United States Patent 11,549,145 (METHODS AND COMPOSITIONS FOR INHIBITING AND TREATING NEUROLOGICAL CONDITIONS) - sequence listing, part 24

SEQ ID NO: 250 - DNA, 953124 bp, Homo sapiens
tatggattcatgcactgaagatgtcatttattttagtttaaaaagcaaaatggaggcagttccttccagtgactaaaatggtttaacttaaagtttaattaacaaaaaaagccacattcccattttccaattcacaaagacaggtttttctttaaaaatatgcctgaaacatattacagataatatcccaaatgattactatgtaaacattgtcattacaatgaaattaatatgatatcagctccatttcacattgtaaacagcaggactgaatgcagaagcctatttagactgtccagtgtttgtgcaggtttttaaatgaaccatacaaaatctacattgttctaccttcttgtcaagaggatccatctgtttccaattattggcctttaactgatgaagttcatcaaatttcatactaatattttctatggacaactgcagcatgtcccaaaaccccgccaaatcctgggaggtgggtcttggatgagcattaggattctgcacaagagaaagaaaaacattcatgctttagaagcaattcttgacaagcacagggccaaaaaggcattttcaaatatttcaaacaacataaggaggactagttccttttggttttccgacacgaggtaaaagtgaggttacaaatgttaattttatacactcatccgtttgagtcagtgattctcaaatgtcaaggttgtaaaactcttctgttgtgataccacatctatcaattcaatatggtatgggggaagggtctaaacatatgaaaaattccagaatgtgtgatctactacaggacgtattttaaaacaccatattcaaatgaaaatgacatttctgaaaaaaaaaatacagtgtattattattagagtttgtattccactacatgccatacaatttattcagagaacagataaggaatctaaaataagattagtttaaatattcatgttaagtaaaacacaaatgattagtaataaaatattggatgttccaagcactatgtgtttaataattaagatgtttactaatataggaagtaattttatcataggaagtaattttatcatatgactgctttgacaaaatcatttgaaaattcattcattttaaattgaccataaaataatatagcaaatgtgagaacacattatctctacatacatctctacatctatatgtctgtaatgacccatttgctaagtgatagtaaacattcttcagtgtttcaggattgactttctttgccccatccacatatccctgataccagaacatataaacctgaatttatatgccctaagacaggaaaaacacagctaggagactgaaaatatcatactctttgttaattactacctgcagcagtagctaaaggcattcatgattagacgggtggcagcctccatatgtcaagagatcctagctggtatctgttttggtgacctcttggtatttcaggcaactggacagactgtgaaactccatgtcctatgataacacgaggccagtgtatgcttttaaaactaacccctaataaaaatgatatcagaattttggaaagtacaaggttgaagaccatcaaaataatggattggaaagacattttaagtccttgggtgcaccagtattattggcctacctcaaaataaaaataaatgaagtctgggcgtggtggctcatgcctgtaatcccagcactttgggagtccgaagtgggtggatcacctgaggtcaggagttcgagaccagcctggccaacatggcaaaaccccatctctactgaaaatacaaaaataatccaggcacgatggtgcacacctgtaatcccagctgctcaggaggctgaggcaagagaatcgcttggacctgagaggcggagattgcagtgagccaaggttgtgccattgcactccagcctgggtgacaagagcgacattctgtctcaaaaataaataaataaacagatagatagatagatatatttataaatttatagttcctaaagtgcccaaaagttctaaagttcattagaagaaataaattttaaagtttataaagttttttttagtttactaaatcagaatactacagagaaaccctttcattaattcagacatcgttagaatagattttaatactgaatcagacacttacaaactttaaaacttattttttaaatgaactttagaattattaggcactttgggaactataaatttatagatatatctgtttatttatttatttttgagacatagcgtcgctcttgtcgcccacgctggagtgcaatggtacaatctcagctcactgcaacctctgcctcccaggttcaagcgactctcctgcctcagcctcctgagtaactgggattacaggtgtgtgccaccatgcctggctaatttttgtgtttttttgtagagatggggtctcacattgttgctcaggctggtcttgaactcctggccacaagatcctcctgcctcgacctcccaagtgctgggattacaggtacaagccacttcgccccgccagtgttttcttgaatgtatttaactctgtataatgggcaactcgttcccttctcataaagaatctctttgctcccacatcattaagaagatagatagagaaacagagagaaagcgtttagcctcagccattctccaaatcagtgagtcatgtgacataccatgcacaacagtggcagctcactccttaatccaagacatgctgccttggagaccagaggtgggtgctggaggggagagtggggagagccaagggaggctggggtccttggtttagttacgttggaagaggccaacttttgtctactcattctaagcctgggagtctagttaggataatgagtaagtgttttcaaaatagagctatgatttttctcctcagaataggaactcaagaaaggaagctgggtctggttctgaccaatcatggtgccactttcatgcagctgtggaccaggccactgtgcctcctggggcaaaggagcatggagctgagtctgctccatgagcaggagtagtgaactcaaatcctgggtaggatgtataaggattgtggttgaatagactgggatttgaatcttggctctgccttttaccatggggctgtgaacaagtttcttagcttttccgtgcccattttcctcatctgtaaactgtcattaaaatgtcactatcgggccgggcgagttggctcatgcctataatcccagcactttggaaggccgaggcgggaggatcacaaggtcaggagttcgagaccagcctggccaatatgatgaaaccctgtctctactaaaaagataaaaaattagctgggtgtcgtggtgggcgcctatagtcccagctactcgggaggctgaggcaggagaattgcttgaacccgtgaggcagagattgcaatgagctgagtttgcgccactgcactcccagcctgggcaacagagtgagactccctctaaaaaaaaaaaaaaaaaaaaaagtcactatcaactccatgtgttctttttgagcatgtaaccagcccagaaatctaaacgctttcagcagggtgtcaggcacatgttaggctcttgacttttttctggaggggcctggtttgaccagcattgcgactgtcttcccccattgtgcctcagtctacctaaaatatgagaagcacattttaccacctatgcccttctagtggccaaggaatgtgagcccatcaagaactaggaaacatcaaaagctggctttaaggaggttaacattttctagaaatctgcaaatttttgggccaggtgcggtggctcacacctgtaatcccaacactttgggaggccgaggagggtggatcacctgaggtcaggagtgcaagatcagcctagccaacatggtgaaaccccgtctctactaaaaatacaaaaaattagctgggtgtggtggcgggtgcctgtaaacccagctacttgggaggctgaggcaggagaatagcttgaaccaggaggtggagattgcagtaagccaagatcacgccactgccctccagcctgggcaacaagagtgaaactcggccgggcatggtggctcacgcctgtaatcccaacactttcggtggccgaggcgggcagatcacctgaggtcaggagtccgagaccagcctgaccaacatggagaaaccctgtctctactaaaaatacaaaattggccggctgtggtggcgcatgcctgtaatcccagctactcgggagggtgaggcaggagaacctcttgaacccaggaggcggaggttgcagtgagccgagattgcgccattgcactccagcctgggcaacaagagtgagactccgtctcaaaaaaaaaaaaaaaaaaaaaaaagtggaactccatgtcaaaaaaaaaaaaaagaaatctgcaaatttttcaaaacttttgtttgcaatttcatctttaaaatatgtacaatgtttacactcttcttcataatatacttgctcatcacatatttcttttaacaaggtatgttgtgttttccctgtatcgtgtacacatggacttccttatgtacctattcttcatgtacatgtttgagcaacacggctttatataagctttcttatatttaaagcacagagaatcatgttaattgagatctgtgacacattagcaagtttgcaaattaacaggagttctgtacctggcccacagctgaagcttgatagaatactcgttggtttaaattcacttattaatacatttactaatataaatgatctcataagccagaataaatttctgaaaaattggaagaagggtgagtttattttttctgagagagggaaaacaaattataaacgtgtgtgtatggggcagggggtgggagggtgtgcgaatagccctaaggagagattacaaagagaaaagagggatggagactaccaccttttccatactttatattttctctcggttgatccctgtctacataaatttctttcagtctgtatttctccttgttaacaagaagtggttaaaactccaaaactggccaagtgcgatggcgtgcctgtaataccagcactttgggaggccaagatgggaggatcatgaggtcaggagtttgagactatcctggctaacaccatgaaaacccgtctctactaaaacaaaacaaaacaaaacaaaacaaaacaaaacaaaacaaaaaattagctgggcatggtggcatgcacctgtagtcccagctactcggaggctgaggcaggagaatcgcttgaacctgggaggcagaggttgcagtgagccgagccgagatcgtgccattgcactccagcctggacaacagagcgagactccatctcaaaacaaaaacaaaaacaaaaacaaaccctcaaaaatcatgcctgtcaattgttggggataaaagaaaaacaaaaaacctctaagatcatattttaagtaatttagattgctaataattgtcttcacttgccaaaaggtaaacaaattgcttttcattttctttgttttagatccagcttgaccaacaattgagcaataaaagctattcttgaaggtttttttttttttttttttttggagatgaagtctcactctgtcccccaaactagagtgcaatgaacctcagctcgctgcaacctccgcctcctgggttcaagtgattctcctgcctcagcctcctgagtagctgggattataggcacctgccaccatgcccagctaatttttgtatctttagtagagacagggttttgccatcttggccaggctggtctcgaactcctgacctcaggtgatccgtctgccttggcctcccaaagtgctgggattacaggcgtgagccattgcgcccagcctgttttgctttgtttttgcatgtccaagaaggatgaattcttcatttgtttcaagaagatcaaatctacactttgtgatgcccttgacttctagctcttgaattaaaacagagaactcagattaggaaatagtcattgactgctattttagaaagaaaatcactatccaaaatgattttttttgggcaatattatttttgaaatatcaagctgcttcatattttgataagaacaataaaatcagaaaagctatgtgaaagccaggaaaatggaaaattttcagttacaaaagaagcaggaaataattttaacttgactgaattttttctaagattatttaagtgaaaaataaatattttaattttaagacaatcaggaaataagattcatcagaaaattctctgttccaagtgagagactccaatggaccttgacttggttcaaaatcagttttactttagttgggccagtcttggtgacatgttcttctcatggcactagcagggaaattgtagaaggagagtgttacctaccaggttttcttcacacagttctctgaactggtagaatttctgggccatgagaagttgggcactgcccactgcggttcggatttttcctagaactggaaagagcaaacatacgagaaatttacacatcatgcttcattgttgagatttagtctggtaaagcaaagaggaagttatgctgtaataattagggaaaatggcacacacacacactgaacactcatgcccacccagacagcccaatcactgttgtcaccctgttggtctgtgtcacagaggctcctgggttaaagtaataaaatcaacttggaaaaacacatgctcctcctgcatatttcttgggagcaatggagttttccagcactgatgttaccaagaactggatgttaccaagagaagaggcaaacagttgttgcttttttttttttttaaacttcctttaccgcaaggatgaatttcaagtgtttaccagtatagctctggattgatggagtcagccgtcatggtcggctggcttgtttttctaaaacaagcccaaacacaaggaaagcagtactaaactagagggggaatctcttggcactcaccatatcccatccacatcctttcttatttttccggagctcagccactggtaccgtcaggaaagagctgtggctgattaaaatattttctaaggagcgaacatgttcagcctgtggcctagaaaacgccagggccgtcccagcttttacactctgcagcccaatcattttgttaatatagggtgaattccctaggcactgtgctgaaaatctccgtctctgcaagcaggctacttcttgtctccccagcagtctaaggcacctttcagctgcctgcaggcgtgctcagaccgagcggagctgctttccgctgagcaatgcccagctctgcagtgtccctggggctcgcctgcaccctttgggactgggtgcagctgccctgctacccaccagggtgttcttaacatgctctcatggtcgggaaggaatcaaaaactagagcaggagaacttctcacaagagcacttgcctctctggaaatcttcacgggatgatatagtacaggatttaagcaatcctgttgttctgaatttacggagccaggtacccgagtggaataagcctttctcaacctcattccccacacattctgagcgacggaaactgaagaataagaaactccattctggcccagggttttctagcaatttgctcctttatttgttttaaactgctaggctagataatggtttctgatgcacattctacctaggcgttactcaagtatttcagcgttcccacaagtcactcagtgcatttatatttcctctaatatgtcaccagccacaccaaacagctcacagacagatatttgccccctccctccgtgatctcgagggggtctcccttgacagctgtctagcagcaatttcttaggcctaagtttttaacaatttttctgctctgcttttaaaatctcttgggatggttatccttttcctctttaactaataaatcaattgtgcaagacctcctctccttttcttaacatccccagaaaggacagcttatggagacacagggcctgagtgggccagagtcctcaatagctactgcctggacaagtcactatctctactttcccatccgtaaaatggggctaatggtacctatctggagggttgttgggaaggttaaaagcgttagtgtatttgaattgcttaggactgtgttggatttacagtaagtacttaataattatttgttattatctaggatcagaaacctctacctcttctatgggtgtgcccactgtgagagccacacttgccctggctaggagagaaaaggaaaaaacaaagtctggatgatctaaggtgactggacatcttggtctcctgggacaggtatgctctctgggtgacctgttccagctccaagaaggtatatggagcaggcacttcctaagtgagcatgtggctgtaggtaagctctgaggtttatggaaacctctgaattatcttgctgaagggtaggactgtgagatcggcaaatctcagaatgaatcctgggaggttatgaccagggtacctaggtctccactttgatggctgggttccatagctcctgggagctatcgcagaaactccagctattctgacttacctaaaaactttgagctgatggttctcaattatgtctgatgcctgagctatataatagactgccataataaaagtaactgagtaagacagtgattctcaaaagaggagacagcactgttctaagccattattagggcaacatgcaaccacacaagttggggctaagtcagatgtcttctcaaaagtaaaacaagggatatctttcttcattcagcatggcctggcaagagccctggcaaagtatctggggtggagttgtggcccttctctttcccgggcttttgccgtcatgttccttgcatggaaattccctactggctccaggatacttgcaattcctgtgtccaggagatgaccgttcctaggcccagggtggggagatgactgcttgggcctagaatgagatcatgaaacagggaggcttgggagaagcagatgacaactcatatttccttgtcctccacactttcttttccggagaactaaaaactcactttaattttaagaaagaagctgtaatggaggttttttttgttttgttttgttttgttttattttttttccattagacactcactctgtgtgtgaggtaagttctttcttccaaaagtaaatttcacatttgttgcacatgccttgaggaagttgaaattaataaacaataaatggtaaacaccagtagaagtaaaaagtggaaataaaaagactgaaagttgataaagaaatgaaatgaagaagaaagaagcatctcgatgttgttttgaaactactctaaaatgttcaataccaaccttcacggtggaaaaaaaaaaaacagttggctctctgtttccatgggttttgcatctgtgagttaaaccaatgttgggtctcactatgtggcccaggctggtcttgaactcctgggctgaagcaatcctcttgcctcagcctcccaaagtgctgggattacaggtatgagccactgcatcctgctgaatttgttttctttttcccttttctctcactcctatgaaatgaagccctacagataaaatatatgttctccactcctatcccattccttttcatccccagaggaaaccattgcagtagagaatgactatttcagtcccatcactgaattcataaggtctcttttctggtcctggaaaggtgatcgctaagggtcattttgagtgttagactggggcaatctcaccagcacagtagcacccatagtcaacatcagcagattttctctgaaagttagaatgggggttttaaagctctatgggtgttgagttgatctctttcacattctggtcatgctttttttttttttacagattgttcaacccagatgtggttaacagtttttgccacccatctcccttagggcacattcaaatgcatcttacagaataattttctctgctgtgtcagccaggcaagccgtttaaccatgactcataccatctatttgtgtaatacttaatcagataataagccttgtattgctgggcagttctttttacataagtaaatctagcctccccagacaccgtataggcacctgatggtgaggcttatagactcctccctttcctttctttccccagctactctgttaatctgtccctcagtggaagtacaaaacaaaacagaaaatgcagttgaatgggattcttcctatttaagaagtaagcactctttataaactcccccacttataattcttcaaacctctcaccccacaacagatatttaagaagacccacaatagagagtacaggcctgggttagtgaatcacataaagtcaggaggaacttttgggaggcctttgtgaacatgtgtttacttaaattatcatcacttagtatttcaaaactcacaaacaggcatctaattagatcctcgcaggaccctgtgaggcagagcagataacttcatttgaaaaaacttgtactcaaactacaaagtttcttccccacggacatctgctgtggccaatccccgtcttctgaccccagtctatttgggctctcttctctctaacactcgcagaaaattgcgtctgaatctacttaagtggaagctatccgagtgtgatttccttcttttttttctttactgtggtaagaacacttaacatgaaatctaccctcttaacaaatatttaagtgcacaatatagttttgttaatggtggcgcagcgttgtacagcagatctcgagaacttattcaccttgcataactttagatccactggacagcaattcccctttccctttccctctccctctacatcatggcacccaccgttccactctctgtttcctgagttttgactattttaagatacatcatataagcagaatcatgcagcatttgttctccagtgactggcttattccacttagcatatagtcctccaggctcatccatgttgttgcatatggcagaatttccttctttttcaaagctgaataatatttcattgtatgtttataccacattccatttatccactgagtgtgatttctgtttatttatgtgtttatttatttatgaatgaggtctcactgtgttgtccaggctggaggacagtggctattcataggcatgaacatggggtcctatagccctgaactccttgccacagccttctgagcagctgggactgcaggcatgcaccactatgccaggctgcatgtaatttctttatcaacatttcccagccagtgccaatggataggggtgagtggcataataagtcagtgggagagttggaagaaattcgccaagcctgatcactgtcccacattaggaagcaagagcaaagcacatccatctacctgaagtgactggcaggcaaggcaatttcaatcctgaacagaaaagaggaaccagggacaccttgaaagagatggtgggtgtttcaagctctttttttcttttacagattatgtgtcataatgagaagcagagaacaactatgttggctgtgggaaaggggagtcttttatgcaatctatgatttgaaatctcctgactacattcaaagacccagccatttagaagagagcatacctcctctttcccactgacctctgtgggataggttgttattttgagaaaaggaggtagtataagaggcacaaggatgaagagaaaaaacactttcctttaaccctcccagtgggtctatggcaaagctgcaaggagtttcagtgtgctggtgatctttttgctgagttaaaatcaggattacaaatccttaagcataattagcatatgcatcctttcctatttcaagaggagttaggtctctagaactaaaaaggcagacgtgctcatttctctgactgcttcttttttttttttttgagacaagagtctcactctgtcacccaggctggagtgcagtggcacgatctcggctcactgcaacctccaactcccgagttcaagtgattctcctgcctcagcctcccgagtagctgggattacaggcatgagccactgtgccctgcctctctgactgcttctaattcttacatgatgctacacctaactccacgatcatcagaccttactttaaggcctcagaaacagagaagaatagacatatttcttataccctcaaagtaggttccctgaagcctggatacgacagacacccctgcaatggattacctctgactggctccccgtggtgaaggttactacggtagatatgctacatagaactcgtcacatttttctgccacctacactataattcacctagtatgtttcattttagtctaactttctctctgggcaatacaggcatgcctcagacatattgtgggtttagttccagaccactacaataaatgaatatcacaataaagtgagtcacatgaattttttgtttcccagtgcatataaaagttatgtttacactatactgtagtctgttaagtgtgtcatagcataatgtcacaaaaaagtacctaatactttattgctaaaaaatgctaatggtaatctgagccatcagcaagtcataatcttcttgcggagggagggtcttgcctcgatgtggatggctgctgtgatcaaggtggtagttgctaaaggtaggggtggctgtggcaatgtctctttttaaaataaatttttttttcactttgtattttttgtagagacaggatctcgctatgttgcccaggctggtctcaagcttctggcctcaagcgatccactcatcttggactcccaaactgctgacattacaggcatgagtcactgccccggctggctgtgacaattttaaaaataagacaacaatgaagtttgccacatcaattgacttttcctttcatgaaaggtttctctgttgcgtgcaatatttgtttgacagcattttacccacagtaaaacttttttcaaaattggagtcaaggggccgggcgcggtggctcacgcctgtaatcccagcactttgggaggccaaggtgggtggatcacgaggtcaggagatcgagcccatcctggctaacacggtgaaaccccgtctctgctaaaaaatagaaaaaattagccaggcgtggtggcgggcactgtagacccagctactcaggaggctgaggcaggagaatggcttgaacccaggaggcggagcttgagtgagccaagatcatgccactgcactccagcctgggcaacagagcgagattccatctcaaaaaaaaaaaaaaaaaattggagtcaaggctgggcgtggtggctcacgcctgtaatcccagcactttgggaggccaagataggaggattgcttgagcccaggagttcgagaccagcctaggcaacatggcaaaaccccatctctactaaaaatacgaaaaattagtcggcctggtggcacatccctgaagtcccagctactcaggaggctgagttgggaggatcacctgagcctgggaagttgagtctgcagtgagccgtgattgtgccaccgcactccaatctgggcaacagaggagaccctgtctcaaaaaaaaaaaaaaaaaaaaaagggagtcaaaatcctctcgaagcttaccactatattatcaactaagttgatgtaatattctaaagcctttgtggtcatttcaacagtgttcgcagcatcttcaccaagagtagattccatctcaagaaactactttcttggctcatccataagaagtaactactcctctgttcaagtttgatcatgaaattatagcaattcagtcacatttacaggcttcacttcgcattctagttctcttgcactttttaccacatctgcagtttcttcctccactgaagtcttgaacccctcagtcatccacgaaggttggaatcaacctctaaactcctgctaatgttgatattttgaccttttcccatgaatcataaatgttcttaatggcgtctagaatggtgattcctttccagaagtttttcttttttttttaatttttaaattattttttcaaatttttttgggtgcacggtgtataaatttatggggtacaggagatgttttgatacaggcatgcactgtgaagtaagcacatcatggagaatggggtatccatcccctcaagcaatcccctcaagcatttatcctttggattacaaataatcctccagaaggttttcaatggactttgcccaggtccatcagaggactcactatctatggcagatatagccttatggaatgtatttttaactaagaagacttgcaagtccaaatgactctttgatccgtaggctgtggaatggatgtcgtattcctctgttttcacgctactgataaagacatacctgagactaggtaattcataaaacagcgatgcttaatggactcacagttccacatggctggggaggcttcagtcatggtggaagatgaaaggcacgtcttacatggtggtagacaagagagaatgatgatagacaagcgaaaggggaaacgccttataaaatcatcagatctcataagacttattcactaccatgagaacagtataggggaaccacccccatgatttaatcatctcccatcaggtccctcccacaacatatgggaattatggaggctacagttcaagatgagatttggatggggacacagccaaaccaaatcagatgtcatgtttgcaggcatgaaaacaactttcatctccatgtacatctctatcagagctcttggttgactaggtgcattgtcagtgagcagcaatattttggaagaaatctttttttctgagccataggtctcaacagtaggcttaaagtgtacagtaaaccatgctgtgaatagagatactctcatctaggctctgttgttctacttatagagcacactttataagagcacacaaatttagcataatttttaagggccgtaggcttttcagaatggtaaatgagctttggcttcgacttcaagtcaccaggtgcctgagcccctaacaagagagtgagcctgtcctttgaagctatgaaagacctacatggcatctcctgccaatagaaggctgttttgtctacattgaaaatctgttgtttagtgtaatcatcttcatcaatgatcttagctagatcttctggataacttactgcagcttctccatcatcactaggaattcaccttgcattatattacagagacagtttctttctttaaactccatgaaccaacgattgctagcttcaaacttttcttcttcagcttcctcacctctctcagctttcatagaattgaagagagttggccgggcgcggtggctcatgcctgtaatcccagcactttgggaggctgaggcgggtgggttacctgaggtcaggaggtcgagacaagcctgaccaacatggtgaaaccaagtctctactaaaaatacaaaattagtcaggcacggtggcgcatgcctgtaatcccagctactcaggaggctgaggcaggagaatcacttgaacccgggaggcagaggttgcagtgagccgagatcgtgccattgcactccagcctgggcaacaagagagaaactctgtctcggaaaaaaaaaaaaaagaagagagtcacaatgtgtctctgattaagctttggcttaagggaatgttgtgcctggtttgttcttctctccagaccactcaaacttcatccatatcaacaaaaaggctgtttcgcttccttatcatttgtatgttcacttgggtagcacttttcatttccttcaagaagttttcctttgtattcacaacttggctatctggcacaaaaagcctagcttctggcttattttgacttttgacatgccttcctaactaagcttaatcatttattgcttttgattaaaagtgacagattgtaactcttcatttgaacacatagaggccattattgggttattaattggcctaatttgaatattattgtgactcaaggcataggaaggcctgaggagagggagagagatgggaatggcaggtcggtggagcagtcagaacataaacaccatttattgattaagttcacagtcttatatgggcacggttcatggagctccaaaacaattacaatagtaacatcaaggatcactgatcacaaatcaccatagcagatagaataataatgaaaacacttgaaatattgtgagaattaccaaagtctgacacaaaaacagaaaatgagcatatgcttttgaaaagatggtgctggtagacttggtcaactcagggttgccacaaaccttcaatttgtttaaaaaaaaaaaaaagcagtgtcttcaaagtgcaataaagcaatgccaataaaatgaggtacacctgtgtgtgggaaaaagtgtaggtgtggggtcaggaacaatcagctcaccaattaccagctattgatcttgggaaagttgatcagactcagactctttttcctttaatggccataatatcatctccatagcattgctgattacttaatggaataatataggtaaacgtgagaatgcagtaggaattctaactcctataactgatctacattctttagttcttgggcatttacctaaaaggtggcagtatccaaaaaaggacatgatttctcctgcaaatcttcacactccaacctccctccccagtagtgtggactaatttgatgtccttttttgctgactttaattcaggcagattttcacaagtgtcactgattggtgaataatttctttttttatgagtataagaaatccataacaatttttcaggggctcagattttagtgcctctctgtataatctagcacagtttcccccagccatcagagctagaacagtggccaactggctgctgggtgacagacacacagaggagacaggaccttaaagcacactggacattcaatcagagccttgctcggaaaacagactcactgcaaaacgaagggtcagagcccaccttaagaatggcagcttctatggcaaaacaaggtccaccttcaggtacagagatgatggcagataaaccccactagcctgtacagctatagtcccatcgtattttccagattgtgcttagccatgtgacttgatgacaccataaaccaatggtccccaaacttggctgatccttcactgctgcccgttagtcctttgcaatgtatttggttacctccctctctaactctaatttcctgaatcttatccattctcaactcaacccctattccctcatcttcaacaaccttgcctcctatgagatgaaaatggagggaatcaggcatgaacactgctgtgatttggatgatagtgtctcctccaaaatatatgttgaaactgaatccccaaggcaataacaataagcggtggggcattaggaggtgattaagtcatgagagctcggctgtcctgaatgaggttagtgcctttattaaaggactcaaggttgaagggaccgcctcttgcccttctgaccctactgccatgcaaggacacagggtttgtcccctctggaggatgcagcaacaggcctcatcttggaagcagagagcagccctcaccagacacacaacctgctggcaccttgatcttggatttctccgcaactagagtaatgagaagtaaatttgtattatttaaaaattacccagtcttgagcattaggacaaatacctaaagcatgtggggcttaaaacctagatgacaggttgataggtgtggcaaaccaccctggcacatgttcacctatgtaacaaacctgcacgttcagcacatgtatcccagaacttaaagtaaaatttaaaaaaaaattacccagtctttggtattttgttggagcaacacaaacaaacaaagacaaatagtcttaatgttctgtgtctcttaatactcttcccccaccaattccctaaacctttctgcccccaccctagtgtcttctctacacccactattcccatctacgtgtgtccttggtctgattctctccctgctaccctgaggccttgctgtgtgagccactccctctctccgaactccttctgccagtgccttacctgagatgtctggcagcatcctcaagtctttcccattctaagtggggcaactcctcccaacctcatggtcccctccagctaacataaaattcctcttctccccctgttattcgctgaattgcattttcctaaaatttacatgtagaattcctaacctccagtacctcagaatgtgactctggagataacgttcttaaagaggtgattaaattacaatgaggtcattctcatgggccctaatccactacgactgatgtccttataagaactggagatgagaacacagacacacacacagaggggagaatcagggaaagggtggtggactgcaagccaaggagagcgacctgaggggaaaccagccccttgatctcgaacttccagcctccaaaactgtgagaaaattaatttctcctgtttaagtgacctgttccatgggtactttattatggcagccttagcaaattattacattccctttaaatccccattctccaaagggcagcatgccttcgctctcgtatttcttctgctctccattgtctccactccctgcagcccagctgcctccaccctcttcaccttctggactctgcctttggcacagaggaaactcagatcccctgggtctcccaacaacgctctctggctgactctgcccttccccgattctgccttccctgtgcttggtagaatttctctcactccaccttgtaaatgttgaacacaaaatgtaatcctgagctcacttctccactcacttccctcattccactttctcgaatttgtgactccactgtgtactgaccccagacgctttagaggagcatgtgtaaccactagctcaacacctcctgtctccccaaatctgtgttcccctcaggattcccttgttgattacaattaggggtacaaggcttgatcaatccatccatagtgtaaatgttatccatcccttgccaatcttggagattgggtttcattaagggaactatagggttttcttatctcatgtaattctcatgctgacaacttttccttggttcccctgctccatatgataagccccagcccccttcagcagggcaggtgcaggccaagctgtccagtttctctctgctgactccttcggtgctccaagcgcccacggcttcccaaatcccccaaggtctttctctcctgagtgtcttcttcacaccaagcactaagctgagactgtctcttccctttggtgccctaggcaagcccctctccctgtatctagcaaagtcctcatccttatgattcagcttgggtgcaccttgccagaaagccttacctcctttcacctctccctcctcactgctcctaaaattcccctgcatagctgtctctgccttttcctcattcttttcaacatgttctgttaatatgtcagatttccgaccagaatgtgagctctttgatggcctagactgtgcccatgtaactaactcctattatctccactgaaggaatatgctttgaaattaactgagttatttacagattctatatcaaccagaaaaacaaactacctgtgatattctgatccttgagcattctaattctttagggttttatcatgtctagcaccactttttaattatagtgttgactaattagctgatatagtcttagctggggtattattcctcttgcattgctgtttgtcatgcaatagttgtagtgactagcctggaaaagtcacaccatctaggataagttgagttgtgtttgtggatgatgaattatatttccttatattcaagttttgcctttttttttttacccacttgcctttttctttcttgctttttttttttttttttttagacagagtttcacgcttgttgcccaggctggagtgcaatagtaccatgtcggctcactgcaacctccgcctcccggattcaagtgattctcctgcctcagcctcccgagtagctgggattacatgcgcgtgccaccacgcccagctaatttttgtatttttagtagagacggggtttcaccatcttggtcaggctggtctcaaagtcctgacctcaagtgatctgcccacctcagcctctcaaagtgctgggattacaggtgtgagccgctgtactcggcctcccacctagctttttcccccaatgttgtagactttaggggtgaagaaagagaaagggaattttaaaagtgggtctatccacttactttaaagacacgtgcagtcaactcttttttttttttttttttggagacctcattctgtcgcccaggctgcagtgaagtggcccaatctcggctaactgcaacctccgccttccgggttcaggcaattctcccacctcagcttcccaagtagctgggactataggggcccaccaccactcctggctattttttgtatttttagtagagacggggtttcaccatgttggccaggttggtctcaaacccatgacctcagatgatctgcccacctcggccttccaaagagctgggattataggtgtaaaccactgcacccagctgcagtcaactaatttttgacaagggcaccaagaggatacaatgggaaaaggatagcctaagtgtaggaccagaaaccacacaactcccagaagaaaacggaagggaaaggttcctcaacattagccttggcaataatgttttggatatcacaacaaaagatcaggctacaaaagcaaaaataaataaatgagactgtgtaaaatgaaaaagctcctgttatcaaaggaaacactcagcaaaataaaaaggccaggcacagtggctcacgcctgtaatcccagcactttgggacgctgaggtaggtggatcacttgaggtcagcagttcaagaccagcctggccaacatggtgaaactccgtctctactaaaaaatacaaaaaaatttagccgggcatggtggtgcatgcctgtaatcccagctactcaggaggctgaggcaggagaatcacttgaacctgggaggcagagtttgcagtgagccaagatcacactaccgcactccagcctgggcaacagagcaaggctccatctcaaagaaaaaaaaaaattaaaaaaaataaaaataaaaaggcatcctacaacccgggaaaaaatatttgcaaaccacataaccaataaggtttgcagactataaatccaaaattaatgaagaactcttacaactcaatagcaagaaagcaactaaccccaaaaaactcaatttaaaaatgggcaaaggtccgaccaggtgcggtggctcacgcctgtaatcccagcactttgggaggccaaggagggcggatcacgaggtcaggagatcgagaccatcctggctaacacggtgaaaccccgtctctactaaaaatacaaaaaattagccaggcgtggtggcgtgcgcccgtagtcccagctacactgggaggctgaggcaggagaatggtgtgaactcagaaggcggagcttgcagtgagctgagatagcgccactgcactccagcctgggcgacagagcaagactctgtctcaaaaaaaaaaaaaaggagggcaaaggtccttgacacagggtttgaacaagacaaaacaaaaacaaacaaacaaaaccagaagaaacaaaaatgggcaaaagatctgaacagacatttctctaaaggaaacataacaacaggccaggtgcatttgctcttctctgtaatcccagcatttttggaggccaaggcaggaagaatgtttgagcccaggtgttcaagaccagcccaggcaacatagtgagatcttgtatccacaaataagaatttttaaaaaattagttgggtctgatggcacacatctgtggtcccagctactcaggagactgaggtgggagaactgattgagcctgggcagttaagtctgcagtaagctatcatcacaccactgcactccagccttggtgacaaagtgagaccttgtttcaattaaaaaaaaaagaaagaaagaaattgtggtatatatataccacatatatatagtgaatattattcagccctaaaaaagaaggagctcctgccatttgccacaacatagatggactggaggaccttatgctaagtaaaattatcttgtattagggcgtcttgtggaataagtagactttagctgctctttcacaaaaaaagtaactatgtgagatgacagatatgttaatttgcttcataatagtcaccaacttactttctatctgtattcaatagcatataaacctcaaatatacacaaaatttatttcaaaaatatcgagtcaggtaggcacagtggctcttgcctataatcccagcactttgagtggctgaggcaggcagatcgcttgaacctaggagttcaagaccagactgggtaacattgtgagaccctgtctcaataaataaataaatgaaagtcatgtggatttgtcattctgagtctgtgtgatttcatggcattgggattatccatgtggagacattctcatttacgagtgtgtccttgcggcaaaaatttccccaacctactgcccagcagctgcttctcagacacacttgtgatccggagctgccatcaacaaaacgtctccatagaaaacgtggatctgtttcattcctgactggcagttgctgatctgcattgcacaacagtgctttttttgttttgttttgtttttagctgaaacttggtggctaatgaataaagaatggattctctagtagaagttttcccatagactaacaccagagtttccacagtgttctgggggaaaaaaaaaaaaatcaacaacattattttgtttttaaagagcaagtttttcaaaaactcagctaattttaatttttttttcccagttccaacccctccaggagccttactcgtagaagatggtcattctttggatcaatatcttgacttatatcagccacgaaatggtagcatcatatacatcatatagataaagacagttttgagcctttgaaagttggatgaaatgaaattagtttctatttccctaggtaatctaaatgaaaaaaactgtatattttatttgaagtccattgcatttattgcatttattttttaatttattttcgacatggagttttgctctgtcacccaggctggagtgcagtggcgtgatctcggctcactgcaacctccacctcctgggttcaagcagttctccttcctcagcctcccgagtagctgggattacatgcatgcaccaccaagcccagctaatttttgtatttttagtagagacggagtttcaaccatgttggccaggctggtctccaactcctgacctcgtgatctgcctgcctcggcctcccaaagtgctgggattataggcatgagccactgcgccccaccagtccattgcatttatatttcacagaaacagttattggagaaaatgataggaggtcttgctccgtgagccagtccctctctttgccatctctggaatgacagaaacaccactggcctaggaacagatctgtttccaggcccagttctgcccccaattaaccacatcacttcacctcttcatgctttcgtgccctcctgagctgggagacaccaccctcaagaagcacatccacaaaaggatggtgtctaatggccttctggcaccagcgctgtgcaaagcggcatgaatggagcattctcaaggttaaacatatggcacattacagccgatttccttttcattactgccacttcctctgcggtcactaatttcaggttgtctggagcttacaaaaagagacatgcaagtatgtgtgtctgtgtgtgtggtggagtgggagggaccttttgagggttcattgcaagagttagatgagaataaaacagaaaggagctaggctagaatgcagccattgctccccacttagaaacacacacgggctggaggcagatgaattgcagaactcacagatacagctttgtctgccacccactgtttcacaggccgcagagacacagcagaggcaatcccaggcggataaaccctgggtgatggcaccgatagaccatcacaatgactgtgcacagtttccgtaaccaaacctgaaaccaggcaaaccccatttcaggtgtcattaccagccccgcattcgctgccaagggtcccaagccttctaggggactgaaggccaagtttcactagcttggatgctattaccaggcaaaattaaagtggaagaattaatctgcctccggcacatgctctaggtttatcagtttgtttcagataaagcctgaaaattccacgtatttgttgtctacaattcagaaggcaaagacagatttagaagtacaatcaccggtatttcatcttagggccattgaaacctgagcctatgttctttccccacagtggtagactgcattcctagttggaggcattcagctccatctggtcgtttcatccccggttagataataccagacgtatctatgtaacatacaagccactgtcaaatagcactgagccatctccctgagacagctgtttcacacaagggcttcattgtctgagaagagctcgtatcattttacttcaagtgctgcgggaacaagcattctgtcagctgtcttggcttggaggaaacctcactcactgcagtttcattattttattatcaagccaaaaaaaaaaaggtactgtcgacggttggggttgaaggtttaaaacaagaactaaagtctttgctctgctttgcatttatcagggaaaacagtaactccaggcacccaaagaatgtatagttacactgttcaaaagatagcttgaggctcctggctactccaaatgcttgttttcggtctgccttttgttacccacatttagtcagtttcaggtgaactaggaaggtgttttccagccctgtgaggccaaaagcagctgtcacaattagcataatgacatcacaaaataattaataactaaataactatttaaaattagatagactctttcttcttcaactctctaatagagaaagatgattacaactaccccacatgcaatatctgaacctcaaatttccagtgagtaaacaggttattttccaaacttttttttttttttttttttttgccatggatgcactgtattttgaattcagggagtcaattaacaaaatacattcttacatgaatatgaacatgaacatggttgttctgcttatctttagctgctgctgcctatttctgagtttttgtttttttagttttttttgttttgttttgtgtttgttgttttttgtttgtttgagacagagtctccctctgtctcccaggctggagtgcagtggcacgatcacggctcactgtagcctcgacctcctgggctcaagcaatgctctcacctcagcctcatgagtagctgggaccacaggtgcatgccaccaagcctgcctaattaaaaaaatatatatttttgtagagatagggtctctgttgcccaggccaatcttggactcctgggctcaagcgatcctcatggcatggcctcccaaagttctgggattacaggcaggagccaccacgcccagtgggggtattttaaaattgtgataaaatagacataagatttgccattttaaccacagtgaagtgtaccattcggaggcattatgtacattcaccaaacattttaaaatatttaaaaattgggataattctggtaccccacaaaataaattgcgtgattagaatcttccgttttttccctctatcctatttatcttttcatgatgacttcaagaccagatctcctggggggattttgttatggcaccacgtttgtcaggcaccctgaagagaggccctccttctgcaggtctgaaacatcccttggcttggccaagggatagaggtatctgtacttgacccatttatcgaagctatttttctggtgtgcacagaattaaaacaaacaaaagctggttgcttagaatttggctatgcctgccaagtgggattggcctctcttccttaccgcccctcttacaaaaaaagaaaaggttaagtcagagaattggtgaaacaaaggccctctgcaactctaggcccagttatcagaacagagtggtgcttgccaaggagtcagggacagatctgcatggcgggctttaaggaggacagtgccaggcaacgcaaagtatcattatcttgtcaaatgttattcatgtgtatctgttctatcagacacttctgttttctgtgaccttggacaagatactgccagagaactgttgtgagggcaaataaaacagcacctgtcaaagtctctaggccatcgtcaggggtattgtgagggcaagatgaatattctttcatgcactgatattttcccttcttcctggagagggttgctactgctttatggtccaattctccctgatctggattggccgcatttgaaattggtgactctgtcctgggcgcagggtttgccacggcactgactagaattttggaatcccagtagtttgaagctcctatttcgtgtctctcaaagtatgaaaaaatagagaaagccttcaagtgtttgtggaatggaactgtgtcttaagaatgagacaggacacacaaggttcatctggactagccacctgtcccacacggaagtgctttccatcacttctgtggcaggtgcccatctctctcttccacatccttgtcctgatcagaagagctcatcatctgtcacgggaacacctttccagcttttggcaacaagaactgttagttacttgctatggtctgaatgtctgtgctcctctaaaactcatatgttgaaacctaattaccaatgtataaatagtaagacagggggcctataggaggtgagttggtcacaggggcagagtcctcatgaatagggttactacgcttatcaaggaggcccaggaagcttgtctgctgcctccatcgtgaggctgcagcaagaaggcgccatctttgaaacagagagcagcccttgccagacaccaaacctgccagtatcttaatcttgaacttcccagcctccagaactgtgagcaataaatttctattgtttataaattacccagtctagggtattttgttatagcagcctgaaaggactgaggtattacttattgaagtttttttttagctaattaggaagaaaggttttgctaagtaaaatacttttataaaacagaatttccagaatatttcaaggactcaaatacatatttactgatcccctgttatgcgtcagagggtctggtgatatgaagatgagtaagacaagaataatttctgttttcagaaagcttactttttagtggaagagaaagatacatcggttattataaaataatgtgggaagtacctgaaggacaaatacacagggcattacaggagcaccagggcgatacccagttcagcttgaacaacaaattaggcctggaacaacagatggttgggcagttccctcatgttcattatcttgggactttgccagcagtgtacatttcaaaatacaaatacgtttctctttcatcctgaacataggctgagaagctggttttctgacaagattttcaacctttcaaatatatgttattgtattacaatacaactgacttgttttcctagctcctttagtttttcctaaatctttatacaatgagtatcctcacacatcattatagagttgggttgagagaggtagatcaagtctcagactgaaaggcccattaaaagaaaacaacagataagtagtttccaagagtcctgttgaaagccagccaggagctgggtgggtggctcatgcctgtaattctggcattttgggaggcagaagtggggggattgcttgaggccaggagtttgagatcagcctgggcaacacagtgagaatctatctctataaaattttttaaaaattagccaggcatggtggtgcacacctgtagtgacagctcctcatgaggctgaggtgggaggatcacttgggcccaggacgtccaggctacagtgagctatgatcccatcactgcactccagcctgggtcacagggcaagactctgccaaaagaaagaaaagaaaaccaaagaaaggagggaagaaaaagaaagaaagagagagagagaacaccaatcaggaagctagaaggagaaccaaatttgagaattgaaatctgaaagtttgtgccattgagcagtggcacgggatgtcattgttccttagttgctggcatttttcctaggaaaatctgataaactgtgagtatgtccacaaggagaaaagtgaataagatgatccaactaagactttcttactgaaaactacccctgctcccactgctgctgagacataccttgtttacctgtcaccagggcaaagacctaattgtgcttgggggtcaacactcaggtgagtctgcagtggcactaacaggggcaaatgtcaaggagatttacttttccactgccaagttgtttgcactcataatatgaagaagcaaaggaaacccatttatgggttttacagaaacccgttaatgaatttcctaacttgcccataaaggcaagcgataagctagtcagtcatttgacaggggtcaggcaggaggagcagactggagctgtgagtgagagagtggacacagtgaagatatccccagtctgatgacaactgttattttccagactccatttcattaaaaaaatgattcccctagggaaaaactcactactctttgacaccactagtttggtgcatttagtaaatgcacttaacatgatttatagtagatgttaaatctaattaagaaattattggccgggcgctgtggctcacccctgtaatctcagcactttgggaggccgagacgggtggatcacctgaggtcaggagttcaagaccagactggccaacatggtgaaaccccgtctctactaaaaatacaaaaattagcttggcatggtggcaggtgcctgtaatcccagctactcaggaggctgaggcaggagaatcacttgaacccaggagacagaggttgcagtgagccaaaatcaggccattgcactccagcctgggtgacaagagcaagactctgtcttttaaaaaaaaaattattgtttttgttacgtacgataatgcatgataatattttacctttttttgagtcggagtctcactctgtcacccaggctggagtgcagtagctgcgatctctgttcaccgcaaactcaatctcacgggttcaagccattctctgcctcagcctcccgagtagctgggatcacaggggccaatctccacacccgactaatttttgtatttttacgagagatggggttttaccatgttggccaggctggtctagaactcctgacctcaagtgatctacccgcctcagcctcccaaagtgctaggattataggcatgagccaccgcacaaggcctatgattatacatataaaaaatgttttctataagtgtgagctacatagggaagtgacacgatgccttggattttctttttttctttttttggagacagagtttcactctgttgcctaggctagagtgcagtggcacagtctcagcttgccgcaacctctgcctctgggtttaagcaattctcctgcctcagcctcctaagtagctgggattacaggcgtgtgccattgcacctggctaatttttgtatttttaatagaaatggtgtttcaccatattggctatgctggtcttgaactcctgacctcaagcgatcctcctgccttggcctcccaaagtgctgggattacaggtatgagccaccacacctggtgctggattttcttaaaaatactctgacaacaataactacaaatggtggagacaagactggccagttgttgaagcaggtgacgagtacatggggactcatcatgttaaactctacttttgtgcatgtttaaaaatgttcataataggccgggcacagtggcttatgcctgtaatcccagcactttgggaggccgaggcgggtggatcacctgagctcaggagttcaagaccagcctgaccaacatggtgaaaccccgtctctactaaaaataccaaagtagctgggtgtggtggcacatgcctgtaatcccagctacctggaggctgaggcaggagaatcacttgaaccctggaggcagacgttgcggtgagccaagatggcaccattgcactccagcctgggcaacaagaccaaaactccatctcaaaaaaaaaaaagaaaaaaaaagaaaaagctcataataaaaattgaaaaagtaatttaaaaaacaagtctaaaaagttacttcatagcaatactcttttagatgctttgcacacagacatgaagcaggcattaatgcctaccaccaaatttccttgtttcaaaaatatcatcagttggaggatccaccattaatttaataataatgtttcagaggaaaataaacatacaacattaaaatacatactgattatatataagctacattctaatttcagaattgttgaaaacatgtaaaacatgcctcagaattgaggtaatttgattatttttctttttcaactgttaatataatttgacaatttttctttttcaattgttaatttttctttttcaaatgttaaaaggtcaagtttgaaaataatagtgtgcaggctaggcacggtggctcatgcctgtaatcccagcgctttgggaggccgaggtgggcggattgcctgagttcagtagtttgagaccagcctgggcaacatggcgaaaccccgtctctaccaaaaatacaaaaatcagctgcacatggggtgcatgcctgtagtcccaactacttgggaggtcaaggctggggtgagccatgattgcgccactccaacttgggtgaggagtgaggccctgtctgaaaaaagaaagaaaagaatagtgtgcgaaaaagagtgtccattatttattttatgtattcatcgtgtatttcactttagcccattcaactgtaataagattataaaatgtgtttctttggcagctaaagggtttgcccctgtaaatcctaagagaaagtgcctgtcaaacaggcttaagaatacaaataggtgggggtttctagcggcctatacgttataagccttgttttaatgctgtatgttaatgagaataacaaaatcataaagaatataaatccccaatgtacctgtatctatggaccttgaaaaaagttagtattatttatatatttatttttagagatgggttcttgctctgtcacccaggctggagtgcagtggtgtgatcatagctcactgcagcctctaacccctggactcaagtgatccttccacctcagtctctcgaagagctgggactacaggtgggcaccactgcactgggctagttagaattattttctttttttatttaaaaagaatttttgtgggtatatagtagatgtatatattcataggatacatgagatgttttgattagaattattttcaatcccctgaggatcagcaacattccaggatcatcttggagaagagggaccaagttagagacatgaaagcacctccacacagagcttggtattttcagaaagaaaaagaacgtcatgggcctagagctaaggacagtgttatatctacccaggagttttcttggttttgtgctgtgcagggacttctggactcagctggaatcacctagctctcctgcatgttctggtttggggtgtggaacgtcaaggttatacaagtgaagctggcagagaagaaaacaacaaggtctgcacacacaaagcaaccccagccccaggggacgggtgtggcacgtggtggcattacttactgtcttcgggcaggttgttttcccgttcttcccgctccatctgttgacaccacccctccatgcggtctcgctctgcctggagaagcttcaggaaccagtggccatcccggtggcacactgacctttgcacggcctccagagggtcttcagtgatagagtcaatccaggggtccggaggaggcagaatagaggggtcaaaatccgtgtcaaagtcatcatcggcggcacaggcatggtaatggtttcctgagccctgaatgctgactgtggaggtgctggcatcgcgggagaactgtctggccatggggccaggacacgaattgtcctctatagattccagagaattttccagattatcatggaagtccaggtcggcctgtactgctgtcgtcacactgttggatcgagtgaacctgcggaagcttgggagaatagaaaaaagaaatttagttagaggatatttctttctttccttccttccttccttccttcctttctttcttttttttttttttttgacagagtctcactctgtctcccaggctggagtgcaagtggcgtgatctcggctcacagcaacctccacctcccaggttcaagcgattctcccacctcagcctcccgagtagctgagattacaggtgtatgccaccacatctggttaatttttgtatttttagtagagaaggggtttcactgtgttgaacaggtgggtctcgaactactggcctcaagtgatctgcctgcctctgcctcccaaagtgctgggattacaggtgtgagccaccgtgcctggcaaggatatttcttgaagcaaaactactttctactttacttggcaggtgtgaccattagaagtctcatcttctcaatcttctctgtgtgtgtgtgtgtgtgtgtgtgtgtgtgtgtgtgtgtgttgggggtggtggtggcaggggtagacccttgaggcaagcatattgattgtcatagcttcaatgtgaagagcacgaatctcatttttgctcaatatggaatattaaagcatatcaagagaaattttataggtggaaaagtgctgaactattaaagccagtagaatgtgcagctctgtcatccattacctgaagtgtccaacttcctccccaaatctggggtgacttaagtcctgaaattcaggttggtgatgagtaaggaaactattcactactatcttagtcggggtaatttgcttagaaatagggaaaaagggccgggcgtggtggctcacgcccgtaatcccagcactttgggaggctgaggcgggcggatcacaaggtcaggggatcgagaccctcctggctaacacggtgaaaccccgtatctaccaaaaaatataaaacattagtcgggcgtggtggtgggcacctgtggtcccagctacttgggaggctgaggcaggagaatggcatgaacccgggaggcggagcttgcagtgagctgagatcgcaccactgcactctagcctgggtgacagagtgagattctgtctcaaaaaaaaaaaagaagaaaagaaaaaaagaaatgggaagaaaggccgtgcgcagtggctcacgcttgtaatcccagcactttgggaggccgaggcgggcagatcatctgaggtcgggagttcgagaccagcctgaccaacatggaataatcccgtctctactaaaaatacaaaaaaaattagctgggcgtggtggcacatgcctgtaatcccagctactcaggaggctgaggcaggagaatcgcttgaatccaggaaacggaggttgtggtgaactgagatcatgccattgcactccagcctgggcaactctgtctcaaaaaaagaaagaaaagaaaagaaatgggaaaaacataacctaacctggaccaaaactatcatgaatcctgcaaagccacatttttccaggggcaactcttaccaagttaagacttcctgaaagcaaactgaagtaagtttctttctttctttccttccttccttccttctttctttctttcctttcttactttctttcttttttttttttttttctgagacagagtcttgctctgttgcccaggctggagtgcagtggcacaacctcaactcactgcaacctgtgactccctggttcaagcaattctcctgcctcagcctcccgaatagctgggagtacaggcatgcaccaccatgcccatctaatttttgtatttttagtagagtcggggttttgccaagttggccaggctggtctcgaactcctgacctcaggtgatctgcctgcctctgcctcccaaagtgctgggattacaaggtgtgagccaacacacccagcccaaactgaggtttcaataattacctcttaaaattaaaactcatttgcctggtaaaggtttacctttctcttagtcatacaggtacaaagccttgggcgcaaacatcagcttatagttctctattagggttctgtatttctgccctctcctgtgcctttaattttcttttcacagttctagcgaggtgatgaaagacaccttgttcacagattaaggctgagcattttacatggatgtccatgagatcagtgtttctcaaccaaagcgccctatatatctctggctgaaccctgcgatgaaggggagaacatggggaaggtgggaggggagagacacgaggagagaagcaaggaactctttctcagatgaggggcaaggaaggcgtgggcctgatgtcatttaagacatacaaaaagagctttgctgcctctggagaagacaggaaacaatgacggaatataagtccactgaagatagcaccatgtgtctgttacgatgccctgtatgtcttttttttttaaagtcgcttcctggcctaatagtttacttattttttattatgataaaatatacataacatacaatttaccagctgaaccattattaaatgtacagttcaatggcattcaatacttaatatattcacattgcatgtgcaaccatcgccaccatccatgtcaactttctcatcttttccaactgaaactgtgcacccatgaaatgctaactctccatttcctcctccccctggccccaggcagccatcattccactttctgtgtctatgagtctgactactctaggtacctcttattggtggaatcatgtagtatttatttgtctttttgtgactggctttttaaattcaacagaacatcttcaaagtttcatccatgttgtaacatatgtcagaatttccttcctttttaaggctgaatagtattcccattgtatgtatttaccatattttgcttacccgttcttccactgatggccacttaagttgctttcaccttttggctattgtgaataatgctgctatgaacatgggtatacagataactctttgagtcactgatttcaattattttgaatatatatcccgaggtagaactactgagtcacatggtaattctgtttttaattttttgaggaacaaccctaatattttccatagtggctacaccattttgcattcccatcaacagtgcaccaggattcctatttctccacattctcatcaacatttgttattttctgttttttgacagaatgtgtgttctgtgatttctgtgtttttgaatgtgtgaggtggtacatttctttgagtagctcatgattgtgccattttaagatagtttgttggccagttgattttcaactgtttcatattcagtagtgccagccttaaacaatagtgcactaaacaatatttatacaacactaaatacaccagattatgtgggattttaaaaaactatcctggactatgctcttgaagccaataaaaactaatattctagtccatcaaaaataaagaatgaccagaacaatacagacaagtagttatttgcaagactgtagaaagactaagagtcacaaaaaggaagagtcatctcaataaatcaattttttctctagagaataaaagtcaagaaaaaaagtggctaaggtattgatctgtgtcagttattaagatggccaaaatgaccaaatacgttgtgattctggccatccattttacgaagataaactagccaaagttgacccatttgctgttttcaaaaaatcaattctgatgaagttatccaacccagtcacttttgtaagctcttaactctcaaatgagccaaaaaaaaaaaagaaagaaaaagaaaaaaaaaatcacatagtgtgaaaatctgaatgcaatgttacaagtctcttgtgctagcaatgaaagaaagaacaattttgcgaaagtggttcttccaacaaccactcatttcttggctgcagtaggctatttctgcattcttcccgttcatccccaaaatgttaactgtcatctgaagctaagctttctctccagctgcatatgtgtgaattggatgactctccttgcaaacagttgacattttggctgttctgctaacatgaaatcccaactatgaaaacattagcctccacgctccaagatcctgtattgccagaggcattacatttccaaacttaaagaagtactagtccctcattgttttcaatcagagcaaactgccacagccagaatctgttccacatataaaacagaatgacctactttcctgtgcctctgtttttatctacacagaactgtactacccgcattcctaacagccatctcctggctatggatcttgcaaaggatccaccttcttagaaaaattacttggcagtagattaatagaagtttgcagtttgcagtgtagtcactcagaaagaaaagttaagtaaaattaaaatggtttgggattaaaagcggcgcctttgaactcaggcagccctgtccaacctgctagtttctatcaattaagttccttaagcaagtgctttcttctactcagagctttcaaagaatgttctgctctacaaaatgatttatgtctttcataagcaaagttccttttgggtgaagagtgcagtcaagttgttattgtttttctgcaattttgataggaacacaaaatgaggtccctagattaatttctttattttttgaaagaattgatcagttcctcgttgatgatatcaacccaaaagctgaacccagtggcttgctgtttcccaacccacagttttcaatcttgaagcttccttggctcttcatgcccctgcaggcacagtgtgtaataattacaacttctgaaaaatgctggccaatattctggcccaagaagcagaaaaccatgaaagcaaagactggatcaaccagtatggaacacaatactctgtctgttctgaatagccagaagaaagtcacttgttagcattcacttctgctgttgctttatgttccttctatgaaacaagtttatatttctaactagaggagtttctaccctctcccacttcctacaacttttctgtacagcaagttacaaatcaaaacatatatgggtaaactgaagaggttccattcttgtccccctgtctgatagagttgcagttaaacaaaagaaattgtgcacaaaaactaagcacagtcattatctttatgacatccatgctttggaactacaagacactcaactgatgagactcaagtcatgaacttatttttaggagagtagcttagtctttccatcatagaatcccctggcctctgcttagcgtctttatccctctcattcacataatggctgcttttcaaggctaagtccagtttcaaagagagcaatgctagcactctgctattctttctttctttgtacatgcctttagacattttaaactaagccttctgtcaaggctgaatatatgtgggatctgaaatgctactcctagaaagtgcaaccatcttggtattttatgaaatggcaccctttcactgatgtaaaaaccaagatgtctcattacataaaataaaagacagatcaaaataaggcacgggcgtgaggagaccgagatcaagaattcaagcttggctgggtgcagtggctcacgtctgtagtcccagcacttcgggaagccaaggcgggcagatcacttgaggccaggagttcgagaccagcctgggcaacatggcaaaatcccgtctccactaaaaatacaaaaattagcctgacatggtggtacgtggctatagtcccagctactcgggaggctaaggcacgagaatggcttgaagaacccgggaggcagaggctgcagtaagccgagattgcaccactgcactccagtttgggcaacagagtgaggccctgtgtcaaaaaaaaaaaaaaaaaaaaaaaaaaaaattcaagctcccccaaaagaggtttacttaggtttactaatttggatcagcttccaaattagaatcatgcatgggagggcgcaggcataagcatcccttgtgcaaaaattcaggtgggaggaaccctcctaccctccatttatatacggttagcactgtcctatcaccagattttaaaactatctcaagacaaacatccatctgttatttcaaatcctctatgttcatcattcctttgcttaaatacatcatgcttgaagatgtctttaaagtaaaggaaaataggataggctttctataaaaaaattttctctaccccaaataattgtgatgtttttctcaaataaaataaagggaggaaatagaaaataatgagagtggacgtgttgtcatctggtaacttctgagagggcccagcatgctgccagcctctttttagcaccagctgggcaggtgctaatacctttgatgggctgtcactataggaaccctggttaggagtctcaacaaaacatccttgaactgaatgtgcccccagaaggaactgctttacctccgcaactggaaggttaggtcactccttggctactgacccgaggtaactaacaaagcatgagcagtctcactaacaattatgttttactgagtcttgtcaaatggaggctgtaggcttgtaagtccgatggttttctttctgcacactaagttattttgaaaaatacataaaaaggaagaaagagagagagaaagagaaggagggagggatggcagaaagaaagaagaagggaaagaaaaggaaaagaaaagaaaaaaggaagctgtgaggcttatcaggagttatgccaagtttcaggcttttgaaatttgaaacgcctgaatgccacgcctttaaaactcaggtgtacagtaaggaactatttggctaggtcatgatattgttaacttggcaaagaaaagagattacttttcaagtgcaatttcaagggtgggtactgggctgtgaggtactccaaggaaactttgaagagtggggactgatccaaagctcctgggttgacaaagaagcaatgttttttgattgccaaaggtctttccaagtctgtggtccctgaactggctgtcagatgttgcctcaattttggctttatgttttaatatcctgcttagttgaaaaggcacaaatcactacaagccctaaagtttacatatttaagtcccttgcgatcaaaagagatcttttatagtagctgacattgtgctataagagaaaacaatgctacctttccacttgcttgttccacccagttacgaaggctgtgagctttgatgtgtgaagcaaggaagattttaaaaactcagaattgggtcacttctggaaatgcaaatggaaacagaggcaatattggtggaaaaaaaaaaaggggtaacagtcctattcactgaggcatttgtttctagagacgaggagtggctctcataatatgtcaccggggctttccttcaacacctctgactcagtctgtgcattcacagatctactggaatggtaggtgccattcacaggcatatttaatgccagcattttttctctttcacattaagtatgtcctggaggtctaaatgttatgtgtaatgtataaaaggtatactaggagagaaggaggttgctccaccaacagaagatcagaaagagcagaaacttttatgcaaatcatcaaaatacgcatctgctcccatttccaccccactgatgtaaatgaaaagatcctggctttccctttaggtatacacacctctgaacacacaaagcttgctctagacattcactattagtcaatttcacctgtttattaaaaattgataaggctggagagttgatgaggcagaaaaagaggccacagagtagtttgccatccctttttctaggaaaagtgttctcttctgattttctggatgctgaaggaaaagagttctcgcagcaacactgaattccacttggatgatctctaaagatttcagacagtggataaatcatttgtaaaggcacagatgaaaatattaagtatacatacaccagaaaaataacatcctggaattcgctttccagaacattgttatgagaccagtagcttctttgcatacccccaagaatgacagttgtcacttgtcagtttgacactgtcagtaaggaactaaggagtatacaattgcaaagtttctgcctccccttaacactttcagttgtgaagatgggcgatgattgctttataaattattacaaattacatcagaaatatctcactttaggaaacgtagccgagttggaatggaggcaggaagccagaacctgtaccacacacttattcacacttatctcttgtttctgaagtggagattatgacagcaatatagctacctgggaactatagtaataagcagaaaggcaaaatccaggacataggtcctaaacttcaactaggagtctctatctatatgtaacacaaccctaaagttgaggaaacactgatggtgttgaatcagagaacttacaccaaaaaatgttattgttgttaatagtagtcaactcccaaattttagagacagagaggtaaagcgactttcaatctggatctctaaactagaatactcttttgttcccatgactccaattttttttttttttttttttttgagacggagtctcgctttgtcacccaggctggagtggagtggtgtgatctcggctcactgcaagctccgcctcccgcgttcacgccattctcctgcctcagcctcccccttagatgggactacaggcgcccaccaccacgcctggctatttttttgtatttttagacggggtttcaccctgttagccaggatggtctcgatctcctgacctcgtgatccacccacctcggcctcccaaagtgctgggattacaggtgtgagccacctcatccggccccatgactccaatatttttccaatacattccaagaccttcaaagccagagagtagtgctaaataacagggcttgccttacttacatataggccagataaaacctatatggacgacttctgtgcatggcaatgatggagtaagaatgactgaacttactatattatctgaaacaactaaaaacctggcaaaatatatgaaacaactgtttccaagacatttgatatcagacaatgaagaacagtgatcactgagatatgggaaacaaatggggcctttgactgactggagcgagtttccagggagtggtccccatggggagtcggcagtctccctgactaatgagacattgctaggggtacgaggaggacaaggcagctggaatttgcatggcagtgtatggaagaggagagaactgcacagagtgaaggtctgagatctgcacgggtcccaatagcatattcacctaagtactgttcaatgcatgactatccaagactgggatatctttattcctctttagaaaacaaacaaacaaacaaacaaaaacatagccattaatctagagtgctgtatgtggcaaaaatatcttttttaaatgaagacaaaataaggacttttttatatacacagaagctgaaagtaggccgggcacggtggctcacgcctgtaatcccaacacccggggaggctgaggtgggtggatcacctgaggtcaggaattcaagaccagcctggccaacatggcgaaacctgtctctactaaaaacacaaatcttagccaggtgtggtggcatgtgcttgcagtcccaggtacttgggaggctgaggcgcgagattgcttgaatccgggaggtggaggttgtggtgagctgagattgtgccactgcactccagcatgggcgaaaaagcgagactccatctcagaaaaataaataaataaataaaaagaagctgaaagtattcatcgccagcagtcatgccctataagaaaggtttaaaatactttctattttcccttttgatttttttctttaacccatgggctacttagaagtgtgttacctagtctccaaaaatttggggattttccaaatatattttagctattgatttctatttaattccattgtggtcagacaacgtactttttcctgaacccttgaaaatttattgaaacttgttttttgggccaaaatattgtctatcttgttaaatgctctgtgtgtacttggaaaaaaaaatgtgtactttgcttttatttatttatttatttatttatttatttatttttgagacaaggtctggcactgtcgcttaggctggaatgcagtggctccatctcagctcactgcaacctctgcctccctggtctcaagggatcctcctacctcaacctcctgtgtagctgagactacaggtgcagtgtatacagttcaataaattttgccctctattaaattctattttgtatatatacaacaataaagtcattttaatttctccattaaaaaaataaatggaggccaggcacagtggctcatgcctgtaatcccagcattttgggaggccgaggtgggcagatcacttgaagtcaggagttcgagaccaatctggcctggccaacacggtgaaactctgtctctactaataatataaaaattagccaggagtggtggcagatgcctataatcccagctactctggaggccaaggcaggagaatcagtcaaacccaggaggtggaggctgcagtgagccgagatcacgccactgcactgcagcctgggtgacagagcaaaaccccgtctccaaaacaaaaagaaaaaaaaaagaaatggaatcatagaaagataattagccccaaagaagtatttttcaaatacttcatacttttccaagtatttcatcaaaagatgaaaaataggaagagatatgaataataaatacaatacggcatacttaaacccaaacatatcaacagtcagtcacattaaatgtaaatggtctaatcactccaatttaaaggaagaggttgtaagattgaaataaaaagcgaaaccaactatatattgcctatgaaaaacctactttaaaaatagagaaataaataggccgggagccgtggcttatacctataatctcagcactttgggaagctgaggtgggcagatcacttgaggccaggagttcgagaccagcctggccaacatggtgaaactctgtctctactaaaattacaaaaactaaactaaactaaaataaataaaaatagagacgtaaatagtttaaagtaaaaggatgaaaaaagatacatggtaatactaatgaaaagaaagctggattggttgtcttaatatcagactaggtaggtttgagatccaaaaatattaccaggtaggaaacaggatgttttctaatgataaagagatcaattcatcaaaagaccataatattcctaaacatttatgagtttaataaagaatttcttaatacataaagcaagcactgatagaactactagaagaaatagacaaattcacaattagagtcagatatttcaacaatactttctcgataatagattaaaaaacatctagacagaaaattagagaatatagaagaattcagcagctatactgaccttattggcatttatagagcactccactgaaaaacaggccaggcttggtggctcacgcctgtaacctcagcagttgggaagctgaggcaagcaggttgtctgagcccaggagtttgagaccagtctgggcaacatggtgaaacgccttcgctacaaaaattagtcgagcatggtggcatgcacctgtagtcccagctacaccggagactgaggtgggaggatcccttgagaccagggaggaagaggttgcagtgagccaagatagagccactgcactccagccttggtgacagtgccaaaccttgtctcaaaaaaaaaaaaaaaaagcaaagtacacattttttttcctagtacacacagagcatttaacaagatagactatattttggcccaaaaaacaagtttcgataaattttcaagggttcaagaaaaagtatgttgtctgaccacaatggaattaaatagacaatagctaaaaaatatttggaaaatcctcaaatttttggagactaggtaacacacttctaagtagcccatgggttaaagaaaaaaaaaatcaaaaaggaaaatagaaagtatttcaaaccgaatgaaaaagaaaaaacaatgtatcaaaatttgtaggatatagttaaagcagtagacaccattagtcaaaaagaattaaggtttcaaatcaatgctcagcttccaccttaaactaaaaatagaagagcgaatgcagctcaaggtaaacagaataaaggaaattataagataaaagcagaaatcaatgaaggagtaaacagaaaaactatacagaagaataaagaaataaaaagctggttcttttcaaaagctaataaaattgataatcttttagcagacagataaaaaaaaaaaaaaggacacatattaccaatatcagaaatgagagccgggcgcggtggctcacgcctgtaatcccagcactttgagaggccgtggcaggtggatcacgaggtcaggagatcgagaccatcctggctaacagggtgaaaccccgtctctactaaaaatacaaaaaattagccaggcgtggtggcgggcgccggtagtcccagctactcgggaggctgaggcaggagaatggcttgaacccccgggggcggagcctgcagcaagccgagatcgcgccactgcactccagcctgggcaatagagcgagactccgtctcaaaaaaaaaaaaaaaaaaaaaagaatgggagaaaatgtttccaaatcatatattaataaggatctagtatccagaatgtataaagaactcttaaaacactcaacaacaaaaagacaaacaacccaattaaataacccaattaaaaaataggcatacgacatgacaagacatttctccaaagagataaaaatggccaatagagacatgaaaagacaatcaacatcattagtcattacagatatatagatccacaccacaatgacatgccacttcatacccaataggatagccataagggaaaaaatttaaagaggaaagtaagtgttggccagtttgtggagaaactggaaccctcatacattgttggtggggatggtaaaacggtgcagccactgtggaacgaattcctatattaactagtaattctattcttaggtatatatcaaaaagaatttaaaacagatgttcaaagacttgtacatgaatgttcatagcagctctattcatgatggataaatagatgaaagatttttaaaaacccaaatatccataaacagatgaatgaataaacaaaatgtggtatatctaggcaattggatattattcactcataaaaaggaattaagtactaacacatgctacaacatggatgaacctcaaaagcatcacactaaatgaaggaggctacacacaaaaggccacatattgtatgattcaatttataagaaatatctagaagaggcaagtccatagagacagcaaaccgattagcagttacagagactgggaggagaaaggaatgcagtgagtactaatgggtatgagatttctgttggtgatgatcaaaatattttggaactaagtcgtgatgatggttgtacaatgttgtaaatgtagttaatgccactgaattgtataccttaaaatggtttaaatggtaaattttgtgttatatgtatcttagtataatttttctaaaaaaaaatcagcaattcaattcatcatattaacagtctaaaaatgaaaaattttttaacatctcaatagatgtcaaagaagcatttgacaaaatccaacatctgttcctgatcataatcctcaacaaactaggaaaagaaaggaacttcctcaagtaaataaaaaggcatctataaaaagaaaaaaaaaaaaaacctaaagctagccgggcacagtggctcatgcccataatccagcactttgggagactgaggggggtgtggattgcttttagctgaggagttcaagctcagcctgtgcaacatggtgaaaccccgtttctacaaaaaatacaaaaattagctgggcgtggtggtacacctcggatcgcgccactgcacatcatacttaaaggtgaaaaactacatattttcatctaagatcagtaacaaggcaaggatgtccatattcatgacttctactcaacattgcactaggccaggtgcagtggttcaggcctgtaattccagcacttttggaggtggagacaggtggattgcttgagcccagaggtttgagactagcctggcaaacatggcgaaaccccctctctactaaaaatacaaaaattagctgggtgtgctggcacatgcctgtaatcccagctacttgggaggctgaggcaggggaattgcttgaacctgggagtgggaggtggcagtaagccaagattgcgccactgcacactccagcccgggcgacagggcgagactccatctcgaagaaaaaagaatattttttaaatgtctggattatttcatttcaggaaattttatcacagttatatatgcacagttttaaaatatcaaatggttctaaaaggctggttatgaaaaatagaaatgcctggcccaattatagagcaattttctacttcagaggcagccacttttaaacactatttctaaataacaaaaataaatctttacacattttttagtgtctgtccttaggaatgctgaagatttagatttctctcacctttccaacactcctattcctcactttctctctctctctttttttttttttgaaaaggagtctcactctgttgcccaggctggagtgcagtggcgcaatctcggctcactgcaacctccgcctcccaggttcaagggattctcctgcctcagcctcctgagtagctgggattacaggcacgtgtcaccacacccagctaatttttgtatttttagtagagacagggtttcagcgtgttggtcaggctgatctcgaaatcctgacctcgtgatccacccgcctcggcctcccaaagttttgggatcacaggcgtgagccaccacccctggcctctttttcttacacacacacatacatgcacttccggtctgtccctgtatttttccattcccctgatatagctgtattattaatttggataactatattcagaacttgttttttatgactatattgttatgaccaggaaatatcattcacaactgaatatgtgttacaggccaaattgtgggccccttccctaaattcatatgttgaagtcctaacacctagtatcttagtatgtgactgtatttggagataggacctttatttaattaattaatttatttattatttatttacttatttttaagatggagtctcgctctgttgcccaggctggagtgcagtggcacaatcttggctcaccacaacctccacctttcgggttcaagcgattttcctgcctcatcctcccaagtagctgagactacaggtgcatgccaccatgcccggctaatttttgtatttttagtagagacggggtttcaccatgttggccaggctggtctcgaactcctgacctcgtgatccacctgcctcggcctcccaaagtgctggagttacaggcgtgagccaccacgcccggccagagcctttatttttaatttgtatttttatttgagacagggtatcactgtgtcacctaggctgcagtgcagtggcacaatcacggctcactgcagcctcaacttcctgagctcaagccatcctcctacctcagcctcccgagtagctgggactacaggcacatgccaccacgcccagctaattttttttattttttaagagagagggtctggctattttgcttaggctggtctggaactcctagactcaagcaatcatcctgcctcagcctccctaagagttgggattacaggtgtgaaccactgcacctggccttagggcctttaaacaggtgattgaggccccaagggtgggctctaatccagtatgactggtgtccttataaaaacaggagattaggacacagacacacacagaggagagacgacatgaagacacagggagaagatggccatttgcaagccagggagagagaccacatgagaaatcaacactgctgacatcttgatccagaaccagaccctttttttttttttttttttttttgtaagacagagtctcactctgtcgcccaggctggagtgcagtggctcaatctcagctcactacaacttctgcctcctgggctcaagtgattctactgcctcagtcttccgagtagctaggattacaggggcccaccaccacgcctggctaatttttgtatttttagtagagacagggtttcaccatgttggccaggctggtctcaaactcctgacctcaggtgatccaccacctaggcctcccaaagtgctgggattacaggcgtgagccaccacgtccagcccaccagaaccagacttatgcctctagcctccaaactgggagaaaataaatttctgttgtttaggacatcagtttgttgtattttgttatggcagcccaaactgactaatattatatacatatatatatatatatatacacatacatataaatgctttttttctgaaatttatcttccaagtccttttgaatttttcagttctgctactatttctttttttctttttttgtaaacgaagtcttgctctgacacccaggctggaatgtagtggtggtcttgcctcactgcaacctccacctcccaggttccacgattcccctgcctcaggctcctgagtagctgggattacaggtgcccaccatcatgaccagctaatttttgtatttttagtagagacaaggtttcaccatgttggccagactggtcttgaacttctgacctcaggtgatctgccctcctggcttcccaaagtgctgggattacaggtgtgtaccactatgcccagccacagttccactattatttctatgaacacttttcttttctttctttctttttctttttctttctttctttctttttctttctttctttccttcctttctctctctctttgtctctttccttctttcttttccctcccctccctccctccctccctccctccctccctccctccctcccttccttccttccttccttccttccttccttccttccttccttccttctttccttcctttttttctttcttttgagacagggtctcactctgatacccaggctggagtgcagtggcacaatctcagctcactgcaccctctgcctcctaggctcaagggatcctcccacctcagcctcccaagtagctgggactacaggcagccgccatcacacttggctaatttatttttaaattgtttttttttttctttctttttattttttgtagatagagggtctcactatgttgcctagactggtcttgaactcctgggcccaagcagtcctcctgccttggcctcctaaagacctgggattaggcatgagctaccactcctagcaagagcacttttcacttctgccccttccctcatctcttccaggtggataagaagattctttgaggaagaccttgacaacttccacatccctcatggatgcttctttactcacctttcctctcttttctctcaaaaataactttttaattttctgaatgttcctgaacaatttttgtttctagttttctggctcttgtcttatctccctgagtttgctgatccttgtcttctcattcttgagaagcacactaaacccagcttagaagtctatgcttttgggaagagcttatcctctctaatcctcactgtagggtgatctggctgggctttcatcttgcaaaatcccggatgtcagcatcttctggtctttgggctcagaagggtcagccctccacaatggactctgccacactgccatgtagagggttctgtgccttgctgtcgggaccctgggggctgagcgagcctaagaaggctcagggcagtgtgcctcaacactgtttgtatatcttcacttaatcctcctattttcagtatagtcaccctgctctcaactatgctggtctcctccaggccagagacccttagttttagcctctgaagaagagacaccctcagtctctgtcagggtaaggaaggactgtcacttggctccgcagattcaaggactttttagctccatcttcatccccgctttcagagcgcccaatgccacccatccacatgcattttgtgggttcttaaatttaaatgggattacatcttggattcctgcactactggctttcgattcagctttctctggtctgccaaatcggttgtcacttccatatctgctttctagcttgctaaattttgctgtttttttttttctctcttgttctcttcctccttgggagttaatgccaaaacaaacaaaaattccttttattgtcatttagtttcagaaggcctccaagatacatgtgtatccttttttttcaccatctttaaacagaaatcatctaaaagtaatgttgataatccggcagaaggagaaaggggcagaaattatggtcctcctatgaatttgagtattgtgcattcattaaaagaggtgtttgctatgaattttcaatagtaaaaagaaaactttttaaataatgtttgttgattttaaagatgttgtaagactatacataggattattccaccaactctttaaatgttcgtggaaaaagtgtgggtaaaaatatacttatttatttgttcatggttaatggataggattatgggcgactttattttatttctgtaatttatacatttttacaatgtaaatactactttgtttttcttatcattaattgcattgttcaataatatgtaattactgtggaaaaggtagataatacgtaaaaagaagatacatacacacatagtttttttgttttttgtttgtttgtttgagacagagtctcactctgtcgcccaggatggagtgcaattgcgtgatctcagttcactgcaacctccgtcttccgggttcaagcagttctcctgcctcagcctcccgagtagctgggattacagatgtgcgccatcatgcctggctaatttttgtatttttagtagagacagggtttcaccatgttggccaggtggtctcaaattcttgacctcaggtgatccacccacctcggtcccccaatgtgctgggattacaagcgtgagccaccacgcccggcccacacatagttttttaaaaaattactccaaagcctatcaaaattaaaaactgttaatatgttaagatatgttttcttccaagtaaatttgcatactacttttgtaatgaaaacagtaatattcttcctctttgtgtccactgctggagtcttagagtcactaatgggctaatgtaagaaagtctagtttgaagccactgttaaaatagaattgttatttggaaggaaatgggagattcctgggaacctcttagctttctcacctaagtcaacagaaaggattggcttactagatttgctaattatcagcctgaaagacaaaaggacctcatacaaattcctggggaccatcaaaaggatgagagacaattgggacatgatgctggagacttctgcatggggccactggcggaggtgagtgccccttggggagatgttgccaagatttgcctgctttacttaggatcagtcctgcatatcagcaaacacatgctatgtgtgtcctatagagcggtaccactagctgacctgtgaaacaggaattgggggaaaacagctaatgtttgatgaagatgatgggtttctgcactggcttgagaggagcagtctcctttcaaaacgacatacgcattcattatccctggcttcctgctgccacggcatttaaactagtgatcttcagacagcattcctctgtccacggtcctcaccgcgaggcagccccagagaatggacaatgtgcatttgcgatccatggcattttgagaatgtcatggtggcctgcaaatgtaacagggatatttgtgatgctccatttcaactcctgttattgaagcagatagggctacctggtgcattttagtttttactaatgagtttttaacttctttttgttttgatttggaacactgaaaaccacactaaatttagaagtctactccttaatagatcaatcagttaggtgggccttgctgggttagtttttgttcctaaattataattgattcaaaaggaaatgagtcccttggcctcttacaaggtcttttaatcatttctttgcactatctctttctcagctcaattttctttctttttctcactttttgttaggttgctgtcttttatcagtctgtttatttgaaaaaggaagagataagttgttaactggccattcagtgtgaaaacaacagcctcacctttatcaccagataattaaaaaaaaaatacccctcagctgtcattaagtaatcccatctgcccgatattgctttttaagatcctatctaaatgaattacaaccagcaaaatcataaaagaattaagttagagacagaaggtattggtaatcccttcttcctgtttgacaatggatttcttttggagaggttgaaaacaatcattaacatcaatttcaatgcttatttactttacagtggttaactataaagtgacctttgaagaagggtatgttttggaaagctaagtactaaaattggcctgccaaccgttttggggatgagttttaaatattttactcagtttactgaggaactgaccattctacaaacttcaataattcaaataaagttcaactttaaaaaataatgataaaaatggctcgtataaagttttttaggttgctactaggtatgaccaaacaatgcaatatttagcattattgtggaaatgaaatttgaggccgggggcagtggctcacgtctgtaatcccagcactttgggaggccgaggcgggcggatcatctgaagtcaggagttcgagaccagcctgaccaacatggtgaaaccccgtctctactaaaaatacaaaattagccgggtgtagtggcgtgtgcctataatcctagctacttaggaggctgaggcaggagaatcgcttgaacccaggaggcggaggttgcagtgagccaagatcacaccattggactctagcctgggcaacaggagcgaaactccgtctcaaaaaaaataaataaataaacaaataaatttaaaaacctggaaagatagactggctgattgcaggagaaatgtttgaagtaaagtaaaggagacgactttctcctccttttttttgaagaaaaggcagcataattattatcttgaaacttctttctttagagagattctatttgagtgcttaatagactaggaaacacgcagagcattgtatatatcaggtattgctctaaaagttttacatgtattaaacaaaacaccccaggacaacacactgaggttaatgctatagtccgctttcctccaacccctttttaaaattaataaactttgtttttttagaacagttttaggctcacagcaaaattgagcacaaagtagggaactcccatacaccccttcccccgacacacacacagcctcaactgatatccacatttcacactagagtggcacttttggtgcagttcaggaacctacactggctgtcattatcacccaaagtccatggtttacagtagggttactcttggtgttgtacattctcgtatccaccgttgcattatacattcagaatcgtttcactgccccagacatcctcagcctattcatacctccttcctcctaacccctggcaactagtcatctttttactgtctcgttgcctttccagggtgtcacatagttggaatcatacagtatatagatttttcagattggcttgtttcacttagtaataatacgttgacgtttttcccatgtctttttgtggctcaatagcttattacttttagtgctgaataatattctattatctgtatgcaccacagtttatttatccattgacctactaaaggacaacttggttggttccaagtttgggtgattagaaatacaggtgttataaataaccacgtgcaggattttgagtgaacataagttttcaattcatgtggataaattccaagaaacaaaattgctgacttgtatggtaaagaatatatttagttttgtaagaaactgttgattaggcaaggtagttcatgcctctaatctcaacacgttgggaggccaaggcatatggattgctcatgtctgatattataagagtaatttgtgtcttctctcttagttagcctagttaaaggcttatcattttattaattttttcagagtcaggttttggttttgttgatttttctctactgattactattttcaatttcatgatttctgttataattttatttatttcttttattgtgtttattttggatttaatttgctcttctttttctagtgtcctatggtggaagcttaaataattgatgtgaaattgttcttcttttctaatacatgcaatcaatgctataactgtccctctaaccactgcttttgcctcattccataaattttaataagttgtatttctgccgggtgcggtggctcacgcctgtaatcccagcactttgggaggctgaggttggtggatcacaaggtcaggagtttgacaccagcctggccaatatggtgaaactccgtctctactaaaaaaatataaaaattagctgggtgtggtggcgtgcccttgtagtcccatctactcgggagactgaggcaggagaatcgcttgaacttgggaggcggaggttgcagtgggctgagatcacaccactgcactccagcctgggtgacagagtgagatttcgtctcaaaagaaaaaaaagttgtatttccatttatttcaaaatatttagtttcttgagatttatttgactcatttgtaatttaaagtgtgctgttaaatctcagtattttgggaatttccagctatccttctgttgttgatttctagtttaattctactgtggcctgagagcagatatgatatgatttataattttaaaaatttgttcatgaccagcctggccaacgtggtgaaaccctgtctctactaaaaatacaaaaatcagcctggcgtggtggcgggtgcctataatcacagctactcggaaggctgaggcaaaagagctgcttgaacccaggaggcagaggttgcagtgagccaagatcacaccattgcactccagcctgggggacaagagtgagacttcgtctcacaaaaaaaaaaaaatggttaagatctgttttatgacccagaatatgttctgccctatctaggtgaatgttccatatgagcttgagaagaatgtgtaatctgttgttgttggatgaagtagtttatagaagttaactatatttagctgttcagtagtgttgttgcattcaactgtgtgcttactgatgttctgccttcttgacctgtccatttctgatagagaattgttgaagtctccaattataatagtagatacatctttttctccttgcagttctatcagttcaagaactcatgtattttgtagtttttgtttgtttgtttgtttgttttgagactgagtctcactctgtcacccaggctgaagcgctcttggctcactgtaacatccacctcctggattcaagtgactctcctgcctcagcctcccgagtagctggaaccacaggcacgtgctataacacccggctattttttgtatttttagtagagatggggtttcaccatgttggccaggctggtcttgaactcctgacctcaagtgatccgcccaccttggcctcccaaagtgctaggattacaggtattagccaccgggcccagctagaattcatgtattttgaaactctgttggtaggtgcatacatgttaaagatttttatgtcttctttgagaattgacccctttatcatcatctttatccctgataattttctttgctctgaagtctgctctgtctgagattaatatttctactcccactttctttttattagtgctagacattttctctttttccattcctttacttttcaatctatatctgtctttatatttaaagtgggtttcttgtagacaacatatagttaagtcttgttttcttatccactctgacaatctctgtcttttaatgatatatgtaaaatactaatgtttaaccctgttcctatttgccctgagaatacttgctggtggcacctgcagctacagcctttaacccaagataactttgccacaaaatattttgttttattattattttcacattgctctagtatattgactttggaaacaaagacatcatcctatttatagcattctggtcttagcagtggtatttccatttagaaaatatagtaattctccattgctgaaaatggcaaatcctagaaaacgtagcattcctacacgtgatgttaacattgtcctcaaagagttgtggccgagattcatttgatgaatccaatttttctgaaatagatgattctgatgattcagatgattctgatgttagttctgtttagaaataactcgaagaacagtttttacattttattttcacattgaaaatcagtcatatttgcttcggcctcaaggagtgtgtttatgtaaaattaaatgagcgctgacagccagctgcacattttttctaaatgggaaaagggttaaactgattatctagttggattaacatctaccatatttgttattattttctattttttcacctttgttctttcttcttatttttgtctttcacattttttctgcttttaatagttttctattgagcatttatatgattgaattttctctcctttcttagcatactaattttatttttcttttacctctttttagtggttaccctagagccctagagtttgcattatgcatttaccacgaatccaatccactttttttttttttttttttgcggagtctcgttctgtcgcccaggctggggtgcagtggcacgatctcagctcactgcaacctctgcctcctgggttcaagtgattcttctccctcagcctcccgagtagctgggactataggcaagtgccaccgtgcccagctaatttttgtatttttaatagatacggggtttcaccatattgtctaggctggtcttgaactcctgacctcgtgatccacctgcctcggcctcccaaagtgctgggattacaggcatgagccactgctccaggccccaatccactttcatataacactatgacacttcacaggttttgcgagtactttgtaataattaataatttccaattcctaccacttgttccttgtatcattgctgccattcatttcatttatacatgagtaagtaaatgtacatatatttaaatacatttttgctattagtattttgaacaaacttatctgttagatcagttaagaatgagaaaaatgggccaggcgcagtggctcacgcctgtaatcccagcactttgggagggtgagatgaccggatcacgaggtcaggagatcaagaccatcctggccagcacagtgaaaccccgtctctactaaaattacaaaaattagctgggtgtggtggtgtgtgcctgtaatcccagctactcggtaggctgaggcaggagaatcacttgaacctgggaggcggaggttgcagtgagctgagatcgcgccactgcactccagcctgggtgacagagcgagactccgtctcaaaaaaaaaaaaaaaaaaaaaattagccaggtgtggtggcgtgggcctgtaatcccagccactcgggaggctgatgcaggagaatttcttgaacccgggaggcagaggttgtggtgagccaatattgtgccactgcactccagcctgggtgacagagcaagactcagtctcaaaaaaaaaaaaaaaaaaagcatgtttatgtaaaattaaatgagcactggcagcaagctgcacatttttttctaaatgggaaaagggttaagctgattatttatctagtcggattaacatctaccatatttgttactactttctatttttttgcctttgctctttcttcttatttttgtatttcacattttttctgctgttaataattttccattgagcatttatgtgattgaattttcttttctttcttagcatactaattttacttctcttttacctctttgtagtggttaccctagagtttgcattatgtatttaccacgaatccaatccactttcatataacactgtgacacttcacaggttttgcaagtactttgtaataattaaatatttccaattcctaccacttattccttgtatcattgctgccattcatttcacttatacataaataaataaatgtacatgtatttaaatacatttttgcaattgctattttgaacaaacttatctgttagatcaattacgaatgagaaaaatgagctgggcacactgtcccacgcctataatttcagcactttgggaggctgaggtgggcggatcaccagagattaggagtttgagaccagcctgttcaacatggtgaaacaccgtctctactaaaaaaaaaaaacaaaaaaaaaaaaacaaacaaaaaatagccagatgtggcaggtgcctgtaatcctaactactcaggaggctgaggcaggagtatcgcttgaacctgggaggtggaggttgcagtgagccaagatcctgccactatactccttcctgggcgacagagcaagactccatctccaaaaaaaaaaaaaaaaaaaaaaacagaaaaatgaaagtttttattttagtttctgacctatgtcattttccttctctcagaagaacttcttaacatttcttgaaggtctgctggcaacaaattccctcaatttttgtttatctgaaatagtctttatttttctttcacttttacggataatttcacagggtacaaaattctagatgggtgtttttggttttttattctcctaatactttaaatatttcactctgttcttgcatggtttccgagaagttggatatacttctttcaatttttttcgtttttgagtgtttttatagtgactaagcctcgctatgttgctattagtccgttttaacgctgctgataaagacatacctgatactgcgcaatttacaaaagaaagaggtttatgggacttacagttccatgtggctggggaggccccacaatcatggcataaggtgaaaagcacatgtcacatggtggcagacaggagaagagggtaaccgggcactgtggctcacgtctgtaatcccagcactttgggaggccgaggcgggaagatcataaggtcaggagtttgagaccagcctggccaacatggtgaaaccctgtctctactaaaaatataaaaattagcaaggcgtggtggcgggcacctgtaatcccagctactcaggagactgaggcaggagaattgcttgaacccaggaggcagaggttgtagtgagccgaaatcatgccattgcactccagcctgggcaacaagagcaaaaactccgtctcaaaaaataataataataataattatatctgtgtggccacagttacccaagtggctgtggtggaaggattgcttagggccaggagttcaagtccatcctgggcaactgatatggttttgtgtgtccccactcaaatctcatcttgaattgtaactcccacaattcccacccgttgtgggaggaacctggcaggaggtgattgaatcatgggggtgggtctttcccatgctgttctcatgataacgagtgggtctcatgagatctgatggctttaaaaatgggaatttccctgcagaagccctcttctctcccttttttttttttttttttttttttagatggagtctcactctgtcacccaggctggagtgcagtggcgtgatctcggctcactgcagcttccacctcctgggttcaagtgattttcctgcctcagcctcccaagtagctgggattacagacacgcgccaccacgcctggttaattttttttttttttgagactaagtctcgctgtgtctccgaaagtgttgggattacaggaatgagccactgtgcctggccagatataactcttatcttttatcttttttgtttgtttgttctgtttgtttatttttgagacacggtctctctctgtcgctgaggctggaatgcagtggtgtgatctcagctcgctataacctccacttcccaagctcaagcaatctttccacctcagcctactgagtaactgggaccacaggcatgcaccacagccagataactttttgtattttttgtagagatgggattttgccatattgcccaggttggtcttgaactcctgggctgaagtgatccacccacctcagcctcccaaaattcagggattacagatgtgagccactgaacccggcctagttcttatctttgctcctctataggtaagatgttctttccctctcacttttttcaagatttttaaagtcttatttttctgaagtttgaatatgatatgcttaggtgtagttttttggtttgtgtttgtttgttttggcatttatcttgtttggtattctctgagcttcctgaatctgaggtgtctgacattaatttgggggaattctgttattattgcttctaatattgcttctgttcctttctccatcctctccttcttgtattcctctctcatgtaaagttacacctgttgtagctgtctcactgttctcagataatctgttatggcttttttttgtttttttggtttttttttttgagacggaatttcgctcttgttgcccaggctggagtgcagtggcacgatctcggctcaccacaacctccgcctcccaagttcaagcaattctcctacctcatcctcccaagtagctgggattacaggcatgcaccaccatacccggctaattttttatttttagtagagatggggtttctccatgttggccaggctggtcttgaactcctgagctctggtgatccgcccaccttggcctcccaaagtgctgggattacaggcatgagccaccgtgcccagctgatctggctttttatcagtcttctttctctttgcttttcagttttggaagtttctattgttatatcctcaagtttagacattagtgtccagtttactagtgagcccatcaaagatattctttgtttctattagagtgttttttatctccagcatttctttttaaatctctcttagaactctttttcattctccatctctctacatgttctgcttctttcattagagcccttagcatattaatcataattagaaaaaaatcttggcccggtaattccaacattcctgccatatttgactctggttctgatgcttgttccatctcttcaaactgtgttttttaccttttagtatgcctcgtaattttttgaaaagtgggcatgatgtactgggtgaaaggaactgtggtaaattggcatttagtaatgtactggtaaggtgtgtgtgagggaaaagtgctctacagttctatgattagtctcagccttttggtgagcctgtgctcctggtctgtgaacttcatcagtgtttctcagttgtttttatttttttctcttacgtgggataaggtgcctgaagggggctgaggttgggtatgtcccttcccccatgtggaaggctagaggaaactagagctgagtgttttccttcccccaggtaggttctaggctctgataaaaccccagccagcaaaaggttctggtaaaatagtttctgctgcgtgcaggccctgtgaataagaagagaaagtgctggcatatttcaaagtagttattttttccttcccctttctggaagcacaaggagattttttttctctgatattcactttgaggacctggtagagttcctggaggtaaaactcacaaaagtgtgagctctccctatgactgggtttccttggagcttttaactctcagagttgtcaatattgagcctccaacaattcttcagttactgcttacgttttcttaccctgtgctggttcctgcagagatttctacttgtgtttctactccagtaagttgtaagtctctgtatctgtctgtttttccaattttgggagaagcagtgtgccctgtgacctcccttctctaagagatatacaaagagatgttgattttttagtttgttgagatttttacttgctaagatggagtggtgacttccgagttccttttagcttatagtggaaactgcttgtaaccccctttttacatataaggaaactaaggcacaaagatgggtagtaatttgcttatggcccctcagttagtaaggggcacagccaggatttggtgttctggctcaagagtctgtgctgtcaaccactacatcgttgagaaaaggcaccaagctgggctggtgggagatggaggaatatattttctttttctttttaagacagagtctgctctgccacccaggctggagcgcaatggcgtcatcttggctcactgcaatctctgcctcctgggttaaagggattgtcctgcctcagcctcccgagttcctgggattacaggaacccaccaccacgcacagctaatttttgtaattttttagtagagacgggtttcaccatgttggtcaggctggtcttgaactccttacctcaggtgatccacctgcctcggcctcccagactgctgggattacaggcgtgagccattgcccatgtccaggaatatattttctttaatgtctactaaatgtatactttcaaaaatttttctaaaacacttaataaagaaacatatgcctaggacattaaagcaatgattaccggcccagcgcggtggctcacgcctgtaatcccagcactttgggaagccaaggcgggtggatcacaaggtcaagatgatcgaaaccatcctggccaacatggtgaaaccccgtctctcttaaaaatacaaaaattagctgggcgtgatggtccgtgcctgtagtcccagccactcgggaggctgagtcaggagaaccgcttgaacccaggaggcggaggttgcagtgagccgaaattgcaccactgcaccccagcctgggcgacagagtgagactctgtctcaaaaaaaccacacacaaaaaacaaacaaacaaaaaaaaatgattactaaaacttttcagagtaaaagaaaaaagtcactcctaaacctaccatttgtacgtattacatttcagtccttgtccatctgcatgaacactatgcgtggatattatatattaaagtttttcacctaacattgtatcatgggaatttccccatgtttctccacctttttaaataaatgatatttaatagctgtataatagtttaccttggtgaggtgctataaattacaaaagcatgctattattggttatttgataattagtgtttttcttttacaatgataaataatgtttcacaattgtttacctttcattgagtaatttaactcaagccccaagagtgtgatttttgggtcaattggtacggatagatgtgtaactattgctaacttttgtcatatttgtttccagaatgatcgtaccagttttctgggcttccagcattgcataattatatcaggttggtgcaaaagtaattgaggtttttgccatattatacacacacacacactatatatatatattacatatacacacatagaatttattaataaatatattaactatatgtatatgatatatatacacacctcttaaaagtatagtgtcaatcaatagtgagaggttctaaaacaggaccatttccataaactgataaattcctccttttcagattttcagtttacgttacatgtagccttgattataggaggcattccatagattttattgaatggatggataatggaaggatggataggtgacattcaaatgattcttcctaattaacacactgaaagttagtagcaaagttgagatgatacactgatttataatttagagtagtttctctcaccgtaactccagttttactttattcagccaacatttgctgtatatttagtatgtgcaaatcacaatgctggaagctgggggtactactagcaataaaacatggttctacccaccaagaaactcccagtttgagaaattcacatgcctctctccatcagattctcatttacaacatgaaattattgaccccaaattctgtaattttatgaaatcctacatttcccatttatagatactaaggctctaaagtaggtaaagagtaatctgaaggactggtgattcaggataatgacagggaatatcttctttttcattcattcattcattcattcattcatcattcattcattcatcattcattgagcacacactaaacaccagacactattaagtgttgggaatagaaatagaaataaggtaagttctcttctcataaaaagtgcactgtctcatatgggaaggtctcttattttttttgttttcagaggtatagtttggcaacccaagagtactgcacacagtatttatatgtatgtaatatgcttacagtactattcaaacaaaactcaaatggagtggtgtctagtattaaagtacaggagagaatcaactaatattgattcaacttcaccctttaaatactcccaaaacttagaggaaaatatcattgaattttgtagacttatcacggggaaaaatgcttttaccttacttcaaaacatcaagacaaaagaggatgcgtgcatgtggacttaccacttctcttcttctacttgcactcccacggactggaacttactgggtgctttattctcccctgttttgtcaggttcttcagcatcatccacctggagaaatcatcaaataaatagagttgttccatttcagtcatcttgcttgaaaaacaaacatcacattttatgagaaaaatctctaatatgactggaatgttttgtaatttataacctccttgttcaatatttgtgtacactaccttcactgcacgctctttgactctgttgctgttagtaaaatgcaattttatccactctcaaggtagctgataaatgtttatgattcctccacagatttgcaagtctgtacttagacttaagtatcttactgtaaatactatattagaagggaatctacatggaaatgtgttcttggaagttttttttttctaatagagtttccctctgtcgcccgggctggagtgctgtggtgtgatctcagctcactacaacctccgcctcccgggttcaagggattctcctgcctcagcctcccgaatagctgagattacaggtgtgtgccaccatgtccggctaatttttgtatttttagtggagacaggtttttgccaagttggccagtctggtctcaaactcctgatctcaagtgttctgcccgcctgggcctcccaaagtgttgagattacaggcgtgagccaccacgcccggcctggaagttttgaatttgaagataacaacatacaaaataaagaggaaaatttatatattgtaattataattgttgacattgggagatttagatattaaccttattaagataaactatagagtgtcttcatttttctccccttaaataaagaattgactttgaatatcactccatagtttctaaatagctatgtgtatattacagctatatagaaaatataccatatagaactaataacctatgcaacagattagctccaacccaaatttgaagaaaattttagaattattaggtttattccgttttcctactatgtgtttaagaaatgttgtctctaaatataaagacaattcaatgtaagttatataaaattaaaatacagaaatatataatgtagaaagagaaagtctcccaagaattattgtcaattatttgatgtatatttgtctatctttatatatatgtctaaatatatatatttaaatttttgtttgtttgtttgtttttgagatggagtctcactttgttacccaggctggagtgcagtggcacgatctcggctcaccgcaagctccgcctcccaggttcacaccattctcctgcctcagcttcccaagtgtctgggactacaggtgcccgccaccacgcctggctaattttttatatttttagtagagacggggtttcactgtgttagccaggatggtctcgatctcctgacctcgtgatccgcccgcctcggcctcccaaagtgctgggattacagccatgagccaccacgcctggcctaaatgattattttattttattttattttatttttgagacagagtctcactctgtcccccaggctagagtgcagtggcgcaatctcagctcctgcaacctccgcttcccgggttcaagcaattctcctgcctcagcctcccgagtagctgaaattacagacgcgtgccaccatgcccagctaatttttgtatttttagtagagatgggatttcaccatgttggtcaggctggtctcgaactcctgacctcgtgatttgagtgcctcggcctcccaaattgctgagattacaggcgtgagccaccgcacctggacaaaaatatttattgacttcttatgtttctatctgtaagttgtctgttcatatcctttactagtctcctccctaattaggctgttttttattttcttaatcataggatctctttatattttatgaacctaaactctttctctgttacatatactgcaaaagttttctctcagtttatcatgtgtcttttaaactttgcccttcattggagagagtcttaggtagtcacatccagcttttatggtttggaaaggctttttctctgagcatatttttaaaagtcttcttgtattttcttttatgctttcatgttatctttttttcgtatttaattcttaaatccaccatcctgaaatgtttctgtcaaagacacatacctagagatctactattaccctcctgtactacctcccttgggttatgaatggatctggctccgtttattaactaattcgccttttttatttgagatgccagctttatctgataccaaactttactcacatatatttccccatacattctcatataggcattctcatatacagtcatgacacacatagtgacatttctgttaacgatagagcacatatacaatagtgatcataagattataatggaactgtcctgtgcagaagtaccattctgtatcttttgtactgtatttttactgtaccttttctatggttagatacacaaatacttaacattatgttataatggcctacagtgttctgcatagtcatatgctgtacaggtttatagcctaggagcaatgggccatactatatagcccaagtgggtagtatgctctacctcccaggtttgtgtaagtaccttctatgatgttcacacaatgacgaaatcacctaataacacattttcccaggtgtatccctgtcattaagtgacatacatataaagacctgtttctggcctattgatctgctgggcttattgaccttccctctcctttttcctaaatttttttttttttttgagatggagtttcactctgttgcccaggttagagtgcagtggtatgatctcggctcagtgcaacctccacctcccgggttcaagtgattctcctgcctcagcctcccaagtagctggcattataggtgtgtgccaccatgcctggctaatttttgtatttttcgtagagacgggatttcactacattggccaggctggtctcgacctcccaacctcagctgatctgcccgcctcagcctctcaaagtgctggttgcatgtctggcctttcctaatataattttgtaatcagtcttgatattttctatggcaagtctcctcctgtagttcctttttcaaaaagtataattaggctaggtgaggtggctcatgcctgtagtcctagcactttgggaggccgaggtgagaggatcgcttgagcccaagagttaaagaccagcctgggcaacatagcaagaccctgtctctacaaaaaataagaaaaaaaatagctgggcatagtggcatgcgcctgtactcccagctactcaggaggctgaaggaggattgcttgagcctgagaggtggaggctgcagtgagccatgatcatgccactgcactccagcctgagtgacagagcaagacagtgtctcaaaaaaaaaaaaaaaggtaatttaaaaacagaacaaaccaaaacaaaaatctctaggttattttggagtattaacttctaagtaaactttaacatcaaattgtcaagctcgtcctgttagcctccaccaagtgataaaaatcatattggaatttttattggaatttctttaaatatttgtattaattttcaggaaattgttgtctttttactatgtagtattcctgtgtaggaatagtaaataattttccatttattacagtattatattttatttatttatttgctggatgagatcttgctatgttgcccaggctacagtacagtggctattcacaaagtcgatcccattagtgatcagcagggcaattttgacctgctccttttctgacctgagccagttcacccctccttaggcaaactgatggtcccctgcccctggcaggtcaccatactgatgctgaacttactgtggacaccccatcactatagtgcactacagcccaagactcctgggctcatgtgatcctcctgcctaagccccctgagtagttgagacacaggtgtgcatgaccatgcatggaggttatttacttatttatttattttcagatggagtcttgggactctcactctgtcgcccaggctggagtgcagtggcgcagtctcggctcactgcaacctccgcctcgggggttcaagccattctcctgcctcagcctcctgaatagctgtgactgcaggcgcgtccaccatgcccggctaatttttgtattttttagtagagactgggtttcatcatgttggccaggatggtctggatctcttgacctcgtgatccgcccgcctcggcctcccaaagtgctgggattacaggcgtgagccaatgttcccggccgcctggaggtcttatattttatgtaaggtaagtttttatattgttttcaaataggagttacatattatttctgaagctcaattgtgttgttttatagtttttgttactactgtgaatgggttatttttgtacctttatattttgtttattgataatatatagataagttattgattcctctgtatttatattatattctttcacgttgctgaattctaatggattttcagtggtttcttctaggtttttttttttttttttttttcttttgagacggagtttggctcttattgcccaggctggagtgcaatggcgcgatctcggctcaccgcaacctacccctccgggattcaagcggttctcccgcctcagcctcccggtttccgctagaattttaaaggtggacatgtatattatctacgaataaaagcaattttgctttgttttgaaatatttacagttcatttcttgctttgtgtcttggccagtaaaggcaaacaacactgaataagcctaagaaaatattcatccttacttgacttctgactctggaatatctctagcatttcgtctttaagcagaagtttagattggtttcttttatttatttatttgtttgtttgtttgtttgtttgtttctgagacagagtctcactctgttgcccaggctggagtgcagtggcgcaatctaagctcactaagcaacctccaccccccaggttcaagtgattctcctgcctcagcctcccgagtagctgggactacaggcatgtgccatcatgcctggctaatttttgtatttttagtagagacgggattttgccatgctggccaggctggtctcaaactcctgatctcaagtgatccacccacttcagcctcccaaaatactgggattacaggtgtgagccactacacccggcctttagtttggtttcttataaatgctttttatcatgttgatacttggaatggcttctgatttttaccaaatgcaatagtttttactatctatctgataccaaacttttccccctaaaggctaaaataactttggatttctgtgacatacactacttggtaatagtatattatttttatttcatttttcttacttcagacaggaaatatgctgacacgataataagatgtgagggaggcacatcttaaacttttgtgtgaagacccaatcatcatgctgatgaatcacaaaaagatcagtaaaggtatattatttttaaaaatatatatacactttgattaattctcaaatttggtaagaatttttacatgtatttttgtaagcatgttattccataattattttttcttgtgttctttcaaatttaggtattagagttatgcttatttgattaaaatatattaagaatcttgtctgggcgcagtggttcacacctgtaatcccagcactttgggaagccgagacgggcagatcacctgaggtcaggagtttgagaccagcctggccaacatggtgaaaccccgtctctactaaaaatacaaaaattagccgggcgtggtagcgcgtggatgtagtcccagctactcgggagactgaggcaggataattgcttgaacccaggagatggaagttacagtgagcctagatcataccaccgcactccagcctgggtgacaagagcaaaactccatctcaaaagaaaaaagagtcttgatcttttttgtaatattacatgctttaaataacataggaattatttgcttcatgaatgttgagaaaacctttcctgttaaaatgatccaagtccgtaacatttgtgaaaggttttttttttcttcactttttttgcactttattctatggttataagatttcttcctccaggtttttattttatttatttatttattttttagacagagggtttctgtcatccaagctggagtgctgtggcaaaatcatggcttactgccactgtgacctcctggtctcaagtgatcctcccacctcagcctcccaagtagctggcactcaggtatgtgccagcacgcacgactaattttttctactttttgtagagacaaggtctcgttatgttgcttaagctggtcttgaattccctggctcaagccatctacccaccttagcttcccaaagtgctgggattacaagtgtgagccactgagcctgacctctttccccagatttaatactccctcttgcatcggtattagtaatatacatgagtgtacgtattattttgactttaaaatttgccaacattaagctgtcacaagaatcttttatagtttttcgaaaggtcatatactattctcattcctaatattgttgatttctattttccctctctcaatcagacttgtctatttatttagtattttcaaataaccaattttggtttatcaattccactttacttgtaattccttcttttgaatctgttgttctttttctagctttgtaaattgagtgtttactttatattgtaatatttcttccttaattatgaaagaacatagggctagaaatttttgttaggtcataactatggccacagcccatagtggtgatttataggattcctgctgtcatttatttcaaaataatcttgaattccttccgtaatccaaatgttatttagatgttttaatattttcaaatggttagattttgttatctgtttagcgttaatttctaattttaatgcatcatggttggcaaacatgactgattatttcttctttttggaattcattaaaatgatctccgtaaggttcattagttttgactggagagaggtccctccaaaaatctctttccaaataaacactgatgctgacttcgaggacatcaaaataaagtcttcaaggcttaaatgttttgaaactatctccttagtgttcctttactattttaagtcaataaattatgaatccaagataatgtgcctttttattttattttattttattttattttattttattttattttatttattttgagacagagtctggctctgtcgcccaggctggagtgcagtggcacaatcttggctcactgcaagctccacctcccgggttcacgccattctcctgcctcagcctcccgagtagctgggactacaggcgcccgccaccacgcccagctaattttttgtatctttagtagagacggggtttcaccatgttagccaggatggtttcaatctcctgacctcgtgatctgcccacctaggcctcccaaagtgctgggattacaggcgtgagccaccatgcatgggcctttttatttttcaaagctttctttcaaatagtaaccattcctttggtttgtactttacttggcagagacaagtttcattatctgcagttggacttatttcttcacataagcataaaatattaatatatatctgtacacttggacaggtattaaaggaaataaataagtcttaagagtatgatctaaaataactaaattttcttttatttttaattcaaagaatagagaaagccattgcatttcatataatgtgaagattaagctgttcttttcatctgttttgcaaattgagttaaatgataatatatggaaatcataatgtaccatcaggaagtagaggggtcagggcctaaaggtagtacatgaaactcatctgtagtcagaattactcttgagagactaaaagacaatgtaaccaactgttgccaggggtcacctttggggagtacagtaggaatacgaggtgggagtgggaaagaaggggaaatctcatattttgctctatacactcctgtactgtacgaactctttataataatcctgtatacatgaattactcactttgtaattataagaaaacaaaaaaaatttatcctaaaggtgcctatgacttttagtttagacatacaactttgctctaaatccagagcagccagtccccacaatgcccccatcacccccagcactagggtatcaagaaaaacaccagataaagtacttgacttgttttggtgccatattatacagaaatttatatctttaaatattctagaagcagagtgccacaaggtgctcccataagaacataggaatcaagactgcacacggatcatgtccattttaggtcttttaacacacatgctgattgaaggaaacagcacatttatttattatatcagacaaagagctttgttttggtgatttgcttactgtctagcagcctcgagcccatcttctacatttagctgctcttcgacactgcggccaggactcccaaactacatttcctaggcctccttgtcagctggtttccagctgtgttctaacaaaggaaggtggaagaagagaagaaacttccttcctgtttccaccttcttctggcatcactcttgcatgtgaaggtagctatggctccaccctccaactcctttttttttttttttgagacggagtcttgctctgtcgcccaggctggagtgcagtggcgcgatctcggctcactgcaacctccgcctgcagggttcaatcaattctctgtctcagcctcccgagtacttgatattacaggtgcccaccaccatgcccaactaatttttttgtatttttagtagagactgggtttcaccatcttggccaggctggtattgaactcctgaccttgtgatccgcctgccttgacctcccaaagtgctgggattataggcatgagccagcgcagccagctccagctcctttttttttttttttgagatggagcttcgctcttgttgcccaggctggagtgcaatggcgcgatcttggctcactgcaaccttcgcctcccaggttcaaacgattctcctgcctcagcctcccgagtagctggaattacaggcatgcaccaccatgcccggctaattttttgtatttttagtagagatggcgtttctccatgttggtcaggctgatctcgaactcccaacctcaggtgatccgcccaccttggcctcccaaagtgctgggattacaggcgtgagccactacgcccggcctttttttttttcttgagacggcgtttcactcttgttgcccaggctggagtgcaatggcacaatctcggctcactgcaacctccgtctcccaggttcaagtgattcttctgcctcagcctcctaagtaggtgagattacaggcatgcaccaccacacccagctaatttttttatttagtagagatggggtttcaccatgttggtcaggttggtctcaaactcctcacctcaggtgatccacccacctcggcctcccaaagtgcagggattacaggggtgcgccaccgtgcctggcccttcagctcctttcaacagcccatgcaccagctgctctgcaccactctgaagtcccagcaccacgtgaccctgccacctcacagtctgagcacgggctaccccaggcctttcttctgagctcctaaacttctggtaaccccaccttttccttcttgttccttttattgctctctcagtcttcccatacctgtgtaaccaattttgtgtattaaactgtctctgtttaagaagtgagcctggtctgtgatttcctggatgagattttaaccaattccatatgactacacttttgtaaattaaaaacgcttaggatgtcagccaaagtaggatgttgtgtcttctactatgcggtggtataaaactatccaatgaaatttgttcagaagacgcatggtagttatttccctgaagaagcacgatcctcaatgcatgaaaaagaggagacagaaaagaaggagggttcatcagaacaagaatggaggatattgttctctgcctggtccaagcctcatccccactggtcctagaactgccagctcatttgcatcaagtattagcatcttctaagctttagtcattgtatataaatttatctgtgattttttactcttagctccaaatattggcaaatggcatcttttatgtattgtatctagggtaatctacttaaatttataaagtggctttcaaaattgtaaaagaagttgcaggatatgagatctctgtccaaaaaaataataattgagaaagtccatggcatatttagttcagcatatttagctaattataattttaaaggacaatattaatcataacaactaaatctaataattgttgaacacttatgcctggcactgtgcttacggccttacatatattttatcaattaatttttaccatacccaaaatgtaccatatgaaataaggactattattattctcattttccagatgaagaatctgagatacagaaatattaagtaattgatctaagttcacagaggttataaagtaagtagttgtagtattagctattgggtatgaattaaatgtaaagttttggtaaaggattggaaactctggccctaagagagaaagcatggaaggaagtctaagattctagtgtgacatattttgggaacttgcatttaaatttgatttctgtataacgaaattcaatgaatagtttgcgtctttaatttttttttttttttgagatggagtcttactctgtcgccaggctggagtgcagtggtacaaccttggctcactgcaacctctgcctcctgggttcaagtgattctcctgcctcagcctcccaagcagctgggactacaggcgtgtgccaccacacccagctaatttttgtatttttagtagagatggggtttcaccatgttggccaggatggtgtcgatctcttgacctcgtgatctgcccacctcagcctcccaaagtgctgagattacaggcctgagccaccgcacccggccattttttttttttcttattattctccatcaaagaagtagtataatgtgatcatgttagacactaggtacaatcttggctctgtcaacaaaaagcaggtgaccttgggcaagttttccaacctctctgtgctctcatctgtagggcagagatgatcctaacacctacgccataaggtggttggatgagtcaaatgagagtcacataaagtactcagtactttgctataatttacatagcagtgtacaatgattagaggaagaataagaacaatttttttattcactaaaatatccaactatttaagacatgagataatgtctcaagtaaaaacttttctccccaatggtatacgtggatttaagtctagttccatcctactgggtgaaaataataattattattattattctgaaactgttttaaaaaatctagcttcctgtggaggttatagtttggtgggtgcatcatcaccactaaacacacacagtatagtgatggtcacacaacaatgtgaatgtccttagtgccactgaactgtaggtgtaaaaatagttaaaacggtctttctttttgagatggaattttgctcttgttgccccgacttgtgtgcaatggcatgatctcggctcaccgcaacctccgtctatcgggttcaagggattctcctgcctcagtctcccaagtagctgggatcacaggcatgcgccaccacccccagctaattttgtatttttagtaaagatggagtttctccatgttggtcaggctagtctcgaactcccgacctcaggtgacccacccgccttggcctcccaaagtgctgggattacaggcatgagctactgtgcctggccacgcctggcttttaaattagccttagagtgggttcaatgtggatggatttattcaacagcaaattgagaagttattattcaaagggtacccgcagactgatatagcacaacaaaaatggagagagaggatgatttttcttctttgatagaagaacacttttagcagggtaacccaagctaaacagatgtaaaagaaacaaggtggaatcagtttgatcttatctttgaaaagcagaaaaacagtgaactgaactgagaagcctactgagttttctaccattttcatgaaatgcttgattaggctgaaactagtgcacattctttcctcatgatgctgtgatgtgtgttattgctttccacactgtcagtcactttggtcttgctcgccttcactcccacatctatgggaagtgattcacatttttgttctcatatggtcattcaatagtgttgaacatactgttatgtggctcgatgaccccggctattcctgcaagtccactctcttttctaaaaatagaaatgtgcgttaggaattaaaagcacctcatgtttgattgtgttcatgttctttgaattatcctgcagcttgagtcacacattcaatttagagaacaaaaataatagctgctaataatgtctacaaagaaaatactttcagaaaccctgatttgagccagacgtccaaagtcaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgaatttcagagccacatacctaagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcggctgacccagaggcgaggagattgctgggcccggcccctgaggacgacggtggccacaatgatcacagtcaaccacaggcctctcaggaccaggacagccacgcaccatcccctcaggtgtgaccggagactttgcagtgtgcatggtcaggggtggtgccgaagcgtcttccacctgccgtgcggaccgtggaaaataaaaggctctgcccccggggtgagtgtggccggttgtaccctgcagtagcgtctgccctgagctgccagtgctgggtatcccccagccccaggaaatgtggggtcggccgggaccctcacagctctgaatttgcttctgttatttacggctttttgctgcttcttggtaccccatctcctgtctgtgtccttccaaccccaggctgcttatgtggcccaaccccaatgctgtcaactaggcttgaaccccacagcggctgtgctcttctgggaggttcccgcttgctgccttcagccagggcgctcctcagagccctgttttcctgcagacaccagctctccttcctgcctttagatcctgagaaggagggaaatgaggggtgctgacacagtccctctgggagagctctgcctagtctggtttggtgaggcccttgatcaccttggccctcctccctgtcttctctgattcttttccctcaaaatagtcctgagaactaattgtcacactggcttatcatgtctctgtgggtgaggtgggagaagcctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaaatcttctcaccatgaaaaaaaaaaaaaaagaaaagaaaatactttcataatcttggtcacatttaacagtatacggagtccacagccaatcacttgaaaatctggtcctatgcatagatctatgattccaagcggcaagaaagcaaatcttccggggaaacaaaaagtgttacattccttagttttaagttcctatttcaaaggatagaaagggaggctgttacctgtatcccgatagacaggcatcgatttttcttaaagtggtccttcttcctgtcctccgtggtgacggtggctatggtagtcgtggtggtgacggtggcagtgttattgcccatgtgttgactggcagggccatggatctgggcgtttgcagcttcgatggcggctgtcagagccttcatactgtccaggctctcggtggagttgctgagtccagactggctgataatatctcctcgctggccctgtccgtccatgtaggcatcctgggctgactctgtgctactctgggctgtgatagaaatgaaaggtttcgtggtagttctgggtgggactggaggtggtgtcttcttatatgttgtaatgcaagatgacactggaagacagtgaaaacaaagacaatgtgatttctgcgtgggttttaatttctgatattgtaactgacagccattgggaattagggcacatgaaacacactgagacatttaacaggaaaacaagttccattgacaggctgagacccctgctctccggaggtggtttgggtctcctctgaggtgacacctccacaaaactgagggagaaaaacaccgggaaatatcaatctctgaaatggaagtttctaaaatggaaattaatatgaatcaacataaactagatacgattagccctctgtcgaaaccttcccagccaacaaattgtataggcacatagaaaaggtgaggggagtttctgtcttcagggaaaaaactaaatatagctaatattaaacagagtaactcattagaagagattttagtggttgataataaatatggaaaaagaaaaaaggaaggcaaagaggttgtgaggatgcgtgttctgatcctaataacaaggacgaggtgtctgggggagaagggtacacacgccatggtagctgctgcaacttgtttatcgaagccagttccttccttccttctttcctccctcccccctccctccctccctccttccttccttctttcctttcttcctccctgcttttcctttttccctccttcctgtaaaaatatttttaaaaaatagagaggaggtctctctgtgttgcccaggctggtcttgaactctgggctcaagagatcctctcccttaggcctcctttcaaaggacagaagaggaagctgttgcctatatcctgacagacagacacatagaagtgctgggattacaagcgtgagccaccgggcccggccacttcccacctttctgtctttctgcctgactgaccgacctacctacctacctacctacctacctacctacctacctaccttccttccttccttccttccttccttccctcctccctccctccctttctctctctgtccctctgtgtttccccacctccttcccttctttccttccttccctccttcagtctttttcttttctctgtctacctgtcttgtcatccttccttttccttctctctctctctccgtctccctctttcttgtctttccccttcctcctcctctctgtcttccttcttcacttccaccttgcctatctctctctctgtctttttctggataaactctcactatataaacttcttttgtttaatttttgcttgtttctgagcagaactactcactgagagtatttacactgtacaaaagtctcctattgtagaaattaatccacatgctagcttataaatcagtcttcgtgggtttggtctgtatgagtcactccctaaagtgtctttctttagggcaacttggtcaagtcaagggcctgaatctgactgggtgtggtggctctcgcctgtaatcccagcactttgggaggcccaggcgggtggatcacctgaggtcaggagtttgagacgagcctggtcaacatggtgaaacctcatctgtactaaaaatacaaaaattagccgggtgtggtggtgcatgcctgtaatcccagccacttgggagactgaggtagcagaattgcttgaacctggggggaggaggttgcagtgagctgagatcgtgccactgcactccagcctaggccacagagcaagattcggtctaaaaaaaatggtgggggcctgaatctaggctgctgagtacaattttggacccgtacaagggggtcaaggtctatttggaggctcccgacagcagcctcagcccctccctctagccatttgattacaacgctgagggttttgaagaagctttacacgttggctttcagtttctcatttgtaaagcatgatttaagaaaataaggatcaaaaatgaattaagtttccaagtgggactccggtcagtgaagcacaattccttaagcagctattataaattcattcaaataattatgcttccatcatttcctccccaccccaccccagcccacccactctcacaggtggtgtcactgtggctccatcacatcagctagacctggccatgcagtcccaacttgttacctacagttccagctgccaactcaggccatctcactgaatgaaatacttgcttcaacattgaagatgtttcctctggccactcagaggaaacaccctataatgaacaataaacaaaaggactctattatgctgtcctgctgtttcagtggcctatgatttggagtaatttccttaaccataaaatagatggagacaataatgtttggctatttcccagggattgcctgagtattggaggaataaatcaagcaaatgtctcattacaatatcatatggactctgggatggggaaagacaaggtgcatgacatagaggcagtcacccctcattccctgggtggatgactggcagaggcccagcccaggagaacttcccatctatgttgactcatgaaacacacaacttcatctctcttttttttagagatagggtctcactctgtcatcaggttggaaggcagtggcacgatcatggctcactgcagcctcgatctcctaggctcaagcaatcctcccacttcaatctcttgagcagctgggactaacaggtgtgcaccaccacatccagctaattttttattttttgtagagatgggggtcttgttgtgttgcccaggctggtcttgaacccctggcttcaagcgatcctcccatcttggcctctcaaagtgctgggattagaggcattagccactatgccatgcccggcccatctttatcatttgaatgcagctcaacaataagtgtcgacttcctcattttttagctaatgcacctgacaggaaatacgactcagggaaaatacagtgcttgcaaggtgcagagtcaggagcgagccagccagcctcaggttcttcccactagcccacagctaagcctctggctaaacaatgccagtgcatatacattgtaaatatcttgcctcactcaatttagtttcttgcatccaaaccatggtggagctctggttcccagagaggcatgagtgatggtagtcctgctgggagtaacgctcatctcagtgattcagctgaagacccagagtgggtgggagccataattaggatagaacctctccctgctaaaattgaatgaaactacagcattgtaccacttctcctaagacatgtctttacaacgtgaactcactattttgttcaaaatggattctcaggacattccgcccactgatatttcaagaagctaaataacatattccaacatcaaatgtctgatcttttggattatgtattgcttcttgttagctctccttggtttcttcttttagtgtggataatccaaactggacagtgaggccaggcacagtggttcacacctgtcatcccagcgttttgggagactatggtgggaggactgcttgagtccaggagttgcagaccagcctgggcaagataacgagatcccatctctacacaattagaaaacaaaaccaaacagtccccctccaaaaaaaagctagataattcagccaaatatggaatcatttgatttgctgtgacatacagtaaaaatcctgccatgatgtgataagtgggggtgggaggggctagttcacattgtttccaacgcatgactgaccttggggactgagcctccagtgcggctcctacactccccaggccaactgcaattggacgccacctggtggctgttgtcagctcatcttcgctatcgatagggataactctggataccttgctcaacagggacattggcagagttccagtaatgcttgacatctaccatggttagactggacagggagaatactggagacatggcttctccaacagggtggtccagcccccaacacccaaagaagataagattttgagatcccccccaacttcgaataagggagctgaatggagggcaggaaccatctcccatgttgttatacggagggacattactcattattatgaggcttaaggaaaggaaccatctcccatgttgttatacggaggggcattactcattattatgagacttaaggacaggaaccatctcccatgctgttatgctgagggactttactcgttattatgaggcttcactgcagtgagcggcactgtccagtcatgggctaggaaggtaaaaggaattcaaatcttcatgactgctttttttttttcaactacagacgggatctcactgtgctgtgtacgctggccttgaactcccagatttaagagatcctccccctctgcctgctgaataggtggcacaacgggcgcatgccaccatgcccggcttaagattgccatttgaaggagaggaaagggattcaaatcacaactcacacttccccatagttccccttcttcattttccaattcttctgcactccaaaactcatacaacgaaatccttccattttccccaacatccccctttcctagatttgctaagccctaaacccacacttctctcctaagggtattttgtttgttggttggttggtttcagttctactctcagaattcagtgccaggaaagatttagaacccactgagaaggtctgagcaccagcaggtgtgtgacacataagagtgagactgaaggagggtgaaacaccagccaatatgtttgtcttgcctggtcaaaacagaaagagaaaatgagaaagagaaaaagagaaaacgagcagtttctatacagtaagtgaaacatctgatttgtttaagagtgacgttctctttttattttgagacggagtttcgctcttgtcgcccaggtgcaatggtgcaatctcggctcactgcaacctctgcctcccgggttcaagcaattctcctgcctcagcctctggagtaggtgggattacaggcctgcgccaccatgcctggctaatttttgtgggtttagtagagacagagtttcaccatgttggccaggctagtctcaaacccctgacctcaggtgattcacctgcctcggcctcccaaagtgctgggattacaggcatgagccaccgctccctgcaagaattgagaggtgaagccagctggacttcctgggtcgagtggggacttggagaacttttctagctaaaggattgtaaacgcaccaatcagcacctgtgtctagctaaaggattgtaaacgcaccaatcggcactctgtaaaaacggaccaatcaacactctgtaaaacggatcaatcagcaggacgtgggcggggacaaataagggaataaaagttggccaccccagccagcagcagcaatcccgcttgggtccccttccatgctgtggaagctttgttctttcgctcttcacaataaatcttgctgctgctcactctttgggtccacactacctttatgagctgtaacactcattgtgagggtctgtggcttcattcctgaagtcagcgagaccactaacccaccgggaggaacaaacaactccgcacacaccagctttaagagctgtaacactcaccatgagggtccgcggcttcattcttgaagtcagcaagaccaggaacccacaagaaggaataaattccagacacagaatgacgttctcaaaaacaatgatttttaaaatgtaagtggaacttgaaaaaagaaatgatgctgtattttttatcaccattactgctttcctttgccctgataagttttttgttcatttcaaatgaaattatttttttcctcatctggctgaaaggactcttatccatttatgagagagttgcagaactagagctgcagatttcagtgacattttcattcagtggatactgtagtgcacagagagaccagaggttggtatttacatttaagaagttatatatttttggggccgggcgctgtggctcacgcctgtaatcccagaactttgggaggctgaggcggccagatcacctgaggttgggagttcgagaccagcctgaacaacatggaggaaccccatctctactaaaaatacaaaattagtcaggcgtggcagcacatgcatctaaccccagctactcgggaggctgaggcaggagaatcacttgaacctgggaggcggaggttgcggtgagccgagattgcgccattgcactccagcctgggcaataagaatgaaactccgtctcaaaaaaaaaaaaagttatatttttaagaaagacattatacggcagagtgcggtggctcgctcctgtaatcccagcactttgggatgctgaggcaggtggatcacaaggtcaggagatcaagaccatcctggccaacatgttgaaaccccatctctactaaaaatacaaaaattagccaggcgtggtggtgtgtgcctgtattcccagctactcaggaggctgaggcaggagaattgcttgagcccgggaggcggaggttgcagtgagccaagatcgcgccactgcactccagcctgagcgacagagcgagactccatctcaaaaaaaaaaaaaagaaaaaagaaagaaagacattatagagaaaacaacacattcctatcatttcagcttcgagctagctcatgattgaatattgcctacatttgtatggaaagataatgcggccaggcgcggtggcttatgcctgtaatcctggcactttaggaggccaaggcaggggataatttgaggtcgcgagttcgaaaccagcctggtcaacatggtgaaaccccgtctctactaaaaatatataaaaaaaaattaacccagcgtggtggcaggcgcctgtaatcccagctatttgggaggctgaggcgggagaactgcttgaacccaagaggcagaggttgcagtgagccaagatcgtacctctgcactccagcctgggcgacagaatgaaactccgtctgaaaaaaagaaaaaaaagaaaaaaagaaagtgttgcaagcttcaggaaggcctgggccagagattattttattctgtagtggtgaagatgttctggcaaattatccagactctctttccactctggttatccttcaagtttaacagcacacaagtgtcaggcggccacaaaacagatgtgagatcaaactccctttttgtgcctttttattcataaacccttaccagctaagcgaatggatcatacaccataagctatgtagagcaactatttagcagttcctgattactgcattttagaaattctttaaaacatgagagagcaagtccataaggaaccacaaataaaaacacaataagacaaagtaattaaacttatatataaattaaattatatatagatatatatgcagatgtcccagagtcaagtaacatctttttgatgtaaacatgttgttaccccaaggcgttgttattaagtgcagctattatcaagcaagctgtgatttgatcatccttgagaagtggcagcgcctacacagagctcatggggaaagcaaccttggatttgctgtgagttctatcagatggtgtcatcttactgagatgaagactaccagagagaagggctgccttggtccactgtctaaaatctgctgagggcaaagttctcccgatttggtccaggtgatcagcagttgttcaacaagccctcaaaaagaaggcctttatttctttatttgagacagagtttcgctcttgttgcccaggctggagcgcaatggcaccgtctcggctcactgcaacatccacctcccaggttcaagcaattctcctgcttcagcctcctgagtagctgggattacaggcatgtgccaccacaccaggctaattttttttatttaatagagatggggtttcaccatgttggtcaggctggtctcgaactcctgacctcaggtgatccagctcccttagcctcccaaagtgttgggattacacgtgtgagtcactgtgcctggccaaaagggctttattaaaaagatttttaaaatctaatggggttgacagaagcgtgctggaactggcccttctcagcttgctaagctcgattgtgcacatttctttctacctctgtattcagtcacttttcactgttagcttgaaattgttgaccttggtgtatttacaccatggaaatcagcaaatgcctgaaatccaggttcccccctgtggattttcttcaatcagagagccggttgttaagcatttccaacacccctgtgtgtacagagcagggttattcaaagcctggtctgcagagtggtgcccgtttgcaaactgtgtcacagtgcagggtgacacatgctatgaaaattgagtgtagggtcaggtacggtggcccacacctgtaatcccagcactctgggaggtcgaggccagtggatcacctggggtcaggagtttgagaccatcctggcgaacatggtgaaaccctgtctctactaaaaatacaaaaattagccgggggtggtggcacatgcctgtaatcccagctactcaggaggctgaagcaggagaattgcttgaacccgggaggtagaggttgcagtgagccgcagaggttgtagtgagccgagacggtgccattgcactccagcctgggcaacaagaatgaaaccccgtctaaaaaaaaaaacaaagaaaattgaatgtaagtgtttagaaacttttatagcaattttatagagtgttttacctgttgaatctaaaaacaaaacaaaacaaaacaaaaattatgggtttgttttttgtatgtcttaaaaaaaaagtcctctttctagtaattcttttttgttgcattttaccaaagcactaatctgcagcagattgagggcaaacaaacaaactggtcccttaccagagataggctgagaagcactgaaaagaacatttgcaaatccagggaacagggcagaggtagtacaagtgagattaagaatatattcaagaggtaacttgaagccacaggctattttagaaaacaaaatgatgtgaagaggccaaaagaaaaaaaagaaacttggaaggacctaaactggggacataaatgtatttctattgtagaaatacagaatgggaacgattggacttatggttgtaatgtcaggtaaggtgtctatttcaggaaaggcatgtaggattagaagtatggacctaggcctgttgcggtggctcattcctgtaatcccagcactttgagaggtccaggtgggaggatctctttgagctcaggagtctgagaccagctagagcaacatggtgaaacccatctccacaaaattatccaggagtggtagaatcctgccccagccttccaagtaggtggcacctgtagtcccagctacttggaaggctggggcgggaggattgctgaagcccaaaagattgaggttgcagtgagccaagatcacaccactccagcctggcgacagagcaagactacgtcaaaaataaaaaacaaaaaataaaaataaaaagacggggtgtttcatttggaaaagaagaaaggggggttttcaattatttggagggctcttgcttagaggatagcatgggcctgttttgtataagtccccaaaggaacaacaaaggcaagggctcagagaggcataaagaataattctccaggcattgattgtccgtccatagaaggaatatgaggacctcataacagagggagttctcagcccctggacctgttcaagcacagaccagcacatcttttggctgggaggctatagcaattgtaccaacatctgatagggggctcaactagatgacaaggtttctttcaaattggatggttatgataatgagtgaaatttagacaagaatttgcaaactagggagggtcccacagagaatgatgctgaagagctgaagaaagaagccaaaaaaggaggccagagaaagagctccaacgaggctgtctggtagcaatgatgaatgttctgccatcttgggaaagcagctggcactgatgaggacaaaataactaatagacaagtttgctgctgctgcttccagccaagcagaccccatagttgtgcacttaacagtgcatcatagggctcctgctccttgcggtgatgtgttatgctggccggactttccaacaaatgccagacaaatcagcggtctggctggagtcctccaccggcaaaaatgcgcaaaccctggcaacaacaaagatgatgagatgagattcagtccagacccgtgacatgccattagatcttcctaatcaccagagagcaaatccttactctgtgtactggacactgtgctaagaacttaatagacatgggggctgggtgtggtggctcacacctgtaatcccagcactttgggaggctgaagcataaggatcgctttagcccaggtgttggagaccagcctgggcaacagagtgagacctcgtctcaaaaaaacccaaacaacaacaactagctggtcatggtggtgcacgcctgaagtctcagctactcggtaggctgaggtgggaggatcacttgagcttgggaggtggaggccgcaatgagccatgactgtgccactgcactccagcctaggtgacagagcaagaccctgcctcaaaaaaaaaaaaaaaaaaaaaaaagaaaaagaaagaaagaaaaagaaaaagaaaaagaaaaagaaaaaaaagaaagaaaagaaaagaaaaagaagaaaatagacatgatctcacatatgtgaaagatcccactatccccatttaactgatgaaaatattaaggctcagagcaggcaacggacatccctaactcatctagagattcagtgacagagttagagtactcagggctccaactcccatctgaccattaactcaaaccacctttgtttatctcccccgccccccgccagtaaacactctctagtaaacaccttgtccactaaagcaccgtggtttccacgagggactccttcgtgcacagccatcctcactctgcaggaactcttaagtttcagtgaatgaatgaatttggagtggtcaacaaggggtgcacagttgcaacttttaaaatattgcagaaggagagaaatgccacaaaacaaaatgcacatggaaaaatcactaccttatttcaaaatatttacagcttcacatttaaggccacccaaagcgtggcggtcagtggtgagaaggcagagatcagaggctgttggggtgggtcatacaccatgattcccggcccccctctgggagatacaaggtatcccacagtcttctctcccagttacatcctccacggaaaccacaagatgactcgctcaactttttctaaagtagaaaaaaatatgcttgtgtgtgtgtgtaaggggaggagaggggatgtgaatgaaatggagggtagtgtaataattcctgtagtcataagacacgccagttggtagttgctagtattccagacacttcctaacgccagacaaatgccccaagcctcggcatgtctggcctagagatctattcaactgatagcagccgcctcttctggggagagcagatctttcagaaagcactggctgcgctgctaatcaaacgcaacattgttctcagcaaggaggaagaatggaaaggtttgtttcagagtcacaactttattttttttaaaaggcacccaagttgtttcaacaagctgctacaaaacttgggcttcctgagtggaggctgttttgcacagtgcatgtactgtacaaaaatccaggcagggaggggtcagagagttcgtcattaaagaaaaaaaaaaaaaaaagccccaggcacttgatgcctggaaatgatgtcagacgcagccactcctctgttagaactacagccaaacaatgcgcaggcaatccacagcagctgcccctgcaaatgtcagcgccagcccagtcaaaagagcttgaaacctaccaagccggaggactgtgctgtgcctctctcgcccacattttccccaagcactctcaggaacctggcaacaggtaacgtggcaacctttgacttataaaagggcaagtggcacaatctcagggaacaaatggacttttttttaaagccagcatctcccccaccactcccacacccccctccctccctccctccctcccaaccaaaagtctgtaaaaaacaaaacattgacgcgggcagtcctactctctagtgtccccttgtggccaagcctggaacatcacatctgtacgttgcaatctgtggatcagctacgaggtaagtcgctctttggaaggggtggaggtctttgctggacttgtcttccgaaaagtatgaagagtggaagtcaaggctcagaatggcgtccttttttaccttatcaccttaacaaaaacttcaccttagctgcagggttaaacctctgggttggggctggggattttcgttgttgttgttttaaagcagcagccaaggccatgttttttaaggtggtgagttaaacggagcaagagctgcggtagccttttccacccaatctctttcttcacatcctagtcacagccaagggtagggtggatggcagtgaggataaacagcccagaaacaggattcctgcagggtgggactggcattttccatttttatctgaagttgtactttgaatgcagacacctttctctcaggccagaagcactgctcatttgtattgctggcttccagttagcctatttgcaaggattacttaggatttccagactgcaggcccagctacccagagagtgtgcctcaaagccccacctcaaagcttttatctctatgtggcgggaaacacccacgaaaatgccaacggcggtatttgtaacttgccttcttccttttgggaactgctttctgcagctctctctgcgttagaggaatagctacagctgggagctgctccagccacgcaggaggagagggcacccattgagaggcgggcaccccttctgtctccctctggctatgttaactggaaactaggaaaggggttcagatcaaagtaactgctgtcttcagaaagttccattcattaactaagttagcggaaattaaatggtgtttggaggaaggtcatttcagaaggcccagggccagaggctgaggtctaaaacttctaatctggacttctattgaagtttggcagtaagttaaacaggaagttgaaggctaccatatgtaaatccagttgttgcctgaaatcagtcatttcaagggagtatcttgaaaggacacagactgggaaacaggcatgagaaaaaaaaaaggaagtagacagacatttggctagtatgtgcctggaccacttaacactaaagattagaaacctagggctctgagtaagaatcatttgaccagtagctaaagtgagtcatggcctgcacagaactagggcacacatgttgaagtcaggatgttgagaacatcaggcttactaatttgcaaggcaggagtgctgcttccagtagggaatgtgatcaggatttcacggctcattttcccagcctttccaacaggtgcaatcaagtcatccgtgtacacaagtgactgccctgttacatctgttaggattaaatttccatttgttccattactttatatgaagtgatttctactgctgagtcagacagaacacttcctcttagacctagggacttttttcaacatttttaacaatgtgtgtgtttttcaaaatgtgtcccaaccaggtctgcaggtcttcctgggttgaatggactgtttacagaaggggaagattcaggcccaaggtcagggttacagaattatataaggtttcctgtttgggcagctggtctagcaacacctctggttggggcagactgggtcttgttgagagatagcatgcccaggaggctagggcagggagagtgccaggagcaggaaagaacatttttcttttctttttttttttaagaccgtgtcttactctgtcacccaggctggggtgcagtggtgcgatctcggctcactgcaacctccgcctcccaggttcaaacgattctcctgcctcagcctctcgtgtagctggaattacagccgcccgccaccatgcttagcttatttttatatttttaatagagacggggtttcaccatgtgggccaggctgatcttgaactcctgaccttagatgatctgtctgcctcggcctcccaaagtgctgggattacaggcttgaaccaccaagcccggcctgacatttttcttttaaatcttttatcaaccagctttcatttcttgtcagatgtcacttttcagcaacctgttgctatattctctgttaggagaactttttttttttttttctggccagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttttcttcttcattcttttcactcctcgttactcttttttttttcactctcagcccacacaaaactaggaactttgttattctacttatttttctgtactctgtctgtttgcacacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagcatccctgactctgagactgtggggtagctggttgttttaagatgggaccagggtattgtgcacttattgccaattcttgcttcagtaagtggggtggctgtgcagagtgagtggcctgtgtatgaaccagggtccgtcccatctaatgagagtccggtcaggctgagtcctcaccaagacttcagcgtggattcatcagtaaccttggttcactggcaggcttgctggactttggagaaaaggctgaccctcccccaaagcagcccattgctgccactgccctaggaacagagggcctggagccagggcttgacctggtacaggagcttttgcacaaggccggctcaaacctccaaacctggggaaacaggatgcatggtgaagtgaagaagaaagaaaatgcatccaccgttccttcctgttggtgtcagcacgatgaggaataattacctggatctggaaagcaggcgtgtgggaggctgcaggcccccctgatctgtgtagttaggcacttaatttttcatcctcctccttctctctgccctcccgaaaccgccgttttcaaaggaaaaacagaaaaacgtatctgggtaacccgtgtaatactgtttacatcagcccacttggcccagaaaggataccagctccttactgatgctcagataacagggttagtgcttaaaaaaattatgccttgggccgggtgcggtggctcacgcctataatcccagcactttgggaggctgaggtgggtggatcacaaggtcaagagatcaagaccatcctggccaaccaacatagtgaacctgtctctactaaaaatacaaaaagtagctgggcgtagtggcgcatgcctgtagtcccagctgctcgggaggctgaggcaggagagtcgtttaggcctggcaggcggaggttgcagtgagctgagattgcgccacactgcactccagcccaggcggtggagtgagtctccatctcaaaaaaaaaaattctgtctcattcattatccaactttgtcactgatagagaaggacatagatccagagaagaacttgtccaggtgaccccagggctctttccccctccattacttttttttttttttttttttgagccagagtctggctctgtcacccaggctggagtgcagtgtcacaatcttggctcactgcatcctctgcctcctgggttcaagctattctcctgactcagcctccctagtagctgggattacaggtgcatgccaccccgcccagctaatttttgtatttttagtagagatgaggttttaacttgttagccaggctggtcttgaactcctgacgtcaagcgatctgcctgccttggcctcccaaagtgctgggattaagggcgtgagccaccgcgcccggtcccctccattactccttaagtgtcccttaaagactgtatttatttatttgaaacagagtcttgctctgtcacccaggctgttgtgcagtggcatgatcttggctcactgcaaccttctgcctcagcctcctgagtacctgagactacaggcgggcgccaccacacccggctaatgtttgtctttttggtagagatgggggtttcaccatgttggccaggctggtctcgaactcctgatctcaagtgatctgcccccttcagcctcccaaagtgctgggattacaggcgtgagccactgcgcccagcaaagactgtgtttaaaatactacctttctgttaggtacttgtcatttgccaaaattaaataaaaacagtctaggaacctaggaacctgtgaagtcagtactaaaatctataccaatttactccacaaacccccatcctcctcctcgttggttgagtgtttaataaagccaggcgctttacctatagtctcattaaattaaaaacaatcctgcataggaagtcaggatctcaattttgcagatgaaaaggaggcttatctgggcatgcccagcaaggtctggggaacgccccttaatggagtacttgaatttgtctgcagggagaggtggcatcaccgcactgtaaatagtttccgaggtcaagtttggctagtggcttttagaattggggcagaaggatgccatcctactcccaccttcagaggcatctcaggttctggagctctgtgctaactaagcccacctgtggagggtggcaatggagtggtgacaggcgtgcaaggtttcacgtctttaaagaaaagacagctccaaggacagagagttttttgttgtttgttttgttttttgagacagtctcactctgttgtcaggctagagtgtagtggcgcgatctcggctcactgcaacctccacctcccgggttcaagcgattcccctgcctcagcctcccgagtagctgggactacaggaggcgccaccacgcccggctaattttggtatttttagtagagatgtagtttcaccatgtgggccaggatggtctcgatctcttgaccttgtgatccgcccacctcggcctcccaaaatgttgggattacaggcgtgagccaccattcccagccaattttttttttttttttaaagagacagggtctcgctctgttgccagggctggagtgcagtggtgtgatcatggctcactacatcctctaactcctgggctcaagcgaacctcccactttagcctccggaacagctggaaccacaagcgcacaccaccacatccagctaagttttaaaaaactgtttgtaaagacagggtctcactatgttgcccagggtcaaggtcagatttgttaatccttctgacattgtctcctgttggagttctggatgttcattagttcatcaccatgcatgtgattcacacactgtactcagaaacattcttttttcttgtttttgtttttttatgagacggagtttctctcttgtcacccaggctggagtgcaatggcacgcacgatctcggctcactgcaacctccacctccccggttcaagcaattctcctgcctcagcctcccgagtagtgccaccactcccagcttatttttgtattagtagagacggggtttcaccatgttggccaggctggtctcgaaccccggacctcaggtgatccacctgcctcggcctcccaaagtgctgggattacaggcatgagccaccgtgcctggccagaaacattctttttattcgtttttattataattgtagtaagggccctggtaggggatttgaactgtttctttccacagtgtggaatgatgtctatatacattacagaatggagatatagatatctatagagatctatagatatctatagagatctatatagatatctatagctatatagatatagagatatagatatatatagatatatagatatatatagatatatagatatatatagatatatagatatatatagatatatagatatatagatatatatagatatatagatatatatagatatatatagatatatagatatatatagatatatagatatatagatagatatatagatatatatagatatatagatagatatagatatatatagatatatagatagatatatagatatatatagatatatagatagatatatagatatagatatatagatatatagatatagatagatatatagatatatagatatagagataaagatatagatagatatatagatatatagatatatagatagatatatagatatatatattttttgagacagagtctcaccctgtggctcaggctagagtgcagtgatgtgatctcagctcactgcaacctccacttcccgggctaaagcaattctcccacctcagccacccaagtagctgggattacaggcacctgccaccatgccagctatcttttgtatttttagtagagatggggtttcaccatgttgatcaggctggtctcgaactcctgacctcaagcaatccacccgcctcggcctcccaaaatgctgggtttacaggtgtgagccactgcgcctggcccagaatggagtaatctgatgtggtcttacagataaacacttcacatatgcaagggtgtgtgtgtgtgtgtgtgtgtgttttaactcatcttttccattctcttcccaacccctcctttcccatctgctaccctcaggctacagttcgacttcacagatagaaaaataaaacctacggctgggcatggtggttcacgcctataatcccagcactttgggaggccgaggtgggccaatcgtttgaggtcgggaatttgagaccagcctgaccaacatggtgaaaccctgtctctaccaaaaatacaaataaattagccggtcatggtggcctgccccagtaatcccagctacttgggaggctgaggcaggagaatcgcttgaaccaaggaagcggaggttgcagcaagcccagatcacgccactgcactccagcctgggtgacagagcgagactccatctcggaaaaaaaaaaaaattagctgggcgtggtggcgagtacctgtaatcccagctactcaggaggctgaggcaggcgaatcgcttgaacccgggaagcggagattgcagtgagtggagatcgggccactgcactccagcctgggctacagtgcgagactccttctcaaatgaatgaataaataaataaataaaacatatgatttaccttggcccactataattttgcactacagggtggcagctccgtgctatgtacaagccgggtgccgcgcagctttgatgctgcccaggacactgacctaaaagtgtgtctgcaagtactctcacccttcattcattcaagctttgcctagtacacactttttggaaaccatttcccaaaatgcatgcttttataccacatttcccacccaccagataaccgagacagtgcacgtaacacagtttgaattaaagaataatcttgttttggccgggcgcggtggctcacgcctgtcatcccagcaatttgggaggccgaggcgggcggatcacgaggtcaggagatcgagaccatcctggctaagacagtgaaaccccgtctctgctaaaaatacaaaaaattagccgggcgtggtggcgggcgcctgtagtcccagctactcgggaggctgaggcaggagaatggcgtgaacccgggaggcggagcttgcagggagccgagatcgcgccaccgcactccagcctgggcgacagagcgagactccgtccaaaaaaaaaaaaaaaaaaaaaaacaaagaaacttgtgttggtagacaaataaattcatgaactgcagatataaatagatcgagcactagatatgtttattatctccagcacagcactgcctcctggtgcggattatattccagttttcaaaaggaaccatagaagatacaagcaatacgattttattttggagggatttctagcatcataggtcaaagacgttattaagtatcgactctgaaaaagcaactataaatactgcaaatcgactaagccagaggacgcaaatatatcctgcgtgttgtgtgctggactgtggttgagacttcatggtcgtgctctgggctcatgggggcagctgactgctcataattaagattgctgttgccgctgcctgtgttccaaagagaacacaagaggacagagctaaggtgtaggaatgcggaagaacttgcagaaactagagctagtcttcggattgaaatgaattaccaataaagggttgggaaatggatcaaggagagggaagcgttttgatggtccctgctccgaggttcagcccatttgcagttgctgataaccttgtcaggtcaccagataaaggcaagtcttgtcaccctcaggcacctggctgcgaagtaataaaacggttgccttatcatctaaaggtggagtgagtcaaacctcagcccagggtaattatagtaaactgaaattgcctgtcctttacaaaaaaaaaggcggagggagagagaaaggaaaagggcttaaggcaggaaattgtgtttgtctttctccttggatttaaaaaagaaacgagcaaaacagcaaaaagttttccagggagtgagaaaagcagcccggctagactcccctcaccctgggttaacaggattgccgacagatcaggcccacgtgatggtcaagaaaagaggctcaagctgatgaaaatccaagaaatcttcttaggagccttcctttctaaatgtaaatgactgagtcattgctttgctaaggagggaaggaagttacaatcacaccaagtgactcattcattgctgttagctccggcagttggatgaaaagttttagcaaaagcagcaacaaatgtactttaaatactagcacagtaagggaattcctgtctttcaggatgaatgccatccacacaaaagagctcctgttgacatctcatttacaatctcccccaggacacagacaagaccctttcaataaatccagctcagaaacacctattgttcaaaatcttcaactcgccacaggctaccaccactccctatggctttgcaaaattaaagatttagaagaaggatggggcggtggaagctatgaaaagaggcaggaaaaaagttcctttgacccgatgctgtcagagagcgtgcatgaagaagaaagttaatggtatttccatttatataagaagcgcctaagaaatgcctgtgacgttcgtgaactagtgattgtgaattccaaatttgatgccaactttatgtgtaaagaagctaactcctgccaacatcgtggctgaatgaacagctgggactatgcttaacccattcccagcttataaaagccccatggcagctgcagtgaagcatcaggtgagtctgatatgggctgtctgttccctcggggatttgaatcttgcctgtcctttccaagtggagtcttgtgcctaagtgctagagcccactccttcctccccactgattcccttctttccatttctgccatttcccttcttcttttaataaaacttggacattttctggagttacatgtttttcttgggatgtacttcaaattaaggagcatatttatgtttacaaacacacgcacacgcacacacacacacacatacacacaaaagaatcgggcatttctcaagtggtgatacctttaccctccttatttttcacttaaggttccccatctcagtacacgatccctttatctgccccgagttcaagccaaaactcagcattatctgtaagcactcctttgggtccttctctccagtctcttaaatccctgtggagtcattccacatccttctgtgcatctttctgcttccctagatcctacagttttaatgttatcttctggagtatcacagcaacttccttaactcaaggtttctccaactctgagttgtcacttagtgggtagtgaaataagatgagtcatgcagtttcaccatttagaaaatgcaaaatgttaggtagaaaatgtcagcgtacatcctgtgtagaaaaagtaagtcttgttgtgaaacctctttcagtttgtgtgtgcgtgtccccggatctgtgtacatactgggcaacagggaaaatgcattttgtaggtcaaaatatttggagaaatacgtttctacttagtctcactgggtctgtcttttctgtttccaaactattgtgtacacttagaggaagagtggaaaccctccagcaggtcctgtcagtctgcagtttacaaatctcccctcaggataagagttcctattcacccttttcaggtctcagaattctgcctcctcctgaccacttttcctttagttattcaacccatcaagttccctgggtttgcatgtgcaatcgattcctcgttagggatattctttcctctggtttttccttcagatacgagcttacgttcgacctcttccaagaagacgtcaggaatgtccttctgaatgcctttcctagttctcatgagaacacagcagtttttaatcaggcagagcacttattacattataattatcttcttggttcccaactgaacttttaagttccaagtgggcagtcagtaaatatttcttggtgcatcaaatgctccacattttacacagttaacgtttgctgcctacaaaccaatttggatagttactttaaagtatcttatctctagttctcaaagctttagtttcctttaacacttaagtatctcttgcatattttcttttcaaacactgcttcgttaatttgcaaattcattggactcctttccttaaaaatcaaaataataaaacttcaagaaagctgttgtgacttctggcctctctgaatgtcagatctgtaaacaggaagggcagaactctgatctctaaaatcctctccagtccactactctgaccctctaacttgagctttctccagagaggttaagtgacttttccaaggtcacggagctttttagcggcaggagattttttttgcctgtctatagatttttaaaagctagccgtaaacaaaaaccaaaaagtttaccgaggacactgagtgccactaacaagtttgtgtgaaagagaattcatgaagaaataggagacttcaaacaaaacactaaaatcaacaacaaccataatggattcctgcctaggcaggtcgggacattaagaaaaaaaaaggtctcgctgtggtttgctattagatggagagatattcagatttcatttttaaaatgaaagtgaaagattaaagaattttggcatcctgaccctttgtagaggccattcctcagaggcacagtgtgcagacaaaactatcctagaggtgccaaccagaacaagctctaatgtctgtctcattcctgagccttggtgccttgacgagtcaccacgctcaggaagaaagctgcaactcgccaggatgaaactgggccccgcttcttagaacccttccccgcttccttcccctgccagaaccacactaaagaattcgctgctctcaaagacagacgttttcattacttccttacattatagagtttgggcttagataaccagttgtatgagtagtaagtcaaacagaaatacaacagcaataatacttatttctttccctaattgtaatatgttgtacttcataagccatcatatgcatttgttgcttttcccccttctacactgaccagtagttttgctttgtttgacagaaaagtatagtaagaagaaactgaatttgaagtggattcttacaaaggaaaaagaaaatcactattgtaactataccaaattactatgtatgtgagctcccagctttgacatcaagtcgttacagccacgtaatgggattacgggtgatttttactttattctttgggcttctctgaattttcctatattttgaaaaagcacctgcattattttgtaattataaaaaagtataaataagaattatacacactattatttcttcactgctatgacatgactagattacaatttttttctttttgagatgactttcggtcttgtttcccaggctggagtgcagtggcacgacctcggctcattgcaacctccacctcccgggttcaagcaattctcctgcctcagcctccccagtagctgggattacaggcacctgccaccacacctggctaattttagtagagaaggggtttcgccaagctggccaggctggtctcgaactcctgacttcaggtgattgatccacctgcctcggcctcccagagtgctgggattagaggcatgagccatcgcgcctggcctagattatggaatttttgtattaccatgtatgttgccgtgtaatttttgttttgaaccttttttatttttcttttaattcctttgagacaggatcttgttctgttacccaggctcactgcaacaaggtgattttcccgcctcagcctccagagtagctggactacaggccggtgccaccacacccagataatattttatattttttgtagaaatggggttttgttttgttgcccaggctggtcttgagctcctgggctcaagcgatccaccctcctcagcctcccaaaatactgggattacaggcataagccactgcacccggccttgagcatttgttttttgaaggaaattttatatgattaccacataaaaaaggaatactaaaaatctaacattatttgatatctcactgtctttgaaaacttaaggaacatggacccatacaaggcagccaaatattggccggtaactcctttacaactgggctgcagcatattttattaccttctcctgacaatttcttatctggctgcttatcatttccagaacataccatccttttgcatgcctttacgccagtggcaaacatggttgtttgcctcctcataaccattctctctatcctgcttgctaatgagaccccagtactgttgatcttttccacacagctgtgagttttaggggtggctaagcccctccctacacgtggaggctgaatcttcaccagactaccagacaaagagatgagaagggaggttggatgggaatgttctgggaaagtttacctcactatttaaagccacccaagtcagggacatcctttttcttcctctggactttgtcatctgcaagggatgctggaactgtggctgccatcgggggaccacagaaagtactggcctaagaagaccagctcagctgggcgtggtggcctgtaatcccagcattttgggaggatgcgggcagatcatgtgaagtcgggagttcaagaccagcctgaccaacatggagaagccctgtctctactaaaaatacaaaattagccgggtgtggtggcgcatgcctgtaattctagctactggggaggctgaggcaggagaattgcctgaatccgagaggtggaggttacagtgagcggagagggcgccactgcactcccgtctgggccaatgagagtgaaactccatctcaaaaaaaaaaaaagatgagctcacactggggatgacgggtggaagaaaggccagctgtaatgaacttgctggttttggtaaattcattgccttacccttggacctggtattgtttgagaaaataaattattttgccatcttagtcactttgattttattttttaagttgtatttgtttgcttattgatttgattggcttggcacttatgcagtgactttgtagatgctgtctatgtgttggggctcagaacataatgccctaaaatatggtgacttggcaattgagaaaactgaaggagcaagaaggtcactcactgtgagagctggccacgagggaatgctctgacctatctttgtctgaaagtaggtcataagatgctcattccagagaggtctcgctctatacccagaggcgaagaaggaacagacagctcttgccctactgtcccccagttgtttgttaccgttagataataaatttattctagttgaaatctgaaatactccaaagtctgaaacttttcatttttttgagacagagtcttgctctgtcacccaggctggagtgtagtgcacgatctcagctcactgcaacctccacctcccaggttcaatgatcctcctgcctcagcctcccaagtagctgggattacaggcatgtgccaccacgcctggctaatttttatacttttagtagagacagggtttcaccatgttggccatgttggtctcaaactcctgaactcaagtgagcctcggcctcccaaagtgctgggattacaggcgtgagctgctgcacccagcctgatctgtaatactctcccttgcagtgtcctcagcctcccaagtagctgggactgcaggtgtgcaccaccacaaccagccaatttttaaacatttttttgtagagatatggtctcactatgttgcccaggctagtctcaaattcctgggctcaagtgatcctcccaccttggcctcccaaagtactgggatttgaggtgtgatccacctcacccgggcctgagtcttcctttggaaggctgctgtatcatgtgaaacttatgttaaataaatttgcttatttttctgttactaatctgtcttctgtgataggagtcttagccatgaacctagcgatgggtgtggaatagatatttcttccacacgctagaaaaggctgtgtctgcctggtgcaaatcctgacctgccagttacaagctacttaactttacactattaaatcatcttttcctgagtttcctcatctgttgagttaggataacagcacctatctcatagtgtgatgcggtgagcgaagaggtgaatgtagggaaaggggatagagtgttccacttaccctgtgacatataggaattaggtgctcttcttttttctttccttcctagattatgtgatgcaacaaaattcaaatatgaaaaccatctcggaggccgggcgcggtggctcacgcctttaatcccagcactttgggaggccgaggtgggtggatcatttgaggtcagaagttcaagaccagcctggccaacacggtgaaaccctgtctctactaaaaatacaaaaattaactgggcgtggtggcacatgcctgtaatcccagctactcgggaggctgaggcaggagaattgcttgaacctgggaggcggaggttgcagtgagccgagatcacgccattgttctccagcctgggcaacaagagcaaaactctgtctcaaaaataaaataaaaaattgctttaaaaaataaaaattcatctcatcgctgttctcaattcatatgtcctctccttcgagagggctttaaaaaaactaaaactattttacctcaaaatatacttctttggcatatttttgagatggctgttcagagggcccacaggcaggaatagccctgccaagttgccatttgtggaggagacgtacatctgcagagaaaatctgcagcaatgaaataaacagctaggctttttctgaggccctccgcctatccagacctaggagagattaactgagtctgacacctttgaaaatgtgacagagaaacacttaaccacagactaccttctgttctctctgaggactgctacctgtgagatttaacccacctgtgccctcaccttccctctcccctccctgccataacctattttgccatgctctgagtccctactcctcagtaacatcaagatggtataaaagcatcaactcagccaggggcagtagctcacacctgtaatcctagcactttgggaggacaaggtgggcagatcccttgagcccagaagttaaagaccagcctggcaagcatggcaaaatgctgtctactaaaaatacaaaaaaaaaaaatagccagatgttgtggcacatgcctgtaatcccagctacttgggaggctgaggcaggagaatcacttgaaccccggagatggaggctgcagtgagctgagatcacgccactgcactccagcctgggtgacagtgagactctgtccctcaaaaaaataaaaaaagatggtataaaagtattaactgtatggtcttttttttttttgagttttcatatgtatttttttcctatggcagaagagttttcataatttgtatgactcatgcacatgtgtgcacgttagcgaaatttgtatgccagccatgtgtggcataagcctgtagtctcagttactcagaggctgaggcgggaggattgcttgagcccaggaggtcgaggctgctgtgagctatgatcgcaccactgcactctaccctgggcgatagagcaagaccctgtctttaaaaaaaaaaagtgtatacttttttttcctgttaatttactatatgtttgttttatagactcaaattatcaaggcttcagggggaaaatgtaaacttccctacagctcccctgatcacccagcttacagcagcctcacaccctcccatcccaggcccgcatccccctaactgatttgagatgcctggagaaaataagattgctgctccatcttttataaactacaagttttggggtcggggcagtgcaaagttgcaagcttgctcattcaacccagtcctgaccggctctaccactgcactcgccccagccctccacagccttccaacggcagctgtctccagattccctacgttctagttagcagccttcaccctccccatgaccaaggccccacgaagtctttccaaagcccctgcttgtcatttctgttaacgcgtccccgcctcccacctcgaaattacatagcaggacccgctgcagcccctgcttccttgcaccttggaacatggcagaacttaccacgcgtttctcagggcttgtatggtggacccctgccagtggtttcaaaccttttccgcaccttctctatcaccctccagttcagaaaagacaaaaaggaaaccccaaagaaaatccaaacaaaaaagcttacaagtatgtttctctttgcctccatagtcagcactaattatttccagctggggtagagagcagggtgtggatgggaccaagtcctgttgctaagttcaagtacttgagaatttaacatcccagatcctctccaagctctgctgcagacccctcaactatattcccctagcttaccatggtaacaagccagagggctagccctaagtgtatccacttacattactaaagcgctatcaaatgaacaaataattccctttgcttttcatgcctgaaaggcaatattgtatgatgtttaagaatatggcacagttctgtcgtcccagctgcttggaaggctgaggtgggatgattgattgagcccaggagtttgagtccagcctgggcaacatagcaagatccgatctcaaaatattaaaaataatgtaagttcaggaggccgaccttgatttaaaagtgtgttacctagggaaggttgctgaatctctataaacatctggtttttattgtctaaaatgaggataagaatgaaaaacttccttatagggttgtagagaggctgaaaggaagcaatatatgggaaatgctcagtgtattaactcagtaaatggcatacagtaacaacagccatcaacagttccataaggggaatcccttcattttaaccaggggacccgtggcccttgtgaaaggtctgagaacatctgaagctaacttctacaccaacgtggtcagatgatgccatcccgtatccatggcaaccagatgtctccagtatctagtttagtgccaggcgggtggtgtacaatgaaacaacagaatcacaggctgcaactctgctgttcagttcattcgttagtggaatccctgtaacacactcaaaattctgacttcataggacctttgaattacagtttcataaaagaagttctgaaacattgaccaatcatttcatacacattttttagttattctcagatgatggttgctgatgtaaaaataaaacaaccaaaacctttgtgttagctatatcttcaagtctatcacaatattttagtccatttccttttttttttgagacggagtttttgctcttgtcacccaggctggagtacaatggtgcaatcttggctcactgcaacctctgcctcctgcgttcaagcgattctcctgcctcaggtcctgagtagctgggattacaggcgcccgccaccatgcccggctaatttttttgtatttttagtagagatggggtttcaccatgttggttagtcttgaactcctgacttcaggtggtccacctgcctcggcttcccaaagtgctgggattacaggcatgagccaccacgcctggccttttagtccattttctattgctaatgtaagaggaattagattaggaagtaggtttttgaagacaaattttcaggttacatgaattgttggtagcacctcacttcataagtaatattagatataaaacccttctcaggaaaaaaaaagttagcattctggagaaaggagtaaaggaaacaatggtttattgtcttccgttttgttttgtttgtttttcagagggactcactgttgcccaggctggagtgcagtggcacaatcatggctcacggcagcttcaacctcctgggctcaagtgatcctccttgcctcagcctcctgagtatctgggaccatgggtgcatgctaccattcctggttaattttttaattttgaattttgcagagatgggggtctccctgtgttgcccaggctggtctcgaactcctgggctcaagccatcctcccacttcctctctaagtgttgggattacaggcatgagcctggctaggaagcaatgttggcccacagtgtccagtgcccagtactcttaggaagtatgaatttatgaacaattaacgcccagatgagttaacagaccttgggtataaattggttggtctgtgtccaaaggcaatacagttttatgcttcattttattaccatctgtggaatgggacaataactacaggatggctgttacagtgaatattaaagacttaaaatatgtaaaagccctttgtaagttgcaaagtgctatgcagatgctaggcaaagaagccacagcagctacccagtaacagttgttacttttttttttttgagatggagtttccctcttttgcccaggctggagtgaagtggcgcgatctcagctcactgcaagctccgcccccaggttcaagcgattcccctgcctcggcctcccaggtagctgggattataggtgcccacaaccacacccggctaaagtttgtatttttagtagagacagtttcaccacattgaccagactggtctcgaactcctgagctcaggcaatccgcccgcctcggcctcccaaagtgctaggattacaggcgagccaccgtgcctggccagttgtcacttttttctggctccagctgagtaacatttccaaaccacaattcttcctggaacagcataagttgtgttggccttggccaatattgaactggggttctgggataccgcaaagtattatatacaatttgcataaatgtacatttaggctgagtagaaagggagaaaatgctgtaaaaattaatatgggtcaaaagaaatgatctctaatcataaattgcacacttcccctctcaaccatccccaaaacactcataatatttgatatgaaaataccatggtggcaaatagctgtatcaaaaagaaactattctttcattatagcgtagggtgaagctaagtagattttaagaattactggagtctcccgcactttgggaggccgaggtgggcggatcacctgaggtcaggagtttgagaccagcctgaccaacatggagaaaccccgcctctactaaaaatacaaaaaaaaaaaaaaaagagccaggcgtggtggtgcaggcctgtaatcccagtttcgggagcctgaggcgggagaattgcttgatcccgggaggcagatgttgccgtaagtcgagatagtgccactgcactccagcctgggcaacaagagtgaaactctgtctcaagaaaaaaaaaaaaaagttattggagtcaaacataacttggagaggagacaaaataatttatttttattttatttatttatttatttttgagatggagtctcactctgttgcccaggttggagtgcaatggcacgatctcggctcaccgcaacctccgcctccaggttcaagtgattctcctgcctcagcctcccgagtgactgagattacaggcgcccgccaccatgcctggctaatttttgtattttttagtagagatgggttttcaccattttggtcaggctggtctcaaactcctgacctcatgtgatccgccagcctcggcctctcaaagtgctaggattacaggcatgagccactgtgcccagcagacaaaataatttttaaaaagatgcataaatagagttgataattttggtggtatttgagtaaatgagtagaaaagctgggactggaaggtgtattgttaccacatagttggtgctgattggggagcctctattttcttgactagaaactcacttctaaagagaaagagcacagatgcctgttaacaaataggcttcaggacgaccttttttgaatttccagcagggaggaaaactgggtcacaagaagataatctcaggggttgctggaggattggccttggacacgcccaggtgaggagagaaaacacccaagggagatgttgacagcagagagggcattgaagcaagtctggccagtaggaaaatggagccgatggagatgggggaggccaagaaagctgcatttttcattgctttgtctgaagcagtgagccctgggcacacttgtgcagtagctaaaatttctcaagtctgtctctgtaggcaactggagacaccctgacagcctgtttcccccaactggctccagcccaaattaactcactctctcattccctgagacacttgcctttgagaggtaaaaatttagctagtttgataagagaatgcattttaggtggggagggggcattttagcaggaatttttgcaaacatttcttccctcaagggtaagaaatgtgtattttaaaagggaggtttctataaagttggccttaactccgagggatatttaaagtggggaatttctggcactgctaacagacccatagtgcagctaagacctttctgtggctctcaaatcataatgaagcccaggaaggagaaatgaaattgtatactttgcctgtcacaggcatagagttctgctgagtaatttgtacgtgggattattattccatttcacagatttagaggtgcagctaaagttgacaggctggtaaccagccctcgggagactgcattttccaaaagtggctgcaacaatatcttccatctgacatgtccttctagaacaggtgttcacaaactttttctgttaaaagccatccagcacgtattttaggatgtgtggatcattcgctgtctgacctgactactctatcactgtggcacagccctgggcgatgtgtacatgtacagccttgtttgtgtttgagaggtgagcccattcggtggtctgagggcgatagtttgccaatctgtgctctagaactttgctgcttcccttcaagaggtagagtctaggccaggtgcagtggctcacacctataatcccagcactttgggaggctgaggtgggaggatcccttgagcccaggagtttgagaccagcctgggaaacatggtgaaaccccatctccacaaaacaaaaaaaaaaaaaattagcctgctgtggtggcgtgcacctgtagtcccagctactccagaggctgaggttggaggatcacttgagcccagaaggtcgaggctgcagtgagccgtgattgtgccacttaaaccaccctaggcggcagagggagaccctgtctcaaaaaaacaaaaagaaacaaacaaactggaaaaaaaaaagaggtggacgaattcccttttccttgaatccgagaggtttgtgatttgcctataattaagacaattggaaggaagtgacactgcatgacctctgaggctagatcagaacaggtgatgtaacttttaccagtcagcacataagtagcccagctgtcctgaggctgccatgctgtaaggaagcccaagtgagtccatgtgaaagaccacctgaaaagccttgaaactgtaggagatgctcagccagccccacttgctccagccctcacctggagagactgcaagctcaggagagatgctgagccagaactaccccgccaaagctctccccaaattcctgacccccagagactgagaagtgatgagatgattgctttaagacattaagttttgggggtgatccgttgcatagaaagaaacagaacattttccccaaactagtgagtggcagagatgggattcaaactgaggctggcctgagcccaatcacctgatctttctattaaaaataaacaaaaaatactgctggctgggggcagtggcttacacctgtaatcccggcactctgggaggccaaggcaggtggatcacctgaggtcagaagttcaagactagcttgaccaacatggtgaaaccccatctctagtaaaaatataaaaaattagctgggcgtggtggtgggcgcctgtaatcccagctacttgggaggctgaggcagaagaatccgggaggtggaggttgcagtgagctgagatcccaccattgcacttcagcctgggcaacacgagtgaaactccatctcaaaaaaaaaaaaaaaattgttgaaaactgctgacacagagacatgaagtgagcacatgctgttggaaaaatggtgttgatagacttgctccatgcatggttgccacaaacccttgatttgtgaaaaacacatctgcaaggcctgataaagaaaagtgtaattgccgggcatggtggctcactcctgtaatcccagcactttgggaggccaaggcgggtggatcacctgagctcaggagatcgagaccagcctgggcaacatggtgaaaccccatcactactaaaaatacaaaaaaattagctgggcgtggtggcaggcgcctgtaatcccagctactcaggagattgaggtaggagaattgtttgaacccgggaggcggaggttgctgtgagccaagatcgtgccattgccctccagcctgggtgacaaaagtgaaactccatctcaaaagaaagaaagaaagaaagaaaagcacaattaaacaatgtgtgcctgtatttaaacctatattggctagtgagtttgaccagagtctaacaaaggtttatcaaggaaaaatgtcagagaattcagatcctgtaagtcaaagacacaacctgttccaggaaggactttgcaacagcaattactctaacaagttacaattcgcagagtccggcctttaaggggctttgaagagagagaaacccatgaatcaataataagataaggctatttggtttgtttcaacttgcgggctgtttgacttccgtatcaaagccatgccttgagaatgaaatcatttctgtcaaacagccctttcaaagaacatccgacacaaacactcactggctgctcctttatttccactgtgtccagggtgtgtatggacttggtggaatttaggggaatagctgtgaattgtgcatcaaataaataacctgcagggagttggcactggtgactgctagccataaatgttgctatttgcttacacaggttaagcctgggcttttggaggcttctttgaccttttctgcctttttcccaaccctaacccaacatagctatgacaaggcagttctgggccgggcagggtggctcacgcctgtaatcccagcactttgggaggccgagacgagcggatcaggaggtcaggagaccgagaccatcctggctaacacggtgaaaccccgtctctactaaaaatacaaaaaaattagccgggtgaagtggcgggtgcctgtagtcccagctactcgggatgctgaggcaggagaatggtgtgaacctgggaagcggagctggcagtgagccgagatcgtgtcactgcactccagcctgggtgactgagcgagactccgtctcaaaaaaaaaaaaaagagatgattaagttaattgggtcattagggtcataatccaatatgactggcgtccttctaagaagagagacagcaggacctacgtgcatagaccaagtgaggacagagagaggccagccacccgcaagccacagagagaggcctcagaagaaaccaccttgctgataccttgatcttggtctcccagcttccagaactgtgaggaaataagcttctgttgtttaaggcaccccatctatggtacttagttatggcagccctagcaaactaacatacccacaaacagagaattcacagccttaaggctgggacttcagaaaaattccaaaggtaataagcagaaatttcaacatgcaagagtctagccttttagcgcagtttctctttctgcatctttcccaggtggcctgcaggcaggatggtaaagcagtgctgggggctgggcaggggcgctgctgacctgcaagtctagtggggtcactaaggtctcttgactcaaaagggaagggaccagggttccagtcctagaaagtccagaaagtagcagggagactgagtaggtgtttggtgcatggtcaagaggcccatattgatgcaagtcactaaccccttccctcttctagccgccctagtccttccttctctcctcttcttccagtctctttgacttttcccaccaccccgtcctgcgacactgctttattatcaggtaagtcagaagaaggggaaaatttggctttaccttctgacttagcgtcatgcaaatcctgatgctcttttagttttttccttttttttttttttttttggtgggagatatgggatggaaggatatttgccggagttggtttttttttgttttttgttttttgagatgaggtcttgctatgctgccgaggcttaagtgcagtggctactcatagaccccatcattgcgcactacagccttgacctcctaggctcaagggatcctcccacctcagcctcctaagtagccggaactataggtgcatgccaccatgcctggccacctgctggagtttaagcaggtggtaggatgggtggatggtccctaaagacacccatcttttaatctttgaaatctgtggatatgctaccttctagggaaaaaaaggacttggcagatgttagtaagcatcttaaaatggaaaagttgtcctagactacctgaatgggcccaaagtcatcgtgaggtccttataagagggaggcaggagggtcagagacaaagacgatgatgtgatgatgggggcagaagtgtgtgtgtgcgagagaggagcagaggggttgaagatgcacctctgctgctggctttgcagatggaggaaggggctttaagccaaggaacacaggcagcctctagaagcccgaaaaggacacagattctcccctatgccctccacaaggaaaagcagccctgccgacccatttctgacttctgacctccagaacagtgagatgatctgtgttgtgtaaagccactccgcttgtgggtgtaactggtgacagcagcaataggaaagcatacaggctgcaaggatgaaaatcctcgagaacaactgctatcacattttattattattattattattattatttttgagatggagtttcactcttgtcgctcaggctggagtgcaatggcaagatctcaactcactgcaacctctgcctcctgggttcaagtgattcttctgcctcagcctcccgaggagctgggattacaggtgcccactaccacgcccggctgatttttgtatttttagtacagacggggtttcaccacgttggccaggctggtcttggactcctgacctcaggtgatccgcccacctcggcctcccaaagtgttgggattacaggccagagccaccacgtccggcctggtatcacatttaaacaggcagtgatgtgtgaccagaaattatacatatttctagagctttcacccttcaaacagtggttcccagaggttggtctcccaccagtagtgtcagcacctgggaacacgtgggtcaaatcctcaggctccacccaggactactgggtcagaaactctggaggtggggccagcaccctgtgtttgaacaggtccttctggtaattctgaggcatgctaaggttcaccttaaagataagtgacctggggctgagttcagtggctcacacctgtagtcccagcactttgggaggctgctaataatagctatgattattatacctgccctgacattatcttctgtttccaggcttgacatataaggatcctatacaagatttcacctacacaagagattcaatccatcttaggttctgctaatgacctcccctcctaaggttcatcaaagctgaagcgggaagaaggcttgaggataggagtttgagaccagcctgggcaacatagtgagaccttgtctgttaaatcaagtttagcctaaagtggcctccttacatattttaagttcagcctaaaggtttctctgtacatagtgaactatatacaacctaaatggaggtataaacccactgtaacctactcttgtgccaatcagagagttttggccaaagggggccaactgttcaaaccgtgttcaaataaggcaaacgccaagctgtagccaatccaactgtttctgtacctcacttctgttttctatatgttactttcctttttctgtctataaatcttccactgcgtggctgcactggagtctctctgagctaccctggcttgggaggctgcctgattcgcaaagcattctttgcttaactaaactttgttaagcttaatttggctaaggtttttctttcaacacgtccctgcaaaaacttaaaataaaagaaattagctgggcatggtggcatgcctgtaatcccagctagtagggaggctgaggtgtaaggattgcttgagctcaggaggttgaggctgcagtgagccgtgattacaccactgcactccagtctgggtgacagagtgagaccctatctctacaaaataaatacataagttaaaagtgacctgggctgctgctttgccaacagagggtacctgtggagcctctgatgtgcgtatgggtagtgtatgtgtatgttggctgtgtgtgtacccactgactctacaattaagctgattcttttttttttttgatatggagtctcgctctgtcgcccaggctagagtgcagtgacgtgatcttggctcactgccagctccgcctcccaggttcatgccattctcctgcctcagcctcccaagtagctgggactacaggcgcccaccaacacgcccggctaattttttgtattttttagtagagacggggtttcactgtgttagccaggatggtctcgatctcctgacctcgtgatctgcctgcttcattctcccaaagtgctgggattacaggcatgagccactgcactcgtcctaagctgattatttcatgattcatgcttggcttgggatctgggaatgatggggaaagttactctctcaaagattggctctgtcccctggggaatgtgggaggagggagagtccagaattcggcttccaagtggccacaagtctggcctccttcacccagcctgtgcctgtgtccacaggacaagatccaggctgacagccatgcactgccacaccactgtcccagactggggcaagcagaagggggctgtttcctctcatctttccccaatttcttgcttgccagaggcaatcctaacttggctagcggaaagataatcacttttgaaaacatgagtgaggtcagcccttccagccacagcctggagtttgaaattacacattcattgatttctttttttttctttttctttttttttgagatagagtctctctctgtcgcccaggctggagtgcagtggcacaatcttggctcattgcaacctccgcctcccaggttcaagtgattcttgtgcctcagcctccccagtagatgggactacaggcatgtgccaccatgccctgttaatttttgtatttttagtagagaaggggtttcaccatgttggccaggctggtcttgaactcctgacctcaaatgatccgcctgcctctgcctcccaaagtgctgggattacacgcgtgagccaccagcctggcctgatttcagtactggaatggcctcatgtcagctgggtgatcttgtgtgctgcctctctgtgtccccatgtcctcactggtgaaacaggcatgctaaaagcattgatttaagagagttgttgagaggatcacatgagataatcaaggaaaaagtcttagatcagggcctggaacaaagtaaatgtttaatcctattaatgcaattaattgtggttaatgacatgtcataattaatagctatgattattttcacgagccctgacattatcttccatttccaggcttcgcatgtataagaggtcctagacacaaattcacctacacaagggattcagtccgtcttaggttctgctaatgacaactcttcttgaagttcttcaaggccgtgtgaaaaggaaaagccagccgggcacagtggctcacgcctgtaatcccagcactttgggaggctgaggcgggcggatcacctgaggtcaggagtgcgagaccagcctggccaatgtgtctctactaaaaatacaaaaatcagccgggcgtggtggcgcatgcctgtaatcccagctactcaggagcctgaggcaggagaatcgcttgaacctgggaggcggagcttgcagtgagccgaggtcacactactgcaccccagcctgagagacagagcaagactccgtctcaaaaaaaaaaaaaaaaaaaaaggaaaacccccctagaaaatgcttttcccgttgcttccctgctaatgggcctttttcatcagggcagcctccagccttaggatgtggccggtccccgtgcggatgcccgtttcccctcctgcctgcattcatctgaccggttcagtgggatctggtacttttcctccctcctcctcgtgctgggcttccacatcatccagacagctgctgccacattccaccgctccagcagcggaagtaaggcacatttaggccctttctgggtgagtgacagcatttgagatgagattaatcaaatgccagtgttaggggaaagcagcctttccctgagtcacctctgctccacctttctcatgacacagagcatgagcctgtccaacggttggcctgtgcgtcaacctctggccaggagacaacgggcgcctgtgacctgggcgtgaaccgtctgtttgtgcgcataggtctgacactgctgctgggcgagcctgcgtgcccctgccccgcggtccattgactgtgccgctgagcacaggcagggatgtgtgcctgtcgccctgggccgctgtcccctgacggcagatgagatattcttccagctcaacactgatgttgcagggtttttcctcacctaccgcatgacgactgaatgaaagcattccaggaaaccaaaagggctgggcaggcctctggaatttcaaagccgacagcctggccctgctggcagctcatttctgccgcgtcattttctctgaactgtaggagtagttttgtagcaaacttatcaccaaaatcccacaaatgttaagcattacccttcttagaaaggaaaagcctacttacttttccccattggaagacttcaattttttaagattcaagaaatccccaaaagtcatgataaagaagagggaaaacagactgagcatacccatccccttttaaattcaaatttattttgtttttttctgcttagctacagggaaggtttgatcatatcacatctgagttaggccatatgcacccagggggaatctcaagagcaaactaatctaaactccaagaaatagaccactaagacccacccaggtagtactcactgaacgctcttcctgcctctcataagaaccaaaaatagcggtttcccgcagatgctcccagaagcaaagtctacctaccacacacacaatatgcagaagggaaaaacccaagccacaagtccctaaacgcctgagtcgtgactcatggaggctgtcctccacccctgccaagtataagaaatgatttctacccacccacttctctaaggagatggtccctcattcctctctcccgagcaggcttcacagcccccttcatagagatgaagccctagtcattaaatgcccagtgatgttacgactgccaaattctatgactatttggaaagttttatcaggtatggatacactccacctatttgcttaggtggccaagatctctgtgcagttgcacagacagtttctgtcctcccaccccgtgagaggttgtgtgtgtgtttgcgggggctgggaagctaatggagggaaggagagacctcctcaggtgagtcaccttgcagtggaactgcttcctgtgtgtgtgaagttcttcaaggaggcaccacttcacgcaatgccccaaacagaaaaatcgaagcaaattagcaaattattttctaggagattagatgttggacaacttcaagctttcacaatagaaaatggcttgttttaaggcagttaaacccaaagcatgccttttttggggttttgtttatgaatatgttgtaatctaagaagagtaatgttcttacagaaaaattagaccttcatgattgcaatctaagtgagaggcaattaggcttatttttcttagagattagtacatcatgttagttcagaaagcatttgtaaaacagaaaaaaaaaggaaatcataaatatcaatttcatcttaacacaatgcaactatcactgttctcaacctgagttcttaatttctggcatgtcacaaattccttgaactaccaatgttgaactaacctcccctgacccagggagttgaatagttttttcaaaggatatgatcaaatctctgttcatgcatgcctacatttattcattttccaaaagcataaattaattctgagggacagaaagtagacttgtgcttgcctaggtttgtgggagatgaaaatgtggctgggagccatggctcacacctgtaatcccagcattttaggaggctgaggcaggaggatcatttcagcccaggaattcaagaccagcctggacaacatagggagacccatctctacaaaataaaaaaattagcccagcgtggtggcacatccctgtagtgccagctacttggggggctgaggtgggaggatcactttagcccgaggttgaggctacaatgagtagtgatcgcgccagtgcactccagcctgggctacagagtgagacccagtctcaaaaaagaaaaaaaaaaaaaagatcaggaatggcggctcacatctgtaatcttagcattttgggaggctgaggtgggaggattgcgtaagcccaggaatttaagacaagcctgggcaacatggcaaaactcagtctctacaaaaaatacaaaaattagctgggcatggtggtgggcgtctgtagtcccagctactcaggaggctgaggtgggaggatcacttgaatgtggggggtcaaggcttcagtgagccgagatcacaccactgcactccaccctgctgggtgacagagcaagaacctgttaaaaaaaaaaaaaaaagcaaagaaaagaaagctggatgtggtagctcatgcctatcatcccactactttgggaggtggaggtgggcggatcacttgaggtcaggagttcaagaccagcctgcccaacatggaaaaattttgtctctactaaaaatataaaaattgtggtggcgtgcacctgtaatcccagctactcgggaggctgaggcaggagaatcatttgaacccgggagggcggaggctgcagtgagctgagatcacgccactgcactccagcctgggcaacagagtgagactctgtctcacaaaaaaaagaaaagaaaatatttgaagctaagactgtggtgatggttgtacaactctgtgagcacacacacaaaaaacgctgaattgtgcactttaaacgagtggattttatgacatatgagtcatatttcaataaggtcattaacaatgtacctgaaagaattacatggtctcatgaaagtactgctaacattttattagtgctagtaatttttttttaatagagatgagggctcactatgttgcccaggctggtcttgaactcctgagcttaagtgatcttcccgccttggcctcccaaagtgctaagattacaggagtgagccaccacacctggcctagtgctagtaattttttgtcagttgtttctggtgtgtgattactaatacaatgctcttgagaagaacagattgcagaagtttataggcttctgagctcagggaaggcactgaccgagtcccaggcaggcaaatgcagtgagtgaatttgttcagtccaatgtgttgtcagtttccttcgtacagttccatgagatagaggaatgttaggcatatatgtttgctttcttatcccccatctttcctgtccttctcccacacgctacagtcctacacgctatccggatgcttctctaatgggtgggcgtatcagaattttgaggaggaagacagtgaagagcaggtagtttttgtaatttgaaaaaacatacagtagtttgtcttgtaatataatatttagttgtggggcattccttctttctctgctatatatatttttagagatggggtcttcctctgttgcccaggctgcagtgcagtgatgtaatcacatctcactgcaacttcaaattcctaagctcaagtgatcctcctgccttaacctcccaagtagctgggactgcccatctaattaatccctccgctattttttctttctttcttccttccttccctcccttcctccctccttccttccttttttttttttttttttttgagatggagtctcgctctgttgtccaggccggagtgcaatggggcgatctcggctcactgcaacctcccacctccccggttccagtgattctcctgccacagcctcccgagtagctgggattacaggcgcgcaccacacctggctaatttttgtatttttagtagagatgggctttcactatgttggccaggctggtctcgatctcctgacctcaagtggtccacccgccttggcctcccaaagtggtgggattacaggcgtgagccactgcgcctggccttgtgctatattctttttttttttttttttttgagacggagtctcgctctgtcacctaggctggagtgcagtggtgtgatcttggctcgctgtaacctctgcctcccgggttcgagcgattctcctatttcagcctcccaagtaggtgggattatagccatgtgccatcacactcagacgatttttgtattttcagtagagacgaggtttgaccatgtccgccaggggtcttgtactcctgacctcaagtgatccacccacctcagcctcccagagtgctgggattacaggcatgagccagtgtgcccagcctattcttaaagaataattacaaaatgaagattccgaaaccaccacgtaggccaagctatagaatgcctccgagcctgcagttcacattccccgtgcatcttttccctgttacaaacccctcctatcccagaagtaactagtctgctgatatttgtcattattttcttgcctttagtatttctgcatgcattcctaaacaatatagcttgattatgcctggttttgaactttaaattaaaagaagcttactacatatatgtattcttttgtattttgcttcttttacttaatgttgtgggttgattcacctatattgtaattacatacaacttgtcaatttccattgctatatgaaaataccatttcattgcatggaaataaacaataaaaatacattttactatagatggatatttagggtttttttggtatttgaacaatgccaccatgaatattcctgtcctgtatttggcacacaagtaaaagacttttctagaaaatgttcgggttgtttgctatgagtttcttcataatgtcaaataatatttttaaaaatgtggatattgtcccaacatacactcccataacagtgcatgagaattcctattgctgctgcatatctttgccaacatttgatattgttacactttataattttttgtggccaggcacagtggctcacacctacaatcccagcactttgggaggccaagacaggagtttgagactagcctgggtaacacagcaagacgccatctctaaaaaaataaatagctgaggtgggaggatcacttgaacctgggaggttgaggctgcaatgagccatgattgtggcactgcactccagcttgagtgacaaagtgaggctctgtctacaaacaaataaataaaaataaaaaataggctgggcgcggtggctcaaccctgtaatcccagcactttgggaggctgaggcgggcggatcacgaggtcaggagatcgagaccatcctggctaacacgctgaaaccctgtctctactaaaaatacaaaaaaattagccgggcgtgttggtgggcgcctgtagtcccagctactcgggaggctgaggcaggagaatggcgtgaacccgggaggcggagcttgcagtgagccgagatcgcgccaccgcactccagcctgggcaacagagtgagactctgtctcaaaaaataaataaataaataaataaaaataaataaaaaataatgaaataattttttgctaacctggtaggtgtgtattggtatctcactgtggatttaatttacttattttggattcctaatgagatgagcactttttgcaggttttgatatttcgatgtccctttcttgtgaagggcaaagtttgaacacaataggcaaatgtagcaatctttttaaaaattttcatgctcttcatattttatttcagaaacttcccctacccccatatcattttgggaagctttattgtttggcctttcacatttaggtcttaaattcaactagaattgcttaggagggctggagtataaagttgtaatggttaattttatgtgtcaacttgactgggccatgtggtacccagacatttggccaaatattattctgtgtgtgtctgtgatggtgcttccaagtgagagtattacattggaatcagtagactgagtacagcagattgctctccccagtgtggttgggcctcattcaatcaattgaagaccggaatagaataaaaagactgaatatgagagaatttctcctgtccgactggttaagttggggcatcggttttttccagccttcagacttggcctgaaacattggtcctccttgggttgtgagcctgcaggtcctcagactgaaactatccatcagctctcctggttctcaggctcctggattcaagctggaagtacacatcaggtctcctgggtcctcagcttgatgactcgagatcttgggaattctcggcctctataactgtgtgccccaattccctataataaatctttgtctttctctctctcctgttgtctctgtgtctctgaagaaccctggctaatacaaaggtatagtccaattttattttattttttttccaaataaatactcctcagtgacagcaccatctactgaatattgtcccttccccactgaattgcaaagatgcctctcaagcttccatatgagcacgggactatttctgtaatctgtagtctgttctgttgggctactgccctgtccttgtgctaacaccatgtcttattactataggctaattatgaatcttgatgctcaatagggcaaatcctctaattttgctgcttttcaagagtatcttggctgtatgtggcactttgcaaaaactaaaacacaacaacaacaacaaaattcaggtttttggttgatattgcattaaatttatagatcagttttaagtgaattgacacctttctaatttgcagttttgaatctttttatttattttttatttttattttttttatgagactgagtctccttctgtcgcccaggctggggtgcagtggtgcaatttcggctcattgcatcctctgcctgctgggttcaagcaattctcctgtctcagcctcccaagtagctgggactacaggcatgtgccagcacgcccagttaatttttttttttttttaagtagagatggggtttcaccatgttggtcaggctagccttgaactcctgacctcaggtgatctgcccaccttggccttccaaagtgctggcattacaggtgtgagccaccgtgcctggctgactctttttatatgactttaggagttagtctagaaattctaatccacatatttaacttactaatatctagacttaatacccttaaccttttcttagaaaatacaaggtacttaaaacactttaactcctgacttctactgggttatatgtatttttaattctgtcttttaaaaaatattctggacagttgtggtggctcatgtctgtaatctttgcactttgggaagctgaggcaggaggatcacttgagctccgagttcaagaccagcctgggcaacatagtgagaccttgactctacaaatagtaaaaatattagctaggcatggtggcgtgtgcctatagtcccagctactcgagaggctgaggcaggagaattgcttgagcctgagaggtagaaactgcagtaagccgtgattgcaccactgtactccagcctgggcaacaaagcaagatcctgtctcaaataagtaaataaattaaataaaattcacaagatgtaatttgttatttttattttattttttcaagacgaggtctcgctctgtggagtgcaaatggcgagatcatagttcattgcaacctcgacctcccaggctcaagcgatcatcttatctcagccttctgagtagctgagaccacaggtgtgtgccaccacaccgaattttcttattttttgtagaggcaagttctccgttgcccaagctggcctccaactcctggctcaagtgatcctcccacctcggcttccccaagagatggggttacaggcatgagccactgtgcctggcctcacaagatgttgttatctttgttttacactatcaatgcccatgcgtccttacttaattattaaccactgtattgctgttcattcttcctgcatctcatatcttccatcagggatcatttttcttctacataaaataaatcatttgtaatttcctttagcggtggtctgcagtcttcatttgagggtgtctttattttgtcttcattctggaaaaatattttttcttttctttttttttttttgagatggaattttgctctttgttgcccaggctggagtgcagtggaccgatctctgctcactgcaacctccgcctcccaggttcaagcgattctcctgcctcaacctccgaagtagctgggattacagactcacgccaccaggcccagctaattttgtgtatttttcgcagagacggggtttcaccatgttggccaggctggtcttgaactcctgacctcaggtgatctgcctgcctcggcctcccaaagtgctacgattacaggtgtgagccatcatgcccatcctaattcttataatccaacgtcttaatccttggtgggttgtttctctcatttatgatgccttgtttccttgtatgcttggttatttttgacagtgagaagattactttccttgggagcttattttggaaggttatatgtggcctagaaaaagtctttttttttctgtagaggattatcatttgaaatatatcattcatggcttgaagttttttggaccgttcaggtgatgtaaatttgggctgaggtttgaatgagagctcatggttacaacttctcatgaatggataacccccaattttagtaccaagacaagtgtttgtttttgtgttttgagttgagatggggagtggatcatatggcaatgactacttgctcatctttacctttagggtataatctttttggggtgccaggtttatgggatagaattttcctattaggctacgccttgggcaagttttgggctttaaagtctgcttctacctactctaggtaccatcaaagcctaaattgggctgggcacggtggctcatgcctgtaatcccagcactctgggaggccaaggcgagcaaatcattcggtcaagacattgagaccatcctggccaacatggtgaaaccccctctctactaaaaatacaaaagaaaaaaatcagctgggcatggtggcgggctcctgtagtcccagctactctggaggctgaggcaggagaatcgcttgaacccagaaagcagaggttgcagtgagctgagatcatgccactgcactccagcctggtgacagagctagacttcatctcaaaaaaaaaaaaaaaaaagcctaaactgaagatcaagctgaatagatagggagggggagtgctttgcatgcttccctcaggggaatttatcagaattaagagtggaaggtggggatttctgccagggatgattatgtatatgtatgtacagtatataaaaacttagcttggattttttaaaagtttagaaacactattctgtaactgtattcagtcctgttttctaaaatttcactgaaattgcaattctacaaattctgtaatgaagttcctttatattttgtgattccttagataatgtgctaaaagctatagatacttttctccagaggtaattcacatatgcacacatgtatacacttttattataatttcaaatggtttaagagaccctctaaagtccattcatggagtcagtgtaagaacgtaagctctaaaaatactgaatactacttgaatttccataagtaaaggaatagttaaataactacggccatgcatgaaaacagaattttatgaagacattaaaaagaaggtaactttatatttaccaatatagatagatgctaaagatacaatgtcaagtaaaaagagcaatttgcccagcatattagaataattttggttgtgtatatatattatgtatgttatgattccatttgtgtatgtgtatagaaaatatctgaatacacaagaattttggacaatgtggctggatgagtattatacacaagaatacacaagaaatttggacaatgcggctggatgagtattatagagacttttttctttaaaataagttatctttgaacatccccccccactataaatttgtatactttttttgcatatattaaagaaaaaaatcaaattaattaaaaggtgaatcttttttataatacataatgttttatttataatctactccaaagaaaaaagtgactttgtatttattgctattcaagtgagatccttttctgtagctgaaaactttgatctccctttccttctttgtttacctaaaggttaagagacatttttggactttccatcctggcttgactcatcactggttgatcatcttgcttttgattctcttcttcaagttttcaatttcttatttatgtgtaatgccctgacattataataataaaatccagatagatgtaaattatattgagaatattgccttcatttctatatgaattcacttaatttatgtccttttaagacacactttgtgattttaatacaaactggttcatggattattaattcaaattatgctgttatagtcaaccacatgagatgaggtaattggaaagataccatgttcttacataacgatttggtctctgaatgactgaaggactctccctgtcatttatttgtacagatgaatttattcgaaggtgaacaaagtaattctaatctttaccaaacattaaatttcctacttgatatttcaactcaatgacatccaatttttttaagcagagtaaattttctaactttattatctgacatacatgaggcgtgttgaataacattagaaaagagacattttccctggctcctgttagagcagggtttggaatgaagcagggaagtgtgtataataaacatagaaatcactacaatagaagatacatgaaatgtccagatgttctctcttactgaccacagaaagtttcatatacaaactagtcaagagtctggttgtctgtcccattttttttttttttttgagagggagtctcgctctttcacccaggctggagtgcagtggcgggatctcggctcactgcaagctccgcctcccgggttcacgccattctcctgcctcagcctcccgagtagctgggactacaggcgcccgccaccacgcccggctgatttttttgtattgtatttttagtagagacggggtttcaccttgttagccaggatggtctcgatctcctgaccttgtgatcctcccacctcctcggcctcccaaagtgctgggattacaggcgtgagccaccgcgcccggcctgtctgtcccatttttttgtcagcaaataggagctccaccttcttggccaactcattcattcattcttgcagcagtgggtgtggtgacctctactgtgactagctgaggacaacctcctggggaccagggaagctgctggggatgtactttaatgagaatactcaccagcagatggccaccatctctgtcttgcagtcagttacttgctaacaacttccttatgtttaacccaattctctcttggaatgtaaccccctaactttgaattctaatcttcaaaaagaaagaaactggcaatatccaatttgtaagccctcattcttcccctcataactatgtttaaatagtcagcaattccatgaattcaatctcctcatcccatggatgacttggtcttgacaggccttcctcaataatcactggattttctgcctctaatccagacccttcctaattcactcttcgaaatgccttctgagttgtattttgaagaaagcaactcaatacttcattcactggcttaaagatcttcaatatctcctcatttcctaaagaatgaaattcaaattccttgaggggattttgacagttgggccctttatcttctgcctcttcctattctctccccacatacctttcgctcttttctcagatatgtgtatggtcctgtttccctgacttgacacatgcaacccttctgcttggagtttccactctccctttctttacctggccaactcctatcatccttcaggtgtgctgtcacctctcctgtgaagccttcctaggttatctgctttgtcctcatgctctcttagcctttaaaggctgtcttttacacctttcattaactaattatagatttctgtctccccaagagataagaacccatgtcctcactatttctgagtccagaccctatagagtgcccagttcaatagaatttgttttcaattatacttttgtatataatttttgttggtttgttttttgagacggagtctcgctatcttctaggctggagtgcagtggcactatctcgactcactgtaacctccacctcccgggttcaagtgattctcctgcttcagcctcccgaggagctgggactacagacgcacgccacaatgcatggctaaattttgtatttttttttagtagagatgggattactctatgttggccaggctggtctcaaactcctgatctcaagtgattcacccgcctcggcctcccaaagtgttgggattacaggcataagccaccatgctcggccacttttacatctttttttttttttttttgagatgggatcttgctctcttgacaggctggagtgcagaggagtgatctccgctcactgcaacatccgcctcccaggttcaagtgattcccctgcctcagcctctcaagcagctgggactacaggtgcacaccaccacacctggctaatttttgtattttcaatagagacggagtttcaccatgttggccaggatggtctcgatctcctgacctcatgatccacccgcctcggcatcccaaaatgctgggattacaggcgttagccactgcgcccggccacttttacatgtcttaaatgagttcatatgtctttctaaggaaactcaatcttttcctaagaacaaaactgaactatcacaaaatgaacccctggatgtccctgattatccaataggcaacagtgataccccatccttttgattgttgtaaaattttgcagtgtatgtttatggatatttgcagggatagtgagtgagcaagaaaggggcaaaggctgatcaaggaatttcatttcttcctaattttaagacccacaatctggtaatataaaatgatacgtgcaaatccctagaaaagtctccatctgaggctctcctcttgtttgccttctagaaacacgtttagtttatttggtaaaggagacacacttcgctcctggtagcactttcctatatctacgattttgctcttttaaaaatgtttttctaggccaggcgcagtgcctcacaactgtaatcccaggactttgggaggctgaggtgggaggattgcctgagcccaggagttcaagaccagcctgggcaacatggcaaaaccctgtctcccccaccaaaaaaaaaaaaaaaaaaaaaaattagccgggcatggtggcatgcacctatagtcccagctactcaagacaccaaggtgagaagattgattgagcctgggaggtcgaggcttcaatgagccatgattgtgccactgcaatccagcttaggcaacaaagtgagatactgtctcaaaaattaaaaaaaaaattctagttatttaaatattatatcaatataatacacagagttttgttaaaacttatccaattccaaatatattagaaagactaatgcctgacttacgtttctttggcacctaatgtattttcaattcataactctatggtttgttgcattatcactattgtaggtttttgtgctaggtagcttttttttttttttttttttgagacggagtctggctctgttgcccaggctggaatgcagtggcatgatcttggctcactgcaagctccgcctcccgggttcccgccattctcctgcctcagcctcccgggtagctgggagtacaggcgcccgccaccccgccaggctaattttttgtattttttagtagagacagggtttcaccgtgttagccaggatggtcttgatctcctgacctcatgatccgcccacctaggcctcccaaagtgctgggattacaggcgtgagccaccgtgcccggcccttttttttttttttttttgaggcagtgtttcactctgttgcctaggctggagtgcagtggtgcaatcatagctcactgtagccttgacctcctgagctcaagtgatcctcctgcctcagcctcctgagtgtctaggactatggacttgtaccgccatgcctggctagtttttaaaagttgttttgtaaagatagggtcttatgatattgcccagtctgttcttgaactcctggcctcaagtgatcctcccacctcagcctcccaaactgttgggattacaggtgtgagccaacatggctgtcttttctccccccatcttgtgattttatattttgtttttcttccctcagtcacattaatgtatatcttactgccttggatgacatcttaatgagatatttatactttataaagatcacagtgactattctgttaatcttacatttttaaaagtgtgaaaattttaagaataatatcaaattcttgaggcattatgtgctttctgtttttaacatcaggcaaacattcaatatcatcagtacttgataccattagtatttgattcctacattatcaagagaacaaccctaaatgagtctgattataacaaagtccaataagatcctaaaatggtcacattggcttatggcatcaaagtggatattagataaggttgcaatcgttgtataaatctcatttcctttcatctactttatctaaccacacttagtgataaatccacaagaactccaaaactaatgctacactgtgccttcagtttcctaagatagctttttaccctcgtcggttttgaaaggaaaaatctggccaggcacagtggctcacgcctgtaatcccagcactttgggaggccaaggcaggtggatcatttgaggtcaggagtttgagaccagcctggccaacatggtgaaaccccgtctgtactaaaaatacaaaagttagccaggcgtggtggtgggtgcctgtagtcccagctactcgggaggctgaggctggagaatggcttgaaccctggagatggaggtttcagtgagtcaaaatcatgccactgcactccagcctgggcaacagcgagactccatctcaaaaagagaaaagaaaagaaaagaaaagaaaagaaaagaaaagaaaagaaaaatccccaaagctgtgaaccatgacctgggtgctattagcagcgtccagaggagcctgcacagaagcacaggaagagcacgaactgatgctttgtggagatagcacagggcattggcggtcacggggctagaattttgtatgggaatcacagcccattggcttaaaaggaatcacagcccattggcttaaaatctgattacagatgaggtttctgaagggccagcttggcatatcagtgactcaggcaaaaagcctctgaaatctctgatgcagatgatgatgaagtaacagtctggtgaacataatacaccattggacataattgttctcctgctacctgcagagttgcctttttttttttttttttgagacagagtcttgctctgtcgcccaggctggagtgcagtggcgcgatctcggctcactgcaagctccgcctcctgggttcacgccattctcctgcctcagccttcggagcagctgggactacaggcgcccgccaccacacccggctaattttttgtatttttagtagagacagggtttcaccgtgttagccaggatggtctcgatctcctgacctcgtaatccgcctgcctcggcctcccaaagtgctgggattacaggcgtgagccacggcacccggccccagagttgccttttaaattaattagcctagtgagatagggtacattattttttttccgtatccctcacagctcgtaggatagtagtgtcttccctgtgatagatgcttaataaatatttatttaaaaaatagatataaataaatacaggggtaacttgacataaaagtcctacttaaggactgctgtgggctaagtactatgttgtcctgttctcttctcactccagactacgtgctgaagtccttgatctatagcccaagcaacagagaatggcacactcttaggagcaaagccagaattgtttccaacatgcaataatagtataccatcttcgaaagcacttcaaagcaaccaggaaagtcaggacctgctacacagcgagacagacagcgggcgctctcagctcaggtcggaaatgaattcttggttgaacaagtgatggaaaccaacaaagctcccaaactgaggagaaaccaagcacgtggagacaccggcaggtcaggccccaggggtggttccccagtgtcccactgctgcactcaggaccctggggtcatctaatctgatcctgtgctcttcctataccatgcttgcaaatgaaagatgtttcctagctgagggccaaagacgtgatgaccaatgccaaaagcggagcaacccggcagtttcctgtgctttacagcaaaccttatgtctgcttatgtccagaatcattctcaatctcctttctccgccaatatgactactgttactattacaagtactatcaccatttattgagtgcacacaatgtgccatacattgtcctaagaccttattatgtattatacaatttaatccttactattattgtcattcaaatttttaatgaggaaagagaggcacagagaagtcagtttatttgcccacagtcatatggctactaagcaggaaggccaggattcaaaccaagcagtcagaatctagaactaaattcttaacaactacactgtacaaaacattttcttcatgaggcacagcaaacaagagtacactagtattccatacaagtaagacaatgtattatatgtaatactatatgtgtgtatgaacatttattacttaattacatataactagtattatatatcatatattaatacataattattaattaatgtatattatgaaggattctcagggcagtcattccattgaaaataagacaagaggccgggcgcactggctcatgcctgtaatcccagaaatttgggaggccaaggcaggcggatcacctgaggctgggagcctgaccaacatgaggaaatcccgtctctactaaaaatacaaaaattagctgggtgtggtggcgggcacctgtaatcccagctactcgggaggctgaggcaggagaatcgcttgaacccgggaggaggaggttgcggtgagctgagatggcaccattgcactccagcctgggcagcaggagcaaaactccgtctcaaaaaaaaaaaaaaaaaaagaacataagacaatgtacacatatatatatacacacacacacacacacacacacacagacacacacagtatataatactgtcctctatggcaacaatagtagattggtttttctgtaataaattcataacaaatacttatatttcactctacagtttgaaagtcctttcacctcatcatctcacttagccacatagcagtcctgtaagggcatagaacaggtggttgtctcatatgtactatagatgctgggcctaggcttatgagcctttcaagaggatacaaatgtttgagtcttgaaaaaagagtcactggctctaaaccatgaacagaaaactgcaacatgaaaactaataaaaatttagttaaatgcctttggacgctaaatctctaaccggtctctgtgggacagtgctgcttctgttctgtcttcagggatctgtctccactaacacctgggtccccttcttaaacagtgtttcatagaccagtgcctgtcactgtggacacacgtgctaaattatgttcatttacctgaagtccattgtcattatccacaaacactcctccgctactccctcaccccatctcattagattgtgcctggaagcattggtactgcaggttgactatcccttatccaaaatgcttgagaccagactgttttggatttcagatctttttgaattggattggaatctttgcattattcttactcgttgagcatcccaaatctgaaaatccaaaatccaaaatgatccagtgaatacttcctttgggcatcatttcagtgctcaaaaagtttcagattttggagcattttcgatttcagatgtttgaatttgggatgcttacctggcatatgtaaatgtgagatttcactatgcaccatctccctcagatagtttaaactgcttttagccctatctggagataggtatactgaaaaggagggtattactgtggatgacttcaaggattcaattattactcactcagtcctgcatttgaaactttatgaccttaagctagtaccttttccatgccttttttggttttctcctctacaaatcaagggataataagagtggctactgagttactgtgaagtattaatgagataacatacgccttgcctttgcttactataattatgaacgtattataaagtgctcaacaaatgttagctctttgtatcataagccttcatatcttcttgataagatacattctttgtccagaacttaaaaagcacaccccagagctaagcattttaatatactgctggtgggagtacaaaaggtacagccccttgggagggggatatggcaatgtctagtcaaaccagctactcttcgacactttcacccaacaattcaacctctaggagtttatctgaagatatgcctccccacatatgaaacaactagactcaagttattcattgtggcattatttgctatagcaaaatattggaaataaactgcacatccatagaagattgtgtgagtgaattatggtacaatcacccaatagactaccatgcaaccctagcaaagaaggaagaagattttaataaaatgaatgatttccagaatatactacagaattttgaaaagcaaagagagtgtataatatgccaccttttgtatacgtagaaacgggaggacagatgaaagaaaaagaaagaaagaagaaagaagaaaggaaagaaagaaagagagaaagaaaaagtaaatcaaaaccaaaggggtattctctctaatatataactccaacaactcagtaagaaaaagactaacagtcatctaaaaaatgctgaaggaggccaggtgcagtggctcacgcctataatcctagcactttgggaggcagagacgggcggatcacgaggtcaggagatcgagaccatcctggctaacacggtgaaacctcgtctctactaaaaatacaaaaaattagccgggcgtggtggcaggcgcctgtagttccagctacttgggaggctgaggcaggagaatggcgtgaacccgggaggcagaggttgcagtgagctgagatcgcgccactgcactccagcctgggtgacagagcgagactccatctcaaaaaaaaaaaaaaaaaaaaaaatgctgaaggatatgacatgacagttcattgaaaaggaaatacaaatgactcaaatataggttcaacattgctcataataagagtattacaaatggaaaacccaaaagtttgatgaaagagtacgttgatgaaactgtggagaaacaggcgctttcaacagtgctggtggcactcctagtggtgtccactgggaaagcctacggagggtaatttggcagacttttgccaatgaaaaaagcatgcatgctttctgatagatataattagtgctcacccatattgtactctcttctcctaccagaaacacacacaaaaactgtacttcttggccttcctgaagtttggcagggccatgtgactagttctagccaataaaatataagtggaaataatgtttgtcacttttggttcaaggttgtctctcccctgcggcaatgactgtgaaggctgtgggttccagatggtgcaggcacaagacccaagcctgggtctctgagagactgtgtggagcaggaatctcctgcaaaacgaacatcacaggacatgtactaggggttggaatatttttggtatgtttattgacagatttgagagttgtttgttattgtatgcaaaacgtaacctcattaatacaatctttgacctcgtaactccacttcagggatttatcctgaagacatattaggacaaaattatatgtttacaatactattttattttatttatttatttatttatttattgagatggagttttgctcttgttgcccaggctggagtgtaatggcgcgatcttggctcactgcaacctccgcctcccgggttcaagtgattctcctgcctcagcctcctgaatagctgggattacaggcgctcaccaccattcccggctaatttttttatatatttagtagagatgaggttgcaccatgtcggccaggctggtctcgaactcctgacctcagatgatccacccgcctcggcctcccaaagtgctgggattacaggcgtgagccactgcggccagcctattatttatttattaaagcactgtatgagaaagctaaatattgggactaattaaatgtgtggcaaagaagaaactggttatgtaaattgtaatatatccatatagtagaatactatgtagctgcaaaacataactagaaagttctctatggaaatatggaaatattactaagacatattgttaagtgaaaaaagcaagctgtacaatagtgtacatagtgtactatcctttgggtaaaaaaggggaaaacacatactcataatgtttaaatatgcaaaaagcatacatctatgtagaaaaaagaaaattggtcatggtaggttacctgttaaggggaatgggaactgtgtattgagtcaatgcatttttccctcgtattttaatttttttgtttttcttttttgagacagggtctcactctatagcccaggctggagtgcagtggaggaatcacagctcactgcagcctcgacttcccaggtgagaggatcacctgagcctcccgagtagctgggactacaggtgcataccaccacacctggctaatttttgtatttcttgtagagacagggtttcacatgtggtccaggctgccatatttcaattgttgagctatgtgaatatatatatatttttttaatacagaaaatgaaaataaataaataaataacatccttttctggctatgtattgcctgtaggaactttgaaaatgtatttccaaccagcattcccaacttcatgcctggatgttttcccttgtgggcatggagctgcagtcacatctgactcctggagggctaggcgtttttcatccttctgtctgtgtgcaggcttaggtctccctcaatgagccctccccttcctgtttgcctctgcatagcttgcaaaacctagacatgtgcactggggcatccttctgatctacccaggcagagttcctaggctgacttctatgttcacataattccttttatatattcctgccattgcattcattatattaagtcataatggcctgttcacacgtatgctgccttctctagatagaagaaccatgtctggctcatctttccatctttctgtccccatggcctgggatagggcatgaaatagtagtaagggcatttattaactttattcatgagttttgtcataaacagattaataagcatgaagcaatagagtataatatgtcatgtttggaaacagtctttctgtgcttcctgccacagacctcagcagcctgaatcctttacatcatcgtgccttacaaatactctatatgagactggtatgccctaaatcatttgacggtggtagttttcaaacgtcttatttttaatgtgatgagtattcactcaactaatgctactccaaaacaatatttttaaaaaaggaggccaggtgtggtggctcatgcctgtaatcccagcagtttaggaggctaaggctggaagatagcttgaacccaggagtttgagaccagcctgggcaatataatgagacctcatctctacaaaaataaaaagttagccgagcgtgatggcacacacctgtgatcccagctactcgggaggctgagatggaggatcacttaagcccaggaggtcaaggctacagtgagctgagattgtatcactgcgctctagcctgggcaagatcctgtttccaaaaaaagaaaaagaaaaagataggaaaagaaaacaaataaaaccctccatacttaaaccaaaaccataatcagataaagaaaaggaaacagttgtgtagagaattctaatcatttttcttgagtggttttgattgcatcaagctcattagttagattgccattagattacatgtaataaaataatatttaatttagtaaaaaacaaattcatgttatttagacacatgatcattgctctttaaaaaatattgtaacagccgggcacggtggctcatgcctgtaatcccagcactgtgggaggccgaggcgggcagatcacgaggtcaggagattgagaccatcctggctaacacggtgaaacctcgtctctactaaaaaatacaaaaaattagccgggcgtggtggtgggcgcctgtagtcccagctactcgggaggctgaagcaggagaatggcttgaacccgggaggcggagcttgcagtgagccaagatcgaactactgcacttcagcctgggcaacagggcgagactccatctcaaaataaataaataaataaataaaatatatctattgtaacatcaccgggtgcggtggctcacgcctgtaatctcagcactttgagaggctgaggtgggtggatcatctgaggtcaggagttccagaccagcctgaccaacacggtgaaaccctgtttctactaaatacaaaaaattagccaggcataggtatggtggcttatggcggtaatcccagctactagggaggctgagtcaggagaatcgcttgaacctgggaggcgcaggttggagtgagctgagattgtgccattgcactccagcctgggcaacaagagtgaaaatccatctcaaaataaataaataaataaataaaaatatacatgtctatatatataataacatcaagcaaaagtagcagcatatgaattttttataatttaatttttgagcccataaaaacaaaaacgataacaaaactataaataaatatctaaaatatattgaatgcctacatgctaaacagtttactaggtacttcaacattatctgattttatttaagctccttttttttttttttaaaccgagacttgctctgtcacccaggctgaagtgtaatggcacgatcttggctcactgcaacctccgcttctggggttcaagcgattctcctgccttagcctcccgagtacctgggactacaggtgtgtgccaccacgcctggctaatttttgtatttttagtagagatggggtttcaccatgttgaccaggctggtctcaaactcctgacctcaggtgatggccctccttggcctctcaaagtgctgggattacaggtgtgagccaccacgcccggtctatttaagcttcttaatcaactggagtgctaagtagcattaccccattttacagatgaggaaagtgtggtacagacggagtaacttgctccagattacaacacagccaggaagttatggctacgaagtttgaacctaggactgtcctatatactgttctatactttcttccaatatgtgttccaaacacaattttaggagttcatatttaaggagggcatgtataaaatcaacaatgggatatagaaggctaaaaaggaaattaaatttgcttctctatctcttaacaggtgcatgtttaagaaacactgtactcagcagaagtgtaccaggtttccttctgccttcacttaagcacacatgtcggttaaagctaggaaatagctgaaaatctgtattttcaaaacatttcacatccttaaggcttctggactggcatctaattttgcattttgttgaaacattgctagaaaaatcctttggccttcttctcagtgaaaccaaacaaaacccataacgtatgctctttcaacttaaagcatcaatggattcaacaaaaccgttgtatatacagctgtggcaatatttacgcatgtaaagcatcttagttgaataccaaattcaaacaaaatcaatacaaaatggattttacagttaattttaatgggtgtgatgtatcgtttaagagggtgtgatttccgggttcataacatcaagtgatttcagcagttgtctacattatggtgtgttccaaaattaatagtaaggtcagactatagttttagactgaaaatatcaaggccattttctaaattcgggcttgaaatactagaagtggctttgatattactattgaattggcttcaaagactgctaattagaccattgtctttaagaactgccttcttatgcaatgtaatagagttgcttgttctttaagagtaagagttttgtttacattgaaaactttcactagactgccaaaataacaaaaacaaatacacagacattgaaacttatactcttgaaaaacaaaaagaaaagagggaaaataaatcagtgacaagtggcagattatcgtttgcagcttgcctttgatttgtaaatgcctacttcctgccccagggaggagggtgaagggtaggttatggtgcttgggatgcacactgtcttctgggttatgctaatttgttgttaagtgctcaaggccgcttattcagcacagatttgattagtttttggctatacagttcaaagatttatgaaaagttcctctctggatagctgtggttgtatttactttggttctccttattcaaaaactttcatatcgttgatgagtggtgacaaatggcttgctcaggaacactgtgccagtataaactcttttgtaataaaacacaattaatattgatgaaatcagtcttcagtcagcacttgtttgttgcctgaaaacctttcctctcctccccaccttccaggactcaaaaaacagactgggggacaatctcatctgaatcgaacactccaaactggggctgtgacttgcccctggcagatgccacaggtcccagaaaggtgatcagagagctctatccaacacgaggagtcgcttccctctaaggactctcaaaggggagaagcaaggatttataaactggctctgtttgtggctttgccgaaaatgaaactctcagcagtgtgctacaccatgattctagtagaaatgatcattagacactggaaagaggaaagcgggaaggagagcacctactgccttccgtacactgtgttaaggctttctctctagcatctagtttagtctctgcaactgccccaagagaagtctttattttattggctaggacactgaggcaaatagcggctccttgccagacccttccagccactggttggctttctgttgcctagggtcccccttaaactttcttctacactgtgcagaaatagaaaagggcagttggaaaagaggaggagggagagggaaacaaagaggggaaaagataaacttaaaaaaaaaagtaaaaagataaatgtgagagagctctgagatgaggtcaatggttggtcatttgaggtcaactttatctgaggtgagggtaatcacaagatgacaaatggctaacccttggaaatttctttccacacatcttccagtttctgggtcacgtggctccacctctgccatttcaggagggtcctcgtcttaggaagctatttgggaaactctcaatgctcccagagacattactgttttttgtttttttattttttttggaaacaggatcttgctctgtcacccaggctggaatgcagttgcacaatctcggctcaccgcaacctccacctcctggattcaagcgattctcccgctcatcctcctgagtagctgggactacaggcacctgccatcatgcctggctaattttttgtatttttagtagagacagagtttcaccatgttggccatgctgatcttgaactcctgacctcaagtgatgctcctgcttcagcctcccaaagtgctgggattacagttgtgagtcaccgtgcctggttgaaacatttatatttcataggaatattttggctggatgcagaggctaaggcaggaggacagcttgaggccagcagttcaacactaccctgggcaacatagagagaccctgtctctacaaaagaaagaaagaaaaaagaaacgtttagccaaaagtataatgacaagtaaagatacatctgagaagagaacattcgtttgtttagtgtggtgctccagcctccacgtcatttttataaacaggatgtctgggtttctttgcagaaacaagtttcttgagttttgttctcagtttctataatattccatttagtattcctgacacactgccacctaccacgctggtggaaggaaggaaggaactccttctgggagatagctctatcctatctctgtcagttatctgactaacattttgatttccggtagtaaaaatgttgaaactggccaggcatggctgctcacgcctgtaatcccagcactttgggaggccaaggtgggcggatcatgaggtcaggagttggagaccatcctggccaacatggtgaaaccctgtctctattaaaatacaaaaattagctgggtgtggtcatgcgtgcctggaatcccagctattcgggaggctgaggcaggacaattgcttgaaccagggagttggatgttgcagtgagccgagatcacaccactgcactccagcctggcgacagagccagactctgtctcaaaaaaacaaagttggctgggcacggtggctcacgcctggaatcccagcactttgggaggctgaggtgggcggatcatgaggtcaggagatcgagaccatcctggccaacatggtgaaaccccctctctactaaaaatacaaaaattagctgggcatggtggcaggcgcctgtaatcccggctacttgggaggctgaggcaggagaatcgcttgaacccaggaggtggaggttgcagggagccgacaatgtgccgctgcactctagcctggcgatagagcaagactctgcctaaaaaacaaaaacaaacaaacaaacaaaaagttgaaacttcattctcagtttactactggtggtaaatccatcagcatctgtttattaaaggatttaccacagtctaccttgacacgctgagcacatggctttgctctaaaaatagaaagattcagctgggcaaggtggctcatgcctgtaattccagcactttgggaggccaaggcggtcagatcacttgaggccaggagtttgagaccagcctggccaacaaggcgaacccccgtctccactaaaaatacaaaaattaagccgggtgcagtggttcacgcctgtaatcccagcactttgggaggccgagtgcagtggctcacgcctgtaatcccagcactttgggaggccgaggtgggtggatctcttgaggtcaggagttcgagaccagcctggctaacatggtgaaaccctgtctctactataaatacaaaatagccgggcgtggtggcgggcacctgtaatcccagctactcgggaggctgaggcaggagaatcacttgagcccaggaggcggaggttgcagcgagccgagatcacgccactgcgctccagcctgggagacagagcaagactgtctcaaacacaacaacaacaacaacaacaacaaaaaacaaaaagcaaaagttagccgggcgtggtggcgcgcgcctgtagttccagctactcagggggctgaggcacgagaattgcttgaacctgggaggtggaggttgctgtgagccgagatcacaacactgcactccagcctgggcgacagagcgagactctgtatcaaaaaaaaaaaaaaaaagaaaagaaagaaagacacaatgacaaaggcagagttcacctacagagggaatgacatcaatacattaggaatatttttaatacattaaatccctttggggtgtttttggacacctggcttgtcatactatgaacaacagaatttccttaaaaagtttttattttagagacagggtctcgctctgttgaccaggctggagtgcagtggcgcagtcatagctcactgtagcctcaaactcttgagctcaactggtcctgccacttcagactcccaagtagctaggactacaggtgtatgccaccacaaccagctaacttttacaaaatattttttgtagagatgagggggactcgctctgtggctcacggccgtcttgaactttgaatacctggcctcaagctattttcctgcctcgccctcccagagtgctgggattacaggtgtgaaccaccgcacccagccctcatttatttgatttcttcagagaggctcatctgttcctatatttagaaatgtggaacttttccaaagaagacaaccttcatttttttcatacgggctttcaaaagaatgtgatgtccttttggtgttttagattctcacctatgaggtataaacaaatcgccttgcagacaagtctcaacacagaacacatgctgcttatcactggcaaagacttgcatcagcctgccaccacggctggctcatcttgtccctccaggcctgtgcctgctggaacactcccactccccatgtctgaatacaccacttcggttggaccaagagtttccagctcgggtggcccctccttccctggaaataaatagctgcctatagaatatcagagtcattctgactcaggggtgactcagctcttccatgacctgtgttcccacttctccttgataaggccaatgttttggccctactggtgaaaatatgtagacctaacatctatctccctgctccagtttcaagagaaaagaccttattcagagaaatatttagaagactcttgtggaattcttgctgtgagtggtttttccttccctgccattggtgcgactgtttcccccttccgtcaaattgctgtctagatgtttctctctgaccccaattttctcggagtttgggattatcaatctaaaatcagaggtgagaattcatcagtgttatcgataagactttgcaattatttctttcaaactgaactttttccctattcacttatttttcctcattgcaaaataatcaaagcattgatgagtgtttctgtttaaattcaaaggacattccacctttaaccttagcattcatgagacacaaaatgggtttttctttttgctgatttaaaaagctgctatgaagctgcacagtgcggaagagggcacccctgctccagaaaagaagaaacaaaactgcctgccatagacacttggtagggagtggcaaatggaatcttggtttgtttttctcttaggactttgacaattatttttccttgaaaagaataagagaatctacctaaaatattaatactagtttcagagctctaggataatatagagcagagtctcttttttttaaaaaaggaaagcggtttcatttctgacagtggatttcttccactgatgtgcacactctttgacatgaaaagctgcacgaagctgccttgaattcattctgcagatggaaagttgcaagtacggtaattagctaagcagtggcaaggccgaccatctgaggtttgatttctcatcaagagatagtgtccgacacacgtgccactgagcatgcttgtaagagttccacgtttcagatgcactgagaatgcatgcatggaacacacgtccccccagcccaacaaccgcactcccaaattgcccctgcacacatatattctaacacggttacaacacagcatgctcccgagcctcagacaataagctgcccaaaaagatgctcaagcaacagtcgcagtgggcctgacttctggtatccgcagccactccagagaacttcctgtgagccccagggactcagaggaggctgagtgatgaggaaggtggccagaggctgccggactagccccaagcagtcactctgcttcctgcctttgttttccctcaaactctcatctttctggagaaaacaaaaccctgtcctgggggtgtagaccagccatgacacccactaataacctctagcaaaacaatagttttaaaattacttaatgctctcttgactttctgacttttaaaatgaaaattgtattttgtcactgtatccttttgttggcaagtggaatactgcactcaaaccaagcaggcaatgtaaaactatgacttcaaagccattccttgataaaacatcaaaacggcccagagtgaaccaactgttatctgtaattcaacagataattaactgaaactcagtgctcaaattgctactgggagtttctgcagccaaggtcattctcatggtgctgcttgattttgtttctgtgtctcttatatcgttttaggcagggaggaacttggattgtccttcagtaaaattccactttgatgcgcaaagcgaacttgaatttctgcttggcctaccacaggcctgcaacatgcactttctcctcgaggtgagaaggtctttttctctccactctgaaacaccgctgcctgcaccttttgctgagtttagagtagcatcatactttctgccacgaatgccacaaatactgccttttcaacttggttttgtaaaatgtaatggtactaaatccgccaaagggataaagcacccttactttggatttgccagtcccatgggtacataactgacctactactctcccacctcccaaccttgaaactccagccccctgaacggcctcaccactccaacccccactgcaatttcccactccccacctccatgcattgcccattcaccaagccagccacatctccctttaagttgaaaactcacccgaaagcccactacctcttccatgcagcctcccctgattaagtgaggatgaagaaacctccaaagcatggccgacaaactcccaataaacgagaacacacacccccccaaaacaaacacagaaactcacaaaagaagaaaatgacacattctctacttttgatttgtgaaactcctatggggctaaggagatcaattttataccaataaatcatttcagaaaatgaagtcattttaatattcttggggttactcagcaaaacactttgcttggacgtctcttttgtactttccttaaattcttcttccttttcttctcggctttttgaacgtatgactgaagggaactgccactcactgacacggacaacagtaaaggaacttggtcttcactatgcctcatagtggtgggtcacactgcccaggaggaacccgcaatgagaccggcaaatgccttaaccatctcattgtctcatcaggaagaagcttaaatgactcttcttgctcacatacttcctgggcaaacatgtctgctctgttgggataaaggacgctctagaccaggctctgctgaaagatccagggcaaaggttcctgacaagactatgtccagcctcaaataaggccacagaagagcccaggctcgctgacgagcaccggctccgaggcagtcacatcaggagacagaaacagacatgttggtgctgccctctcaggtcagtgcaaatgccacttgaggagggctgagagctttgcagcataaaatgaccagaacaaggagaaacacagatgcaatggcaatagctggcaattcgcacatggcgtcaaacaccactgccacagaagctttttagctacaagccacgctatgcaacctttaagcaaaacattattgattttgtggttgtaaaaacataccttcaactgcagaactcagttttatgacaccttgaataaaaacaaaaagtggcagttatataatggacccaaatcgccttttccaggcttctcataacacacgcatgcttcagatttggatttttctttttctgctggcattgcaagaacgtaactaaacaaatatcaacttcaaaaataaaataatttttagtcttaactaggtctcatggatgtcttcttttcccccactaaaaccatttggggaaatttttcactaaaaatgggatcaaacatgtttttggatgggacaaaggccaagtctgcctgagtgactatttctgtgtataaattataccagattatggatcaataaaagttcacacaataggatgctagggaccagcacttcctctttgatactgtatctagagatcatctgatgcatgttaggacagagtttctgttgaaacatgtaacaggtggttaaaaaccatggtgtgatctggtaactttcttctctggggtggttgggccagagcccttttcttggtctgatgggtttagatttcagctccctcaagtcagagagtgaacgggttatctgagcaagtcaagttgttcatgaagcaagtcagtacccttgactgatatttatgcacctttgcagtgaattttttttttttttgagacagagtctcgctctgtcacccaggctggagtgcagtggcgcaatctcggatcttggatctcggctcactgcaacctctgcctcctgggtggacgccattctcctgcctcagcctcccgagtggctgggactacaggcgcccgccagcacgcccggctaattttttgtatttttagtagaaacatggtttcactgtattagtcaggatggtctcgatctcctgaccttgtgatccgcccgcctcagcctcccaaagtgctgggattacaggcgtgagccaccacatttggcttttcggtgaatttaaaggtgaaaataccaaactaagataaattagacctgataacaatcatttgatttaaagagcactttttataagtcatagttaaaaataaataatattatctaatcttacgcaatagtcatgatcatttaggctgaacaaaaatgtctgcagtttcattcggttgaagtcctggttctctttcaaactggaggagtttgcaaacaaaattcttttcaatactggtaaatcaaattggtatctgtatgaacatacactgatttttaacagattatgttcacattgctcttccttatgactttctggaaaagctgcttttaagtttgtttcctattgaatttcatctttcctgcataaccaatggtgtctggtccaacgttgagtaagaaacactataggggaggaagtatgcatatacatgtccatatgtttattataaattttgctgatacgaaagatatgtggcacacagtctataagtaacaatgaaatatacagtattctttatggcaaattccatatagtgaattggttcccatggaattctttttttttttttttttgagacggagtcttgctctgttgcccaggctggagtgcagtggcgcgatctcggctcactgcaagctccgcctcccgggttcacgccattctcctgcctcagcctcccgaatagctggtactacaggcgcccgccaccgcacccggctaattttttttgtatttttagtagagacggggtttcaccgtgttagccaggatggtctcgatctcctgacctcgtgatccgcccgcctcggcctcccaaagtgctgggattacaggcttgagccaccgcgcccggctcccatggaattcttttgttcatcttggccaaactcttgtatctgtagccagcagttcaaccatgatcagacaatcattcattcagttgcatctcagtttgcccttttcccaacaaacttactattattatatcttttatgtgatataagttatttttattaaataagcctctttcagcttcaatactatgtcagtacccataccatggcatatttgtcactgtacataaagttgggcagagatgtgcagtgatcacaccagcatgtagtatttccaccatacgggtatggtagaatgtaacctcaagagcatggatagaaacatgactaggaaatgatgagttttaaatgtttataacttttgtttttgatataatttatctaattgtaagttacacaatttaatttgtaataatgggcttccaaaatgtctgaaactgtaacgtctggctcttgcaagctggtatgaacccgctttagggcaccactgccataactgatgcttccttgtgtcaggcccagggaagaccttgaacttcagaatacttcctgagatcttcataaagggggtaatcatttaattgaacaagacaaatggaagtaaacttaggatttgctattattttttgccagttatttcaaaacctgtgaagcctttcattgcaaaaataaactatacatacatcaccttagagataacagtcattgacaatcaactagtataatcacaatataaatggatttgacattcttttggtcaggcaactaaaccaaaacgcaaggtcaggtacaagtaattgacttattaagcaatgacctcatcttttcagagtagaattcttatatacatcagaatatcaagtttttcagccatattcatttttgagtataatcatggtgtcagcaaatgtcattcaactgaaaagacaacaatgtgctctgatcagtatgtagaaacagagttcatgcaagaaaacaagaaaatttaaacaaatcatcagggaagacaggggtggcagtgaaggagagcccaatcatcatttactgagttggggaaacaaggtaagctcaaatacaaacaaaaattagatctgtaattatcaacattgttttaagaaaaacgtgtgattcactagctccaaatagacttctcttatatttttaaaccccaagtcaaattattctgtatagtaaggtaggcctttatattgggaagtaactatgttacagtgaaaatttagaattagctatatctagttagataccttatattaacatgatacacaaaattgtacaacgagtgggaaagatcatttatcttaaaatgtaaatgtttttaaaaattttgaatatttaagaagggattgatgttgatattaaaaagctacacatagcactgctgacttccaggacacacaatagacattatctggtgtgtggctgacattgacattgcctggaattcagggtaagccgtaacacatacatttatacacacacacacacacacacacacacacacacacacacacggatgctaccaccccccgccgcccccacccccggtttctttttcatagtctgcagaagtgtttgaaaatacaattgaaaacaacaacaaaaaacaaactcaactgtttttctctcagctcaatatctttttttttttttcttattttttgagacagaatctccctctgtcgcccaggctggagtgcagtggtgcaatctcggctcactgcaacctccgcctcccagcttcaagcgattctcctacctcagcgtcccgagtagctgggactacaggcacgcctgaccacacccagctaagtttcgtatttttagtagagacagggtttcaccatgttggccaggatggtcttgatctcttgacctcatgatccgcctgcctcggcctcccaaagtgctgggattacacgcatgagccaccgcgcccggcctatttccctatttcttctacttcatctcacatgacttttccccttattccggacccattagccacatggtttctttctgtgctttgcaatgctatttcctttctgcccttggctggtgtacttgcggctcgctccctcttgcctgctgccctaaactgcccaatcttcctataaccagctcttttcttttgttcacatttgacttcaaatataacttcctcagagagtcttccttgattactatatttagagcaggccagaaataactctatcccattgctcttatttatttatttgtttacttaatttttattttttaaaaggattgggggtgggggtctcactttgttggccagcctggccttgaacttctgatttcaagcaatcctccagcctcagactcccaagtagcagggactacaggtacctgtcaccacaactggctttcttttattttttaaaaatagcacttttcactgtttgcagttatctcattgatttcacatctgcgtccttgtttacctctgtcctcctcattagaatataatcagaaggagagcaggaacctggtctgttttgtttgctgctgtaactcctctgcccagaaatttgtagcatagagcaaacacacaaaaaatatttactgaatgaaaaggtgatcattcccgagtatcctcaaggaggatcttatcaatcccagcaaatgtacttcaaatacgttatttcaattatggatgttattgagctgagtactgagatttcattatattgaccactgtctatttctactcagaggctgttctttatagggagttagtcaaaatctatgtgcagagtgaatacatataacttgcagtaaatatttaggtgttttagggttccaatattggcaaggtatctgacaagtaagtttattggctacttggagacaaaattacgccctaaatggacttcaagaaatattagttaactaactttatattcaaatacctcaataatctgcagttctcttgtctcaactgtcatcaccctgggccaaattatgacagcaatgttcacaggaaactgtatgataaggcacaatagagaaagaggaactaaaaaagaacttcagcctttaatatcctttttctaagttattcccatgctgcaggtggagagactttttcaaaagatcatgtgacagccttccaactcttattttattcatttattttttagatgaagtttcactatgtttcttaggctggtctcaaactgctgtgctcaagtgatcctcctgcctcagacttccaagtagctgagattatcggcatgtaccagagtgcccagtgaaattcttaagacaaaaagccttaacatgactgcaaaaccctctatgatgtcacttataggtgaataaaaatggccacaaattcttccacactcctcccacagacaggtggaggctatgtctcctctccttgaatctgggtaagctctgtggctgctttgaccattagaatacagaggaaatgatgctgtctgcccagatctcatgaaacaggcagcttcccctctggtgtcatggaccactccctccgggaagcctgagacagcaggttacaagtcctgagacggtcctgatggaaaggccacatgcagacactcataaacatcagctgagcctaagtgtcaagtttaggcagagggaagaagctgtaaggtctttttttttttttttttttttttgagacagagtttcactttgttgcccaggctggagtgcagtggcacggccttggctcactgcaacctccgcctcctgggttcaagcaattctcatgcctcagcctcccacgtagctgggattacaggcgcctgccaccatgcctggatgatttttttttttgtattttagcagagatggggtttcaccatgttgctcaggctggtctcgaactcctgagctcaggcaatccgctcatcttggcctcccaaagtgctaggattacaggagttagccactgctcccggccagctgtaaggtcttgagaagactgctggtgaaggctgggaggactgaaaattgtcactggagcctggagaaaaggtaactctattaatgtagtggcagagaatttgctaacattatcacttgtagtaatgtggaaaatagaaaatatacccaaggaacccacggattttagtaagaaaacttctaggcagaatgcttaaagtgccatttaaaaatttaaaaaaaaaattttttttaaagctacacacagtaaaaggtgcaggtagagaaagatgagtcaaaaaagaactgttcagttttcaaacaaaatttggagacaataaagagctagaatgtgttgagtaaaaacaaaacaaaacaaaacaaaaattgttttaacactcctagggggtggctgtaaaataccttttaatgactgtagaaatatttaaggatgtacctcatagagtttccaaaatagacaaaaaggcttttaagaatcctaagggtattgtcccacagcacccaactctgagcccagaccaaaaaagggactatcttgaagagaattgtaggtatgtgtttcatttaacagaaagaaacccagtaagattcaaaggatgcccacaaagattatgagagaagtgtattagtggacacataatcagcttggacaaagcaggcagaggtaaagtgcaaagagtccttagagcccccagacttttatgggtgagacataagctgagaagattattcagctgaaagtgctatttcttatggaaaggggacaactcagaaggtgcaacaagagtctggagggtggatccaagagccgcagagaatcattccagagagcaggactcggccctccagccaaggaactggcagcatgtggatttcagacttgctatggtaatgcctggcgtatagctgtttatccactctttgagtgggaatatcccaagcacttatcccatccctgtattatcagtatacgttggacatatatgaggcaaatacctttttcatattgagaggtcttcatattgagagaaattgtataagacaacagcatcaaatgggccccatcagcaactgaaccttatttagatggtaagaacctgaatctcggctgggtgccgtggctcacgcctgtaatcccagcactttgggaggccaagatgggtggatattctgaggtcaggagttcgagatcagcctgaccaacatggtgaaaccccgtctctactaaaaatacaaaattagccgggtgtggtggtgcatgcctgtaatcccagctacttgggaggctgaggaaggagaaatgcttgaatctgggaggtggaggttgtagtgagccgagatcatgccattgtacttcagcctgggcaaggagagcaagactccccctaaaaaaaaaaagaacctgaatctcaaacttgagcttgagataaggtttttgaagtctttagaaggggtgagtatattttgccttacagaagatgtgaataatttgtgtccagaggctgaagcatggatgactaacgatgaccacagattatttgaaactcttcctattgagaagtggcatcttcgttattccctttggtctgagtgggcttgtggactgctttggccgtcaccaagaatatgaaggaaaagatgctctgccagtatctgggctcagaccttaagaccttaagatttcctatctcttgtataggaactgtctctggaagccctgaactgacatgtaaggagtcttgaagccgcaaggctggaggtgccaattacaggtgctctagtcaacagttaccatattgctactgatcaggagcccacactcccagccattgaaatgaaggtgccaggcatgtgaataatgctgtcttggactctcaagaccagcccaactgtgatggttagtttgtgtgtcaacttgactgggccatgaggtgcccagagatttgaacaaacattatttcgagtgtgtgtgaaggtgtttctggatgagattaacatttggatcagttcattgagtacagcagacttcccttcctaaggtgggtgggtcttgtccaatgagttgaagtcctgaatagaacaaaaagacaaagtaagagagaattctctgtctctgctgggacatcagtcttctcttccctttggacttcgacttgaactggaacttacacaattgttctccatgttctcaggtctttggacccagattggaactataccattggctctcctgggtttcaagcttgcttgctgactgcagatcttgggacttctcagcctccataattatgggtcagtatacacacacacacacacacacacacacacacacacccacacacacacacacacacggatatactacttctctggagaactctgactaatacaccaacttctagctgaatgtggaacagaagaattgcccagctgaaccctgcctaaattcctgattcaaaatcataaggtataatataatgattgtttttcagctgctccacattggggtaataaggtatgtagcaacagatgacagacatagtcagctgtgcatacattttctgactacacatgtgccctgtcccttagctcttggtactccagccacatcaccctttcagttctactaatattgaatgcagaattagcacgtgccatccctcacccttcttgatcctttgactcttagctaatgaggattttctcagggaagttctccctgagcctctagattagtccctttgttacaatagatcctcccacaagaactgtctctttctttcagcgcagttatctctgtgattatttgattgacgctagtctctacccctagatggtaaactccatgagaacaaagggtaagactgcttttgatcaccagtgaattccccgagttcagcaccatgtctggacatagtaagtgcagaataaatatttgttaagaaggtgaatgaaatatttgaagcagctgataaagactcccttctcaccatagcttttaataaccatgtcaatattcttttctttgcaccttgtgaaaatctgggttctcagccattgtaactgggaaagactgtgacttaatatgaggccactggtcctactatgctattgtctgtgacggcagctaagcacaactgaagttgctggagttcctttttgtaaccgctggggaagaggaagcacaagagagcctctgggtgtgtgggcgcaggaatgcatagagaaaaaagtaattagtgcctgttcacatttatgtctttagttggaaattagggagctctcctaaaagtctaaagaaaatcgtggatgctcaaactgtttaaaatgtttctaaatttaagtttagaaacaatttgttactagatcaggagctcttccccctccccccaaccccttcctctaaaaatggaagaaataattgctgcttccttagtgctgttaggaaaattctgtaccttccataaccattgctctcagtattattttcttaatacctaatctgaattcctactgttttaaaatgcattcccctacttagctctacggatatggaaaatacatgctccgctgggaatagtctttcttaaaatatatctgctctgcttaaagattagtttatcatttttgccacatataaaataagctcaggtctctacaagtgcccttgtaatttccatttcataaatttaaaaaatattttgttttacctcgttatatttctaatagtgacctccaaatgggtctgtgtacgatatttcattaaatgggtttagtaggcttccaaagggagaaaagaggatttccatttctgcataatattcttgctcttttaagaagaaaacacctctacagtggcagggctaatatgtcgacaggcatattccgtatcatttatgtaagttaacacattctgaggctctgcccatttccacttctctgatttgtcctccctccctgagtgcacaatactgcatttgtcccttttgaacatgtaacagattaaagagctgggcaggaggcagatgtaggggcacctttgatctctcatccttggaggttaagggagggcagacacctggcggctgccgagctggaaacaaaacacaggcccagactggaattaccttaaagggagcccggctccaaccgcagaggcagctggaagcgctgaatgggcaccgggggaagagagccccgcggtcaggcagaggacgcaacagagtcctaacaatgtgatccaggctacccgagagctggttagaataatccttcctacgcagaaagacccaggaaaccttccaggaaagactaggcagccgcattgagaaaaaacgaaaagtaaatcttttgcaaataatatcacaaaacttccagctgtgcacaaatactgaagggcaattttgatgacaatgcaggaagctttcaaagaaaggatttttaaacatattttttccttggcggaactctttttagtaaggatttccacctttgccccaggatcctgccaatgttcttagtcaaagccagacccgagtttcctaggattcttcggtgaaactgcattgccccctggcgtttgtgtgctgtcattacgccgcacagataaagcccatggaacacctaccaatccgaggaaggatgcagctcctggtttcatctacatggagaaacctctcttaaaacacaggatcagagaatgcagttctaaatggcaaatctagacttggtttgacaagacatggaatgaaactttgaaattaaaactccttccttttccatccttagcagaatctcctgagatgttcaagtagctctggaaagaaactgatcagattctaatctgtcaatttaaaaagtttttttttaaacaatttttaaatttgttttagagatagggtcttgctgtgtcattcaagctgcagtgcagtggtgcaatcatagctcactgcaatcttgaactcctaggctcaagggagcctcctgcctcagcctccgtagtagctgcaactacaggcgcccaccactacaccctgctaattttcttatttttaaatttttttgttttgttttagagatgaggtctcactgtgttgtccaggctggtactcctgacctcaagtgatcctcctgctttggcttcccaaagctctgggattacaggcctgagccactgtgcccggttgctaatttgtcaatttttttttttttgggagtcagggtctcactctgttgcccaggctggagtgcagtggtgcatctcagctcactgcaacctccacctcccagactcaagcgattctcttgcctcagccttctgagtagctgagattacagacatgcgccaccaccacccagcttatttttgtacttttagtagaggcggggttttaccatgttggccaggctggtctcaaactcctgacctcgaacgatccacctgcctcggcctcacagtcaacaaatattgactgtgctgcttaccatccatgtgaacttggaaaaccctcttaacctttctttgtctcctccacttacaaaatgaggctgataatagtagcatataccatctagtacctagtaaacaccctttaagtgtttgtgaatgatgagaactatgtgagttttccactccggtggactagggaagattaaaaaacattctgtgatgttgaaagggcttggacttggttcctggccaagtctattaaaaccccaaaacacaaagaaatgctccaggtactgcggtttctacctggcctcagtgcaaacctagaattaagtacatctctgacacttccaggtcggtgtgactggacctctgagaatatgctggggcctgagagggtccattcttgtccacaccagggcagagttccacccccaaggctaggccagagccggaatgactccaggagtaaggccaagggtggtcttccttggcccaggttcctctagaatatgccactgtggcataaaaatgattttgagctgaaggcatttgataagaggcttatttctaaactccttatctgccccaaagcagaacctcctcccaaaactcaattgtcataaatcccttcccacagatttttctgcaaccagagaaagttgactctaataccaaagagaagcccacagcacacctaaacaggcattgtcacaaaactatcatctcccatctattctcctaaaggcccatgatctttcttaaaagtaatttatttttccttaagtgcccttctcctcctccccttctcttgttcagatggcacataagccccaaattgtaagtgcccccttgaggcatattttcctgagaactcccatacataatgaacagaagcctgtcttttcttttgcagcccccaaaacactgaacttaagagggtaaaggaacagtttttccttccttcgtttcttctttccttccttccatgttttctagagacagggtctcacactgtcatccaggctggagtgcagtggtgtgatcatagctcactgcagcctcaaagtcctgagctcaagtgatcctcccccctcagcctccaagtagctaggactacaggcacatgccaccacacccagctaatttttttaatttgcaaatttttgtagagatgggggtctcactgtgttgcccaggctggggaaaagtttttcatcttccgtaccttcttctgtgcctttggcaaaatactggactccactgtgcaaaaaaaaatctctgctcaggccttcaaaacaagcttcacatcttgtgccaagctatcctcagtcgaagcagtggtggcaaatagacgcaccataaatgagaaatagaatgcttggcccagtgcactggctcacgcatggaatcccagcactttgggaggccgaggcaggcagatcacctaaggccaggagttcgaggccatcctgggcaacatggtgaaaccccgtctctactaaaaatacaaaaattagctgggtgaggtggcaggtgctacttgggaggttgaggtaggagatcgtttgaacctgggaggcggagcttgcaatgagccgagatcgcgccactgcactccggcctgggcgaccgagtaagactctgtctcaaaataaataaataaataaattaaaaagcaatagaatgatctacataatatttgacatgttaatattcgtacagcatctttgaacaaaggctgacaaatacaagtgataagtgtttgttaaatgaaaataaatgttgtacaatttcagtctttaagaaagacaacgcagactggtattagggttccagaccttccagatgtttttcttattttgcactgcatctttaaaatcttgcgtattattgataaggagtgctgggaagggaagagcgtgatgcctttaaatgatacggaagaggggaagggaagtgctgggtagaggagggcgtggtccctggctagggctctacccccacggacctaggcgaggacaggcactcctgccttcctgcccaaatgttgcattttccaagaccaccttggcccaccacacccccaacctgggcctataaaaattcgagaccctagtaaggaaagagacacaagcggctggacgtgttgggaaacacatcggcagaagaagacacgagtggttatgtgtctggtcattagagagcatgtctgcggaagagcacatcgatagactcccgcacatggatcgatgccatcgacccgcgacctgcggaatgagggagagttggtccggggcagtcagaggagagccgggcagcgggtggcccaactctaggggaaggccatcttccttctggcttcctcaatggctgagaactacttctactcagtaaaactttccactcattatccaagcccccatgtgatccagttcttccggtgcaccaaggcaagaacccggatacagaaagtcctctgtccttgtgatgaggaagcggatctaagtgaactaacacaagctgcctatagggctaaactaaaagaacaccctgcgacacacgaccactggggcttcagctgtaaacattcacccctagacactgccgtggggtgggagccctacagcctgcctgtttgtatgctcccctagaggtatgcgtagtgaggcactgaagaagtgagccacatagggtgtgcgatgggaacaagggaacctttcccatttcattataacgataggaaaagagtatattgttttacaacaaaacaaaacaaaacaaacccctaaaaattgtattgctggagtaagacgatcgaagtgagatcgttttaactaccgtcttttgaagtgtaagtgtgtgcaaagcatattcagacttaatacaaaatggaacagtggatgactagagagataaatggtgccaatagctactaacaatcatgcaaaattatacatcctgtgggagactggaaacatatattcattttcaagagaagaggttagaaaatggagacctctgatgcgatttcaaaagacgtgcaatcaccaatgaacactttttgacttcctgggaatttctctgcattacaagcaaatctggcaactgataacttcctggacagctgtctctcccatttattcccccaattcttttttggtaattgtcagctaaatctttacatgagtgtaatctctaccctgcagaaagaaattcatcttagaagttttcattttcatttggcaaaggatttggaagaatggtgattattctctaagcctaaagtgaaaattcaagggtttgttttctacagatgcaatcaagcataatattgtggtatctttatgagaaatttctaattaatgtctagttcagtgtgcttaaatgtaagtcacaattctgattatacctgcttgtattaaccatatcctgaaattaatgtttgctgtcatttaagcaaaacctgctttctttggttggcaaatcatctaacattaactgtcccataactaagcacactgagatcaaggtcaatctgttagttttattttagtttaccttattaagaatatcagaaaagtttagcttgcttggcccttgattgaaactgcttaataatctcccactgctcttcgcaaaactgtcaaaatccttaatgtggcttacaacgttctgggctacctgagccagtattacttctagttttgtcttggatcactcccatcccttctttctttttcccaccttccctcccctcccctccatctctgtgttccagtcactctagccttcttttaattactcaaaattttatattcattcctgcttctggcctttgctctttgctgctttttttttttttttccacctggaattcaagtcagacttccttgaggaagaagcagtttattttctttgatcacacagctcatggttgcctaggatcataacacccctatctctctctctctttacagtacttgtagcaactgtaaacattttatgtataaacactacaagaaaaaaagctctcagattatttgcttttgaagtcagagcagaggctgggtcagtgttattgctgtatcctcaggagcagcctggtgcctggcacacgttaggtgctccataaatgcttgttaaataagggaagggattcgtagttccacctgactcttaaattggcaatgcatgttttcctgcttcatggctgcacttgagcagaaatgtcaaccatgccacaagaggttgattatttaagactaagatggagccagttgttttcataaaggttgaaaacagattttgcatttgtattccttaagtacttttgaaacagatatattctcccacacatactcattcacaaataatgggagtatgatctttaagagaacctaagcaaatatagtcttgatgaagtaattccattttaaataatctattttaaggaaatagtcatagattattttacccctgccctcatgtagtttattctcagcagagcaggaataataatttcttaaaagccaggatcatgcacccccttgggcaaaacctggaaatgatcatatttcactcagagtagaagccaaatccttccaattgccaacagagtcctgcataattcatgttatttgtatatttcgtgtttttttctttacaattttctgcaatgagatatttgttcaggaaaaacaaaagcattattaaaaaggaaagagggacattcagaaagcagatttgaaaagttaatattctgtttttttaatcattgaaaataagttatgaagatgggatttcttttagaagtttttttcaatgggagaaaatgtgattattactaatcattcaactgctgattagacacacacacacacacacacacacacacacacacacacagaggcaagaatttgctctttggcttctacttatctatttcttgaaagttaacaagagcagggaacggtggttcacgcctgcaatcccagcactttgggaggctgaggagggcggatcacctgaggtcaggagttcgagaccagcctgggcaatatggagaaacgtcatctctactaaaaatacaaaatcagctgggtgtggtggcacatgcctgtaatcccaggtactctggaggctgaggctggagaatcgcttgaacctgggaggcagaggttgcggtgagccaagatctcgccattgcactccagcctgggcaacaagagcaaaactctatctcaaaaaaaaaaaaaaaaaaaaaaaaaaaaaaaagttaatgagaaacaggtagataaacccaggagtgtttaagacttttagagactactcacaactaagttctagttcttactttgtattcctcttaaagttatcgtgttctccctaatcttgttgtatcagtttcaaccattcatcaatagtggtggcgagcacatgtccggcatcaaggcagactagctggcaagaaccaagctagtctgcctcctcctttcactgtagttctactttctccctggccacctcccctggtggattcctacacctgttctttcctctccatccccagtgccatgcctggggcaagtccttatctcctcttgcctgttgtattccaactggtttttgtgtcttcagtcttttgcctctttaatttattctacattaaagtgaatgatactctaagacaccgattacttcctactggcaaaaggataaagttcaaggtctatcttagtctagattcaactctgtcttccgtggttccccaggccctattctttggcttcgctcttttacttcacatgccttgtacttacttgcctccacacctctgtgcgtgcctggggagcccctccccagtttcttttcacattcagggctcaattcactgtctttgatagtgatgcctccctggtcctcctgcggcacaaacctatccctctactgcattcttttaacactttgcatatctctattatggcccttactggatggcattgtaattgttcatattcctgttgccctcagcgacctgtctggtttactaaagcattgctcccattggttatcgtgtactgtcactctttagaagcactaattgatagaaagccatggttgataggatactcatagcagagagctattctagtaaacagctattttaataactattgttagcacacaattgctgctgtgaatgagaggaggatgattgcaactcttttttttggatggagtctcactcttcgcccaggctggagtgcagtggcatgaactcggctcactgcaaccttcgactcctgggttcaagctattctcctgcctcagcttcccgagcagctgggactacaggcatgcgccaccatgcccagctaattttttatttttagtagagacggggtttcaccatgttggccacgctggtctcaaactcctgacctcaggtgatcagcctgcctcggcctcccaaagtgctgggattacaggagtgagccactgtacccagccttttttttttcttttgagagggagtctcactctgttgcccaggctggagtgcagtggtgcgatctcagctcactgcgacctccgcctcctgggttcaagcgattctcctgcctcagcttcccgagtagctgggattacaggcacccaccaccacacccagctaatttttatactttagcagagacagggtttcaccatgttggccaggctggtcttgaacttctgaccctaagttatccacctgccttggcctcccaaagtgctgggaggacaagagtgagccaccatgcctggccgattgctactcttaaaactgctgccattgccaggcatggtggcgcatgcctgtaatcccagcactttgggaagcagaggtgggaggatctcttgaggccaggagtttgagaacagcctgggcaacagagtgagatcttgtctctataatattaaaatatatatatatatatgtatattttaaaaaatgctgccatggccaagtgtggtggctcatgcctataattccagcactttgggaggctgcggtgagacaatcatttgaggccaggagtttgagactagcctgcacaacaaaatgagctcctatctctacaaaaaaataaaaaaatcagctgggcgcactggtgcatacttgtgatcccagctactcatgaggctgaggtgggaggatcacttgagcccaggagttcaaggctgcagctagccatgattgtgccatggcacttcagcctgggtgacagagcaagaccctatctgtaataaataataataataaaaacctgccaccaccactaccacctttaccaccccactacctctactataatcacttccacccctactatcaccaccccactgtcatcacctataccacgtccaactctactcttctcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcattagcataggcagagcactgccaagtaccacgcagtgggttagctggtttttttttgagatggagtctcactttgtcacccagggtggagtgcagtggtgcgatctcggctcgctgcaatctttgcctcctggttcaagcgattatcctgcctcagcctcccaagtagctgggattacagacatgctccaccacgcctggctaagttttgtgtttttagtagagacgggatttcactatgttggttgtccagagtggtcttgaacccctgacctcaggtaatccgccggcctcagcctcccaaagtgctaggattacaggtgtgctccaccgtacccagccagggttagctgttctatatgcattgtctcattccatctctacaacacgattaaatatgagaaaactgacactcagatccagcaacatctgtttgatggcacagctttgggtggaagtgtttggattctaacttggggccctctggcctcagagtctgaattttcgtctccaaagatctgttgctaataagctactgcagtggtaccctacagttttgtttcccgcattcctatcacctttgctcacttcatccactccagcggcctcatcctccagctgactcatccatgccacccatccccacctccatctgacccactccataatgtgccctctaacagggctttccattaaggcctttgcagtggtgtgctggtaaatgtttaacaacaggctctctgaagaggggcagaggggatttctcctttgtagcatttgctgttttccatggtgtaaatactgccacatgacttttttttgtaccaaccaacttgatgtcaaccagctgaaaaaattattaaaactttcatagtcagctctcatgagccaatattgatacaggagttaagaagaaattacttaggcagatagtgagggtacggaagtccttggtaatgttttcctttgaatgaaaagcagccccagactatttgttttccttttaatgaaaagcagccccaaactattttcctttctaacaaacagcagcctgtaagatcaagctgcagacatagatgccggcagttgtgccaatcatgttcaaaatggcagtcccatctttcctctgccagccgcgtgtacagcaaggagcagacaagatggcgcagcccaaggagaaagtttatttgcgtaataagattagggtggggcaaccagccttccctgctcgctatgtaaatgtcacacttaattgaaccaatctgtgagcattatgtaaatcagacaccgcctcctcaaacctgactataaaatctggcacatccaccactggcaggtcctctcggaagacccttctctcactagagagagctgttttcctttctttttcttcctccttcttttgcctgttaaacttccgctcctaaactcctcatgagtgtccatgtcctaaattttcctgccgcgagatgacaaaccctgggtatttactccagacaatgtagcagcttcagtataagctggcttcaaggtcctacaaaaaccccttttacaatgagcaacttccttctttcacacctctgccttaagggaaccaaggatttttccttggtaataccattaccctcaagaccttgccaatttgaggctacttctcctgttttttttttttagaagaaattgtgaggtcagtatacacaaacaaacaaacattaaccaattaattagaaaaagtactcttctaattaatttaaagcattttcatggtttaaaatcccaaattcaacagggtagtcactgaaaactctctctcctatctgcgtttccaatcaccagatttctctccctgaatgcaatcaatgttctcagttttcatgtgtattgacatactttttctttccccttgccctttatggatgcattttctgttgccaccaccctttaaactcttattttgaggctaattccactcatacagttttctctattatctactaacttccaggatattcctggaatatcttctgtagcgacttcagcccgtttcattgggctttctatcccatcctctgagatttcaacattcatgtttatggtctcacaaatttccccagcttcaagactctttatctccagttcctcaaccaccagttgaggaattgaaccaccagttccatttctaaattatggaagagtcaagaactcctttgataactatccctttatcctacaccgtaatcactccttcacgtccactgaatctgccatagggccatttgtgaacactagcctggctccattttgccccagtgaatcagctctctactggtttcatttattgtcttaacctgacccacaccctcaaaactagccattccaacaagagaattctctgtcctcttccctaccagttatatccattctaaaattactcattacctgtactgtatattcctgcagcagttctgaagacatttttgtgcttaaaagccttcagcggctttctaggaatttaatccagaattctcagctaaatagacagagatccatgtttctagcgtgcctatgaccatccacttcagggatccagtgctcagccacatccagctacttgctctctttttcttttttcttttttttatttgaaacggagtctcactctgtcgcccaggctggagtgcaatagcacgatcttggctcactgcaacctctgtctcccgggttgaagcaattctcctgtctcagcctcccaagtagctggaactacaggtgcttgccaccatgcccggctaatttttgtatttttagtagagatgaggtttcaccatgttggccaggctggtctcgaactcctgacctcaagtgatctgcctgcctcagcctcccaaagtgctgggattacaggcgtgagccactgtgcccggtgggtttttttttttttttttttgagatggagtctagctctgtcgcccaggctggagtgcaatggtgcaatcttggctcactgcaacctccatttcccaggttcaagcgattctcctgcctcagcctcccgagtagctgggaagacaggtgtgtgctaccatacctggctaatttttgtatttttagtagagacagggtttcaccatgttggccaggctggtcttgaactcctgacctccagtgatctgcctgccttagcctcccaaagtgttgggattacaggcgtgtgccagtgtgcccagcctacttgctcttgttttaacataccttggcctttcccacctccaggtcatttgtttgatgattccttctgcttggaattatctctctatctctgcctattgaattcccatagattctttaagacccagctcaaatcacatctccttcacgttttctctcatttccccatctctcctttaccgttgtgtttgcttacttattttataaagcaaagcatgttctgcttaatatgatcgttgtttttgtgtcttatcttcctaataggctgaacttcttgaggatgcttgtatttgttcttagagtccccattacattaaataattgctttatggctttggataaaatacatttacaatttcttttccaagaacgaacaaggatcagaaagcaaaatagggcaaaataaacattacaatgttctgataggttattataccacacaacttaattctcaaattttatagaaatgcagaataggatttttccctcccctagttattacagaaattattcttttctacccaaatataaaacaaagctccagtaaaagaaggtgtgaacacttgtttctgctatgcatcgcaatacatgggatgtttatatggcaaatgcatgtgtgggatgtgtcctgcatttatatatgttggggggaaattcttagctcacagaggatagtgaatgaagaggaacagctataactatcactggttcttcttcttcttctttttaaaaaaccagttaattaattatttttagagactggatcttgttatgttgcccaggctgagctcacactcctgggctcaagcaatcttcctgccttagcctcccaagtagctgggattacaggcgcatgccactgtgcctggctgtgttcttgatcaacaaggcccccgtgtctttgcagcaaatattggtttctcattttccctccccaccccctactcccacccccatggattttttatcttttcagaaaagctcttgttgacctccattctcttataattattccttaattctgtactagttggttttccaacataaaaaacagtgaagtctctgtaattatgaaactacttgtgtgacatgacactacttgtcagcattctttctgttgcgagaatgaatagcaactttgacttcccaaaaaacacagctctagcttgaatacactgaacatgtgtagccgcgccaagaatgactaagtacagactaccagcaatgagcacttgatgatcacctgcagttttcatcatccccttctgttcagccaccccagtggcctacctcttatgggtcactgcaacacacaggcagcaggcaatagagagtatatgggctactagatagggccgatgagctccgtggtagtttggctctaagaaagacaacaggccaggcacaagtggctcacacctataatcccagcactttgggaggctgaggtgggaggattgttgagcccaggagtttgagaccagactgggcaatgtagtgagaccgtgttgctaaagaaaagaaagaaagacaacaaagggacatgaagtatcattatggttttctttttcttttctttctttctttctttcttttttttttttaaatagagatgggttcttgctatgttgttcaggctggtcttgaactcctggactcaaatggtcttcccacttcagcctcccaaagtgttgggattacagacgtgagccaccatgcccagccatgggtttcttactaggtggtggagctatttcccacgagaatagcatgaaatgtgaaccatttctcaagagaatagcatggccattcttcaccaggggtcttggtcgaggttgtagaatctgtgtggccctcctctctctaacggttggcaaaatggtgataggccagtaggtgacaggacagcctggctggacatctccatctgtcatctctgttatggttgggacctcagaagggagcgaaacaaaaccaaaagtcattccaaattgcttagggttaattgaaggaagccacaggaagagcagctatgaactctgtcctcagggcatccacagagtgtggggacctggagaaggagcagtggcagccacaggcctgagggcagaaggaaggggtacaggtgagtacagtgatcacagagtctcagctttctgagaaagtcatgattttacctaatctattctgttgtcagacatgttctgttctttaaccctcaatgcttagccattgaaaatttggaggccgggcgtgctggctcacgcctgtaatcccagcactttgggaggctgaggtgggcagatcatggagtcaggagatcaagaccatcctggctaacatggtgaaacccctgtctctactaaaaatacaaaaaaattagctgggcgtgatggcgggcacctgtagtcccagctacttgggaggctgaggcaggagaatggcgtgaacccgggaggcggagcttgcagtaagccgagatcgcgccactgcactccagcctggaagacagagcgagactccgtctcaaaaaaaaaaaaaaaaaaggaggaaaaatactgtttgactcatgactcatggtagtgtttttcacaaacaaatgctatcatttgcacacttgggcctaggaagaatgaagaagcctgaatctatgctgcaaactctggtttccacaagcctcgtgaaagatgaagaaagaaggctaagaaggcttcctcccaatgggatgatggtaagtctgaaatcccagttgatctggtgagatatgaaaaagggtgagataattgtgctgagaaatcatctcagtttacaggcacgcacatcttcaacacaaaatggaggctgatgagagttcagttcaatgactgtttccaacactagagtggggctatgaattggcatcatcctagagaaatttcaagtggcttaagtggacttgaaaacagtactgtcctctcactttttgtcatttagtttcttagagtcagagataatgtctaaaaaagggcatttctcataataatttgtgaccaggagaatcaataaaaaaggatttcccttgccaggattttcagagagaaaactatgcttacagtccacagaatgacaaatattcattgtgtgatgctaataaaagtgtaaggcattttaaaattcaagggtattttcttataaccatcttcttcaaagaactttgatctctagttaccttatatgattgaaaacaatgactaaatgaaatgcttgtctcctccaagaatggaatataaagtatttacataaatcgatattgctggaaaaaaatctgcagattccttatgcttgggttcacatgaaataagtaactttcttccccaaaaagccagctgtgtgattactaagagaccaagtcacatggtttggatctgtgtccccctccaaatctcatgcttagttgtaatccccaatgttgaaggtggggccttgtggggagtgatttggtcatggggatggtttctcgtgaatagcttagcactatcccttcttgatattgtcctcatgatagtgagtgaattcgtgtgagatctggtcatttaaaagtgtgtggtggctgggcgccgtggctcccagcactttgggaggctgaggtgggtggatcacttgaggtcagaaggttgagaccagcctggccaacatggtgaaaccctgtctctactaaaaatacaaaaattagctgggtatggtggcacatgcctgtaatcccagctacttgggaggctgaggcaggagaattgcttgaacctgggaagcagaagttgcagtgagctgatattgcaccactgcactccagcctgggtgacaggcgagaccctgtctcaaaaaaaaaaaaaataaaaaaaaataaaaataacgaacgaactaactaattaactaaataaaataaaagtgtgtggcacctccccctcacacctcacactcccttgctcctgctctggccatgtgatgcacctgccccctcttcaccttccatcatgattgtaagtttcctgaggcctccccagaagctaagcagatgccagcatcatgcttcctgttcagcctgcagaaccaagagtcaattaaacttctcttcttcataaattacccagtctcaagtattcctttataacaatgtgagaatggactaatacacatggcctttttggaaaagctctagatataaagtctgaggccagaggtttagatgtgtggtacagaaaatacacgagaaaagaagttgggcccgatcctctctctgtttctgatttttataaagatgctattcatttatgagtcagaaggcctagattcaagtcctgactctctctaagaaggtgtttggctatggttaagttattttggtcttagttgtgtaatctgtagtgaggcagctactctagatgaactcaaagttcctgtcggctgtagccctctgaggactggtgtggggtgtaggcactggcctctaactgggttctagggaaagcactgataacacaggactcctagagcatcctcattatttataagcattatttgattgattgaagactagtatccaaagcttgttttctttctttcttttttttttttttctgagatggagtcttgttctgttgctcaggctggagtacagtggcatgatctcagctcacggcaacctctgcctcccagttcaagcaattctcctgtctcagcctcttgagtaggtgggattacaggcgcgtgccctcacgcctggctaacttttgtatttttagtagagttgggggtttcaccatgttggccaggctggtctcgaactcctgacctcatgatccacccgcctcagcctcccaaaatgttgggattacaggtgtgagccaccgcacccggccatatccaaaactttgaggaagaaaatccattgagtggtatgtttcctactgagtgctcttactgatcagttacagagaaggagctgatggtagatgaaatcaggtgagaaaaggtcaaacatcaagagaacacatcaagagatgtagaacacatcaagagatcaatttagtatctctttataataaacaacccaaaccaaaaataccaacaatatataagcaagaactgttctgatacaatcctgtaaaaatagctttattaaaacctagcctgaagttttacagagaaaagattagacttagaaagcctccaaatctatcaagagagaaactttttttttaaaatctctatttgggatgatagacgatgcatttcagtttcagagaaccagctaaaaaccaaggatgaaataataagtgctcaagtgggctagaaataaatatagctgctgttttccctatatgagggatgtgcagcagtaatgaggctcagacaaaggattatcatcatagagaggaaatgaggcattaagcaaataattaaagagtattaaatcatctcagaacacttgtaagactgtaaaaggcaaacatcgttagcagtattgttgagaaatgatggtaagaaaaaggaaaggaaatacagttagtgtttgggagggagtgtggtattgcgatctcttactagaggtatgttttttgggaaatcacttactcttcaagattcttaattttttcatcttaatgaaaaaatttcatcttgctcttaagatggagcaagtaatatctccctcactggggggacacgaggattaaataagggcacagagaactggttctgagacattaagccgtcagtaagtggtgcctattgttattcaggaacagaaacaaggtgatgtttgatccagctagttaaatagctgtattctatcactgatacaaaaaatgcactctaggagagatgacagctcgttaaagtaccatatatttataatatgattgggtaaggttttttttttttaattaaaattttttttccttttctttttgagacaaggtctcactctgtcccccaggagggagtgcagtggtgcaatcacagctcactgcagcctcatcctctcgggctcaagcaattctcccacctcagactcctgagtagttgggactacaaggatgcaccaccatgcctggctaatttttttttttttttttttttttagcacagatggagtcctgctatattgcccaggctggtcttgaactcttgagctcgggtaatcctcctgcctcagcctcccaaagtgctgggatgaaagatgtgagccaccacacctggccaagatgtttttatttaagccatactgctttgaaaattagtgatcttccactttcattgcatgaatcattcacaacaggaaaagcaattcacccaagattctactattccaatgctataggaactaatcctctataagaagtgaaagaagaaaagacaacggggttggggcaccccttcagggcagttgcggtgttcactgacagagactaggcaaaacctgggagggagggtctttctctacaggagaaaaattgcagagattctgatgaaacaggaaaaaaaatgtcacttagaccacacctgtatgtaaaaggtcatcattagccatcaacattgcaaccaaaatcgtgtaaggagggaaggcagcatagtttagtaacttatttgataaagtcaaacaaggatttgcatacagtgaaaattttctaaggattgttcaaatgaaaagctgaaaacagtaatcctgtattgggtattccttttagtagccacaacttaatgtttggcattatttataaagcgctaattttcccctgtaaacatttggaataaaaatattgagtattgctgagaagcctgcattaccttgtaaaaaataagcatatcttccatgcttcttgattttagttattgccttaataaggttttttggtaaatgtatcacatggtaaaaagtggatttaagcatgatatatcagcaaccaagagaaaggagcacgacatggagcaaggtgtctttctctagtattaagtgtctcatggtaaaaatccaaagatggggcctggtgtggtggctcatgcctataatcccagcactttgggaggccaaggcgggtggaccacttgaggtcaggagatcgagaccatcctggctaacacagtgaaaccccgtctctactaaaaaatacaaaaaattagccgggtgtggtggcgggcacctatggtcccagctacttgggaggctgaggcaggagaatggcgtgaacccgggaggcagaacttgcagtgagccgagattgcgccactgcactccagcctgggcgacagagcgagattccgtctcaaaaaaaaaaaaaaaaaaaaaaaaaaaatccagagacggtaccctttaattatttatttattttgtagagatggggatctcactgtgttgaccaggctggtctcaaacttctggccttaagcaatcctcctgcattggctccccaaagtgctgggaatgccatgagccactgtgcccagcccaagatgctaccctttaaatcctcattataagacaagaataaaccaagaaacctaggagcacattgtataatcaaacacaattgctcttcaaggcccgtgccatcatataatgatacagtagcaaaatttagaaagggaatgctgtaggccggaggcagtggctcatgcctggaatcccagcactttgggaggccaaggcaggaggatcacctgatgtcaggagttcgagaccagcctggccaacatgatgagagcccgtctctactaaaaatacagaaaaatttaattgggcatggtggcacgtgcctgtaatcccagctacttgggaggctgaggcaggagaatcatgtgaacccaggaggcaatgttgctgtgagctgagattgtgccactacactccagcctgggtgacagaggagactccatttcaaaacaaacaaacaaacaaacaaacagaataaactaaaataaataaataaaatgaaaatagaaagagaatgctgtgtaagggtatttcttggaaacctgactgctttgatcaagtatgacaccctttcaaaaagcactaggaatccctaacagattccttcaattaaggaatcatgggggaaggttgtttagacagctcttgttttgagaactgtagcaaagcacactgttaacagaattaacagcattatttaaagactatgttggttatgataataataaatattgcatatttttattcagtttatatattgtagggcaaagacagtgttcccttatatcaatgctgtgcatagcaatgggggctctgtacaaagatgtttctttcctgagattttttcttttgtcttgtgcattttcactattgaacaagagactttagttgccccaggaagtgaagagatctagcctagatcaaagaaatcattggtcaggttctcagttgacttttaaaatctataaagtagggtgcataccacatgccctccaagagtgagtaggaaggtgggatcctgcacatagaacagatgttctagaacagatgtcagaggctctgtgggaggcagaataatgcccctcccccagagatacataagttctaatcctggaacctataaatattatcttatctggccaaagggtctttgcagaactgattaaggatcctgaggtggtgagattatcccggattattagggtgggcctaatgtcatcatggggtccttgtaagtggagggggagtcagagtgttgcaggctaagaaagactcagtgaaccattgctggctttgaagatggaaggggccaacagccaaggaatgtgggtggcctctagaaactggaaaagacaaggaaatggattcttcccaagagattccagaaggagcagagtcctgctgacatcttaattttagcctggtgagacctgtatcggacttctgacatttcagaattccaagatgataaatatgtgttcatctaagtcaccaagtttattacagcagccataagaagtgaatacaggcactctctcttacacttttgtattcagttcactttgaggtgcttcagcctgtgggtgcccaggtaggaggcttttctgattatatgatctagttttctctgaattagcttcatgaaatggacagatggtgtaaaagaattaacgataataccaataatgtaagcatacgccaacaacataataaaatgttgacttgctttgatatagctcttcattaattactttataaacatgatgatgatcttatcagatctgacaagaaattggcttacaaatttaaaatccttgagaattttgaagaacatttactctttaaaatgaagaactaagtcttaatatatgaagctttattaactaattatatatagtcatcacaatggaaaagtactttcagaaatacttgaagatatagctatgaacttaaaaacaataacttgcaaaagtgtatacaggactttcatagaaaaaactcagaactcaatgccaaaaaaataagcaaaacaaattttataccaggaagtgcagtatgtatatagaatgtaaaaagggccgaagtaaacaaatgaccaacctataacattgaaagagaaattctgaccaaacaatagctttataataatgagtataattatcccaatcctcagagactgtttttttttttttttttgagacagggtctcgctctgtcacccaggctggagtgcagtggtgcgatcacggctcactgcaacctctgccttccaggttcaactgattctcctgcctcagcctcccgagtagctggaattacaggcatgcaccaccacgcccagctaatttttgtattttgttttagtagagacgcggtttcaccatgttggccaggctggtcttgaatttctgacctcaggggatccaacggcctcggcctcccaaagtgctgggattacaggtgtgagccaccgcacccggcccagagactgttttaaaatttaatcacaagataattctttctcatctaaaatggatatagttaatggttatcaaatgtgaatttcttgattcatatgaaagaatctgtatgacttaaaaccagacaaagatgtgagatacaaagtagaaatccagccctctaaagggaagcagagggcagttaccttcaaagatggaagggatgcaacccttgaggcatcttggcaccctaagggaaagatcagtgaaatgctgaaaaattattaaaaaaaaacaaaagaaaaatgtgaaatgcctgttcatgtgtgactactacaatgtctcagaacaaacttcagaatgttactgttgataatatttgcttttttcccatcagtttaagatatattctaggtattaaaaaaagacacacacacacacacacacacacacacacacacacacacacacacacacacaccctaccaaaaataagaaacaaaacttgaaggtgggaagcaggtaaaggaatgggttaaagggttggcttggagacatctggcaatgcttgccctccccctccctcctcgtggattctttacacatttgcaggaatgtctgatgatgcatgagactggcctctttcatccggcctcctttctggtctccagaaccctccgaggccctttactgtcgactccactgcagggacatgttaataagaaacagatttgatactgggaatgctgtcatggagaaccctgggcttagctcattcacactcagtttacctttagcggatctggtttcatgcattcctgatctatttatgcatgtctgcctctctagaaagactataaggccctacccctgtgctctgtctcctccaggcacaatgtttttgcacactaaagcactgaatgaacgtttactaagttaaaaaataatatttgaagaagattctttgtattatttattgtattacttgcaatgcaggatctgtggtttctggaagaatttaaagtcacttatctctctgctcatgttaaaaccaaaggactcctaaacctcaaactgtaattgctgacctcaaacaacaaaccttttcatcagctagagcaacaaagttaaaaacctggctgccaaataaactctcctctctgtttgaccgttaatgggtttcaggaatgtaattttagataccccatcatccagggtcaggttgccctcattttggtgacactgggaatgtctgaaaaataatctctagccttgtatgtatcagacaaacggtatcattgtatccttttttttaagcagacctatcttttcccttctctaaatatcatcaagaagagaaggtaatcagccatttcagtgggaagctgatatgtgtggagaattgctacccacctcagcaaatcagaacatgaatgatggatttaaaggtatatttccatgtgtctaggtctaggacccacacaaatataactaggccaatgtgccataattgttgttcaagtatctcccaaattgtatgccttggaagaccagttctgagagatataaaagtatgtcttaagaaaaaaaaaatttgtggttaatttggaaaattctggatcaattagaattaaagaggtttcttgattgtagggtttcttagagtcctcgatatgttaataagcactgtgatttcttaagaggtttacaacctgtaactagggtaagatatacttttattgtttttaaatttatttctagaacacctcataaaatcctggcatatagtttggaaaggccagcaagcctcccccttgattcccattttttttttgtggaattcctaagcattgttgagaatttctgaacttcaggattattaacagtaccctgcgggctgggtgaggttttttttttttttttttttttttgacagtgtttcactctgttgccctctggtgcaatcacagctcactgcggactcgaactcctgggcttaagtgatcctcccacttcagtcttccaagtagttgggactgcaggcatgtgtcatgaagcccggctaatttttgtattttttgtagagttggggtcttgccatgttgctcaggctagtctcaaattcctgggctcaagcgatctgtcccctacggcctctcaaagtgttgaaattacaggtgtgagctaccaacccagggcaagggtatttttaaacaatatcaaggaaggagagattttccttgccttggtttagctcctgaaaaagcctttggggattccaatgacttggagtcatctttgggatatccaaagacgagctggggcccttgattgattctgaagccccaagacctcatactggcctggaatcacctgccagagcaataaagtgatgaaagtgcccagaggaagtacaggctgaaataacacatttagagaagagagtaatttttaaaaaggaataaggaaaggaagtgattagtcttttcgcttccctatttcttcctcgagtatttctttaaaggagaaattccttgtaatgtctattctttttttgttttcatatactgtagttttttcctccagcttcctaatttattagtctttttcaccaccaccaacagaattaggctctacatctcatgctgctaatcactgaggccaagacttatgattcagacatgctggcggtagcaggcttctaatcatgtgctgaagaaataaatataacttctaatcatgtgctgaagaaataaatacaagtttggaaaatggtacagtattggcctgccatgcaaaacagtatttggtataggtggaaggtgtatataagggtctggtttagtggagacactcacataaagaccattcctgacaaaggggtctgactccctttttttctcaggccaggtgatttccgtagttgatatgctaattcgaaaaatcataagtaggatgaacatcaattactcagaaaaagggcaggtgcagggggtcatgcctgtaatcccagcactttgggaggtggaggcgggtggatcacctgaggtcaggagtttaagaccagcctggccaacacagtgaaatcccatctccactgcgtgatggtgaacatctgtaatcctagctactggggaggctgaggcagaagaatcccttgaacctgggagatggaggttgcagtgagctacatcgcgccactgcattccagcctgggcgatagagcaagactctgtctcaaaaaaaaaaaaaaaattactcagaaaagttaaatgaacatgtgtatgacttccagcaagtaagcttttttattatatctttacatttatgggcctgtatttacatttgttattgtaacaatataaagataaatacaaacccaaaagaaaaacaaaagaagtcctttataattccaccaaacattttaaaaaagaattgaggaggccaggaacagtggcttacacctgtaatcacaacactttgggaggccaagacaggaggatcacttgagcccagaagctcaagaacagcctgggcaacatggtgaaaaaccatctctacagaaaaagaaaaaaagagttagctgagagtggtggcgggcatgcatctgtagtaccagctatttgggaggctgagatgggcagactgcttgagcctgggaggtggaggttacagtgagccgagatcatgccactgcattcctgtctgggtgacagagcaagaccctgtctcaaaaaataaaaataaaaaaaataaaaaaaggttgaggaattagttcatttaatacttcatataaggaaggaaaaatagaaaatcttgaatccacgtaatggtggtttgtatttttcactgtatttgcttaagtcaatgttttctttagttcatcttaatcaagaaagagctatccttaggaggactttgaaaaatttactaattattttaacatatcctcagaacaataccaagggaaacaaattcctggccgctggtgagctacctctggtaatgtaacttagcacaagatcaaaggttaagtgcctcttaccagaggagagaagtaatcatttccattatgtgtattttttggagtgttttttttgttaatacaaaatgaaatggactttcccctctacaaaccattaatagctgtgtatgtgcagccaaggcatattatgagtcaattataaagttctcatggtctccagagttcaaatgtaattttatcattttaattagtagtttatccttttaccaggcatcagagtgtcttgtgacaatgtacacaatggcctaccttcactcccaatttacagcaggatggggaggcataagctcttcaaggttgttcaatacctcttcccatttatttacactggcagtggttcaggtcttgggaagttaaccctgtttctgcaagcgagggccaaatggtcaggtctggttgagatctgcatatggcagctctttgctagctactcagtactttaaagattcaaagcactctcctgttactgagttcacatatactccttgggagagggatattatcttagaattatcctcctgaaacaacttctgttattaacttttctcattccacattaggaaatcaagaagctctgtccctggaaattcaaacaacttctctagtgttccagaactagcaaatgaggtgggcctgaagccaacacagagctgggacctaggttagtaattctggacttggagcttcaaggctctgctcatgccgatgaaagccacgcagcatgactatcatgaagcaggcaccctggatcactgaaagctctttaactcttggcttaaggtattctggctttttcagtataaaagccattacatttctttgcactgctaatgtcaaggaacaaatgtgaggcaaactatattttctttttcagagacagagtctatgtcgctcaggctggagtgcagtggtgccatcatagctactgcagcctcgaactcctgggctccagcgatcctcctgcctcagcgtcttgaatagctgggacttcaggtgtaccctaccatgtctcacttatttaaattttttttttttgtagagattggggtctccctatgttgctcaggctggtcttgaactcttgggctcaagtgattcttccatctcaacctgccagcctcccaaagtgctgggattacaggcatcagccatagtgtctggccacaaactacatcttctaacatttgattttctccttccatgtacactaatctgcatgttgaagaaatgcaaaatatttaattatactgcatgggcagaaacatgttagaaaacggatattaatgtgaaggcaatcactgcagagatgtgtgccagtcagattagtggtacagcttcctgctgaagatgattaaaaagaaaagagaaactcacacatccaggggtaattgactcagtgcaatttggcatataattatactgaggaccataaattctctatgatttcacagctgaagtaagacgaccccaatacacttaaaatggaagtattattctctgctgaaaatctgtttattgaaaaggacaaaagggaatccagattgggctaggaagctgctagaggagcatttagtctcagcatctcagtgtcatgatcagtgtctgatgttgcactgtttgtatcagtggctgatgtaagctgatgatggcatttttttttattatagttttaagttctgggatacatgtgcagaacgtgcaggtttgttacataggtatccatgtgccatggtggttagctgcacccatcaacccattgtctacattaggtatttctcctaatgctatccctcccctagccacccccccctcagcccccaacaggccccagagtgtgacgttcccctccctgtgtccatgtgttctcattgttcaactcccacttatgagtaagaacatgttgtgtttggttttctcttcctgtgttagtttgctgagaatgatggtgtccagcttcatctgtgtccctgcaaaggacacgaacgcatccatttttatggctgcatagtattccatggtaaatatgtgctacattttctttatccagtctatcattgatgggcatttgggttggttcccattctttgctattgtgaatagtgctgcaataaacatatgtgtgcatgtgtctttatagtagaatgatttataatcctttggtatatactcagtaatgggattgctgggtcaaatggtatttctggttctagatccttgaggatctacactgtcttccacaatggttgaactaatttacaatcccaccaacagggtaaaagcattcctatttctccacatcctctccagcatatgttgtttcctgactttttaatgatcgccattgtaactggcatgagatggtatctcattgtggttttggtttgcatttctctaatgacaagtgatgatgaacattttttcatacgtttgttggctgcataaatgtcttcttttgagaagtgtctgtgcacatcctttgcccactttttgatggagttgtttttttcttgtaaatttgcttaagttccttgtagattctggatattagccctttgtcagatggatagattgcaaaaattttctcccattctgtaggttgtctgctcactctgatgagtttcttttgctgtgcaggagctctttagtttaattagatcccatttgtcaattttggcttttgtccctattgcttttggtgttttttttgttttttttttttttttttgagacagagtcttgttctgtcgcccagactggagtgcggtggcgtgctcttggctcactgcaagctccgcctcctgggttcatgccattctcctgcctcagcctcccgagtagctgggactacaggcacccaccattatgcccggctaatttttttctgtatttttttagtagagacggggtttcaccgtgttagccaggatggtctctatcccctgacctcatggtccacccgtttcagcctcccaaaatgctgggattacaggcatgagccaccaagcctggcctgcttttggtgttttagtcatgaagtctttgcccatgcctatgtcctgaatggtattgactaggttttcttctagagtttttacggttttaggtcttatgtttaagtctttaatccatcttgagttaatttttgtataaggtgtaaggaaggggtccagtttcagttctctgcatatggctagccagttttcccagcaccatttattaaacagggaatcctttccccattgcttgtttttgtcaggtttgtcaaagatcagatggttatagatgtgtggcattatttctgaggcttctgttgtgttccattggtctatatatctgttttggtacccataccatgctgttttggttactgtagccttgcagtgtagtttgaagtcaggtagtgtgatgcctccagctttgttctttttgcttagaattgtcttggctatatgggctcttttttggttccatatgaaatttaaaatagttttttctaattctgtgaagaaagtcagtggtggcttgatggggatagcatttaatctataaattactttgggcaatatggccattttcatgatattgattcttcctatccataagcatggaatgtttttctatttgtttgtgtcctctcttacttccttgagcagtggtttgtagttcttgaagaggtccttcacatcccttgtaagttgtatttctagatattttattctctttgtagcaattgtgaatgagagttcactcatgatttggctctctgtctattactggtgtataagaatgcttgtgatttttgcatattgattttgtatcctgagtctttgctgaaattgcttatcagcttaaggagattttgggctgagacgatggggttttccaaatatacaatcatgtcatctgcaaacagagacaatttgacttcccctcttcctatttgaatacgctttatttctttctcttgcctgattgccctggccagaacttccaatactatgttgaataggagtggtgagagagggcatccttgtcttgtgccggttttcaaagggaatgcctccagcttgtgcccattcagtatgatattggctgtgggtttgtcataaatagctcttattattttgagatacatttcatcaatacatagtttattgagagtttttagtgtgaagtggtgttgaattttattgaaggccttttctgcatctattgaaataatcgtgtgttttttgtcattggttctgtttatgtgatgaattacgtttactgatttgcgtatgttgaaccagccttacatcccagggatgaagcctacttgatcgtggtggataagctttttgaagtgacacttggttcggtttgccagtattttattgaggatttctgtattgatgtttgtcagggatattggcctgaaattttctttttttgttgtgtctctgccaggttttggtatcaggatgatgctggcctcataaagtgagttagggaggagtccctctttttgtattgtttggaatagtttcagaagaaatggtaccagctcctctttgtacctctggtagaattcagctgtgaatctgtctggtcctggactgttttggttggtaggctattaattactgcctcaatttcagaacttgttattggtctattcagggattcgactttttcctggtttagtcttgggaggatgtatgtgtctaggaatttatcagtttcttctagattttctagtttatttgcgtagaggtgtttatagtattctctcatggtagtttgtatttctgtggaatcagtggtgagatcccctttatcattttttattgtgtctatttgattcttctgtctttcttctttattagtctggctagtggtctattttgttaatcttttcaaaaaaccagctcctggattcattgatttttttttgaagggttttttgtgtctctatctccttcagttctgctctgatctatttcttgtcttctgctagcttttgcatttgtttgctcttgcttctttagttcttttaattgtgatgttagggtgttgattttacgtctttcccgcattctcctctgggcatttagtgctataaatttccctctaaacacttctttagctgtgtcccagagattctggtacgttgtgtctttgttctcattggcttcaaataacttatttatttcttccttaatttcattatttacccagtagtcattcaggagcaggttgttcagtttccatgtagtcttgtggttttgagtgagtttcttaatcctgagttctaatttgattgcactgtgctctaagagactgttatgatttctgttattttgcatttgctgaggagtgttttactttcgattatgtggtcaattttagaataagtgtgatgtgttgctgagaagaatgtatattctgttgattcagagtgggagagttccgtagatgtctattaggtccacttggtcctaatagaccaagtcctgaatttccttgttaattttctgtctcattgatctgtctaatattgacagaggggtgtttaagtctcccactattattgtgtggaagcctaagtctctttgtaggtctctaagaacttgctttatgaatctgggtgctcctatattagatgcatatatatttaggatagttagctcttcttgttgcattgactccttaaccattatgtaatgcccttcttagtcttttttgatctttattggcttaaagtctgttttatcagagactaggattgcaactcctgcttttttcttgctttccatttgcttggtaaatattcctccatccctttattttgagcctatgtgtgtctttgcacatgagtttggtctcctgaatacagcacaccgctgggccttgactctttatccaatttgccactctgtgtcttttaattggggcatttagcctgttcaaatttaaggttaatactgtttgtgtgaatttgatcctgtcattatgatgtttcctggttattttgcccattagttgaagcagtttcttcatagtgtcaatggtctttacaatttgatatgtttctgcagtggctggtactggtttttcctttccatctttagtgcttcctccaggagctcttgtaaggcaggcctggtggtgacaaaaatctctcagcatttgcttgtctgtaaaggattttatttcttcttcacttaagaagcttagtttggctggatatgaaattctgggttgaaaattcctttctttaagaatgttgaatattagcctccactgtcttctggcttgtagggtttctgcagagagatctgctgttagtctgatgggcttccctttgtgggtaacccgacctttctctctgatgattatgtgtcttggggttgctcttcttgaggagtatctttgtagtgttctctgtatttcctgaatttgaatgttggcctgtcttgctaggttagggaagttctcctgggtaatatcctgaagaacgttttccaacttggttcctttctccccatcactttcaggtacaccaatcaaacataagtttggtcttttcacatagtcccatatttcttggaggctttgttcattccttttcattctttcttctctaatcttgtcttcatgctttatttcattaagttgatcttcaatctctgatatcctttcttccgcttgatcgatttggctattgatacttgtgtatgcttcacgaagtcctcgtgctgtgtttctcagctacatcaggtcatttatgttcttctctaatctggttattctagctatcaattcctctaaccttttttcaaggttcttagcttccttgcattgggttagaacacgctccttttgctcggaggagtttgttattacccaacttctgaagcctacttccatcaattcgtcaaactcattctccatccagttttgttcccttgctggcgaggagttgtgatcctttggaggagaagaggcattctggttttcggaattttcagcctttttgcactggtttttcctcatcttcgtggatttatctacctttggtctttgatgttggtgactttcagatggggtttttgtgtggatgtcctttttgttgatgttgatgctattcctttctgtttgttagttttccttctaacctgccctctgctgtaggtctgctggagttttctggaggtccgctccagatcctgttgcctgggtatcaccagcggaggctgcagaacagcaaagattgctgttctttcctctggaagcttcatcccagaggggcatctgccagatgacagccagagctctcctgtatgtggtgtctgttgactcctgctgggaggtatctcccagtcaggaggcatgggggtcagggacccacttgaggaagcagagtgtcccttagcagagcttgagcactgtgctgggagatccactgctctcttcagagctgtcagacagaaacgtttaagcctgctgaagctgtctccatagctgccccttcccccaggtgctctgtcccagggagatgggagttttacttataggcccctgactggggctgctgcgtttctttcagagatgccctgcccagagaggaggaagctagagaggcagtctggctacagtggctttgctgagctgcggttcaaacttccccatggctttgtttacactgtgaagggaaaactgcctactcaagcctcagcaatggtggacgccccgcccctgaccaagctcaagcgtcccaggtggacttcaggctgctgttctggcaatgagaatttcaagccagtggatcttagcttgctaggctctctgggggtgggatccgctgagctagaccacttggctccctggcttcagccccctttccagggtagtgaaagattctgtctcgctggtgttccaggcaccactggggtatgaaaaaactcccgcagctagctaggtgtctgtctaaatagccacccagtttttgtgcttgaaacccagggccctggtggtgtaggcacccaagggaatctcctggtttgcgggctgtgaagaccatgggaaaagcatagtatctgagccggaacgcactgttcctcacagcacagtccctcaaggcttccttcggctaggggaggaagttcctcaaccccttgtgcttcccgagtaaggcaaaaccccaccctgcttcagctcgccctctgtgggctatacccactatctaaccagtcccagtgagatgggccgtgtacctcagctggaaatgcagaaatcacctgccttctgtgttgatctcactgggagctgcagactggagctgttcctattcagccatcttgccagccacctagcattttattttatttttttaaaattttaattgttttttgagacagagtctctgtctgttgcccaggctggagtgcagtggtgtgatctcagctcactgcaagctctacctcccaggttcacgccattctcctgcctcagcctcccgagtagctgggactacaggcgcccaccaccacgcccggctaattttttgtacttttggtaaagacggggtttcaccgttttagccaggatggtctctgtctcttgacctcatgatccgcccacctcggcctcccaaaatggtggaattacaggggtgagccatcacgcccagccgactttgttgcccaggctggaatgcagtagtgggatcatagcttactgcagccttgacctcctgggcttacgtgatcctcctgcttcagcctccttagtagctaggactacaggagtgcactctgccataccaggctaagttttaaattttttgttgaggtggggttgtgctatgttacccaggctggtcttgaattcctggctcaaatgatcttccaggctcggcctcccaaagtgctgggactataggtgtgacccacagcacctggcctgatgatggctttttaagtgtactaatgatctcatcagaggagccaaatgccacatgactcaagaagaaagaaccaaacagtccggatccagggtgaaagccttcttcagctattcttcattctgtagtgtctatgtgtggtgttcccgttaagggtgagaagggaaagcaatgaccctgtgttggggcctccaaaagcaatcacgtccctccctacaaatcattgagaatcctggttgctgaagaatgttaaaataataatatgtgattaggagaatgacagtgctgcaacatcaaagaaaaaagccgggcaaagcagaaggattcgacccatgcttatgtgataaatttggtgccagctagttgagctgaggaatctgagagattagaagttgttggagaatctgtggtttcagctaaagcagcagagaatatggccaaggagtccatttgggtctaaagtagagaagaggttggtgcagagaagctctgtgggctgagtccaggagactgtttggactttgggtgataaagaagagagaagataccatctgaagctgggttggtatattttgggttcagagcaaagagggacctgtttctctaggatgaattgaggtaattctgctgcgatctggcagatggacatagagagagataagacaagatgacctcaagagtcaagagtgagaagagtcgtaggaggggctctgtgtgtgtgagagacggagagacatagggagttcttgaagtgactgtttaagatttcaaatgtgtgccaagatatcggggtaaggttgagatgtatacatttatgttattctctatgtatgagtaccctgacactacctttattttaattaattaaattaattatttatttacttttgagacagagtctcatacttgtcccccatgctggagggcaatggcacaatctcggctcaatgcaacctttgcctcccgggttcaagcgattctcctgcctcagcctcccaagtagctgggattacaggcgtctgccaccacgcccggcatgaagtttcaccatgttggctaggttggtctcgaactcctgacctcaggtgatccgcccacctcggcttcccaaagtgctgggattacaggcgtaagccgctcctgacgtctaccttgaattttaaaatagcaggtgtgcttcatggtgctcaattggatatgcttcacaggagtaaacatgtttgggaaatgttatcaaaaccaggaaggcataaattgctacctttctatgggatggcaatagacaagttcccaagagaggcagcaacagacccctaggggagagcctggcagggttgtggacttcctgcatgcaggcgccctaggatcctgggcttcttcctagacccttccctgggtttgagagacaggggagcgaggcaggctatgggatcctatatgtatcatcttagaagtaatcagatacaacaaggtagctggcatcttagcaaatcacacagctggaagactttaagtaaatctctgtggggagccagagggctcagatctggaaggagacagctgctggatgaggaataagtaacaactgaaaagtcagggcagcccagtggcaggccccttaccagtggggttgaggagaatgacaggctcgctcctgcagccactcaggtacaggcagttcatccaggaagcagtaagggacagagggagaagagagaggacagggatccaagtcccagaaaggagtataagatggagactttgtcttagaaattgacatgaaagcttacttgctaggacaaaggcaagcaagggtctctggagtgttctcaattctgtgaaggcaggatcagcccagagctggttaagatgtggagcctgatggtgccaacaggtcatgaggccattcagggaaaacaagggttaggaaggaggatggggacccaggcacatgatggcactagaggtcctgaattccaaattccagaatctttgaagtggtgtcaagattgtgtctcaggatcaccggatatagctggtccttgggatggaatgtggcgctgtcctgacaaaagacctgaacttgccaactgagagcctttgattcacgtgctctgaattttattgcatttactccaaatgccactgggcagttgtccatgcataggctggagaaattaataggaagggcaagaaaacatgagaagtatcataaagaaatactataaaggacaaataaatgagactggtagtgaactagacagacacagaaaatagaggacagaaattcccagaactgcttcaagcacgaaagtgcagtggccctgatctctgtagaaggaggagtgtgaggaggatgtgtgttcagaggagagcgagtggctgttgtccacttgtttctttttagaagacggagggatatttgaaagttcactagatatggacacattctctgcattcttcttctcttttcgttcttttttgttttttgtttttgttttttaattctagaaaagaattgtttcttattttcctcccgaagatgcaaccaaatgccctcttttctggaaacattttagttgcagcttcacagactccatttacggttgacatgcattctttcccctatgaacacacctcagcagccgccagagggagactttccacacacggtttttgcgaagagaatttccttggagattactgcaccctacatgatacaaattcctccccacgttccccttcacaggcagggcttctaatcttgacagttcccagagcagcagtcatggctatatcaggcaattataccattgggaacattagggctgctttgtaaaaccataagcacccaagaacagatactttaaaaaatgtaaaaacaagacagcagtgacagcagaaaggacacagcagctgagtcacctcactgcatttctccacatcctagcccctaggaggatgctctgcggggcccacgggaagggctgagtgccacatgccagggaccccagaggttggcaagaatggctttgcctagagaccatgcttcctttcaggtgttgcagggagaggtggcaattctgtttcccacattaaagaaaaaattgaccgggtgtggtggctcatgcctgtaatcccagcactttgggaggtcgaggcaggtggattacttgaggtcaggagttcgagaccagcctggacaacatggtgaaaccctgtctctactaaaaatacaaaaattagctggtgtggtggcaggcgccagtaatcccagctactcgggaggctgaggcaggagaatcgcttgaacccgggaggcagaggttgcagtgagccgagactgcaccactgcactccagactccagcctgggtgacacagcgagactccatctaaaaaaaaaagaaaaagaaaaaattaaatttcatgacttagtgagaaatggtcattttgggggtccattgcttgatttttttttttaaatcttcttaaacaactctgaattaaaatgtctgagagaacacagtgactcatgcctctccacttcccagctttccaactgagcagcccactgggttggaggtatcttgccaagagggaagtatttttaatttgggctttatctgtcactcagctgtggtcatagagactggcaggaatgcatgcaattagaagaagaaagaacacctttatgattccataatattagtatttaatgccttttggatgttttggatagcagtcttgtgtaaagagacaagacatgaatacatgcaaaagcaaatgagaaaagtcagcatttataacactatatttggggattccagaattgggtaatagaggacaaaagtgtgcatctctaaggagttatttctgtagttcagttcacaaactgcagagtggaataagcttagcagatagaaataagacattcagttttttattagaagagaaacacacataatttggtagggctatttaaatttttgagtcaaacgaattttgttggcatgatgacttcagcgaaccatctgcaaggctatctgaaaggactctaaaataaatgaagggattattccagtttattttgtggaaagaaacattttcaacttttcaggctactttttttttttttttccaggaaacttcagggggttagaatgcagttttgctttgctctgtatacctccttgtcaacagcattgtgcttgtatggtgcagtattatagttgcaatgagttatctgtatttatcccttaaaaatttgctggaaaatatggagctaaacatatcatactgatttagtcgcagtataattcttcataaaaggctactctgcccaaaccatcagaccccaaggagcattaaaatattgtttcaccaagggcccaggacttaaacacaattccagactcaaaatgtcattttaactaaggtgaccatatatcccagtataataataataatagtaattattattattattattatttttgagacagagtcttgctctgttgcccaggctggagtgcagtggctcgatctcggctcactacaacctctgcctcctgggttcaagtgattctcctgccttagcctccctagtagctgggatcacaggcctgtgctaccacgcgcagctaatttttgtatttttagtagagatgaggtttcaccatgttggccaggctggtctcgaactcctggcctcaggtgatcctccctgcttggcctcccaaagtgctgggattacaggcgtgagccaccgcgctcggcccccagtataattattaatggtgcatttttttttttttttgagatggaatctcactcactctgtcgcccaggctggatcgcccaggctggattgcccaggcgcaatctctgctcactgcaacctctgccttggggttcaagtgattctcctgcctcagcttcccaagtaactgggattacaggcactcaccaccatgcctggttaactttttgtatttttagtagagacaagttttcaccatattggccaggctggtcttaaactcctaacctcaagtgatccacccacctcggcctcccaaactgttgggattacaggcgtgagccaccacgcctggcaaatggtgcatttttcacactcagtttggaagatacaataaatggccagcatgcatttaataccagccctgaagcttgcagggtgatggacacataagggccattgtgtctccacactcaggaacagcattgatgtgcttaatgaggacaggctgactccttcccttcagccttcctgcaaagagcaagcatcaacagctcccgggcaaaaataaaaggccaaggagctggaaaataggatataaattttcttacccaaagctttctcaccaaagcttgtaggtatgaaaacgtaatgttagtctgcaagcataaatgttgatgttggagatggagcttatcgaaggcttgcacatgtgagactctgagtgacgtcagtgatgtgttgagcaacattgtgatctggatgcagagagaaactgaagagatgacagaatgatctgatacagaccacagagaggcgactccagccagaagggtatgttgacttactaggggcaagtaagcaagaaacttcaggaaagcacacagccctaaactaatacgtcctggtagaaaaaagtttccccaaatgagaacttgacaaagaggtattcaaaagaataccaacatctacaagatatcagtgccactgagtttgggaatgggcggaaaaggaattttaatatggaatttaagagaagaactgagttcagcaagggagaactgaatgacatcaaagtattacgcatgcaattgtgggttacatggagaatataatggagaaatgggttgttaagggactgattaattagtaagccaagatctagtatttgtttgcttatctcttatttacccacctgaacccacctatctgaatacagtttatatcttaatatttcatgactcttgcaagttctctcattgtacctctacgctctaagaaaagaaagggagaaagacggtggtgtgaagatctctatctttggaagagaactacttctcatgcttttgatggaagcagaagaaaatggaccctagacggggtgcagtggctcatgcctgtaatcccagcactttagaaggccgaggtgggtggatcactggaggtcagcagtttgagatcagcctggccaaaatggtgaaaacccatctctactaaaagtacaaaaatattagccagatgtggtggtgcgtgcctgtaatcccagctgctcaggaggctgagacaggagaattgcttgaatctgggaggcagaggttgcagtgagccgagatcacgccactgcactccagcctgggtgacagagtgagtgagactccatctcaaagaaaaaaaaaaaaaagaaaacagaccctagattatcttgtgcatgtcttttcattgcgcttagaatactacactgtaatcgtggatatatttgtctgttttcctgcattggtgctgcgttcctggaaggtagaaatcagtttctatgaaggcaaggattatgtctgcctgattgaaaggggcttcttggagctctttggtcacattaaacgggcacaggaataaagttcttctaaagaagggatgttggggccactgggtgacttggtgcttaggagcagaggactaccacagaaggaacctcttcttggccaggtctgcaatctcttttgaaattcagaatgacattgtttcatccatgagaaaatggcaaaaaactgcatacaactcatcctttgtaattcctttttttttttttgagacagggtctcactctgtcacccaggctggagtgcagtggcgtgaccccagctcactgcaacctccacctccggggctcaagcaatcctcccacctcaacctccagaatagctgggactacaggtgtgcaccaccacacccagctaatttttgtacttttcaggagagacgggatttcaccatgttggccaggctggtcttgaatgcttgacttcaagtgatccacctgcctcagcctcccaaagttttggaattacaggcatgagccactgtgcccagctgtaattcctatctgagcaagaacacacatctgaccgttgtaaaacaaaatgttttttattgtgagagctgtgaattcaccaagttgaagttcatatggggtgatctttacccattttgcctgagtggtatcaggggtggaggagtcatgtcttcctaccctagcgcccaggattccagcttcttgtcaaggctccctgcaaaggacaatacaagtgtctcatttctgctccgtttcctgcctcttcctctccaagagcaccttcaggaagggtggaggatgagggaatctgtttgcgatgggcatctggacttaagtggctttaaattttggggcacactctacaacaagaatttaaaagcttaagtaagcacaatcgtaagtaagctaaagcttggaaatggtaatgaaggaaaaggatacaaaaggacctgaattagctttttcttggagaaaataaattgtaagagcgtacttgacagtacgcgtaaagagactcctcattgtgactcagatatgactttctgaagcttctctcccaggtgcacattaggtggaaggaagaagggagagaggaccaggtttctttaaaaacagatttttcagggaaatctctgtctgcctttgagatgccttacacctcttcaaaagcctacagtttggttgaatccactctccaaaaagactgggacagaaaaaaatttacaaagtctatttgtttagttaatttattcaacaaatatttactgagtatttattatatgccagatactggttatacaaccgtggaaaaaacatagtccttccttcaaagtgctcctataaatatacacttgcaaatgatggcaagtgctatgaagaaaaactacatagaagaacccaagtcctgggcctaaataaaatgagaaagctgccgtgcaacctgacatgcactccaaccccctacacaccttccttcactctgtgctggcccaatctgcctccaaatatttaccgaagacacccctttaggagccttcctaagactgaagaatgtattttaagaatgcttcactatacaccagtaaaccacagagcagtattgtgccagctcctttgatctgataagctttgttcgaatgtgagctgaactgttagcatgtttgacctgaagttgagttctcaacaacgtaccagtagagttgaaagtaattgcacatgtccactgtatacaatcccttggtcatttagggagacagtacaccaggcttttcaacattttttcagtctgtgcagaacatgtacatttgcactgggtcctagagactcactgtaaagcagcagtgcagaaattgaagatttagcacatggtattgacatgaaaagtcaatggaaaaagtaggtttccatgcaagactgtgaacccctccagggcaggcacgatttcccccagccctgcacccggggtttggcacagagaagtgttcagtgtttgcgggactgaaggattcaataatacttgatattcctcttttctctgcattcctaccgttgccatgcccagttaatactggaattagaagtagacagcatgggcataagggtatgatctcctgcctctgagatctaaggagcccaggacaggcccaaacctggtttcctttatacatcagttcacaaaactaaaactcaggtctatagaagatgaattactgctactcctacagccaatgagaagcacatttaaaatagggagctgctattttctgtagtggaggaagtgattcttcctgtgtggctacgtttagcacatatagcttgggacatggatggatttatgcttctctgtgcagtgggctctctccataaatacccaatggtctttcattttacactaggaaagacaagctaccaaaacggaacacttctcacacactcttatcctactcctaccaaaaggaaggaatatttagggaaaatgatttgaggggctgggactcaagactccttgtgataaaaaattctcacctgcccctgcagatttttgataggggccctacgtcatcccccgccctttctcctccacacccagcttcaggctctgcagagggacatgaatttgaatttttgtttgtttgttagtttatcaagaagaggtataggtttagaaggttaaagactctggtctaatgttctccccactgttcccagaaaagctcccgtcaaggacggtgtcaatgactgtggagaggaaagcacagccctcttttacttatttattccatatatatttttaaagcattcactatagatgtcactgttctaagagctggaggcatagtagtgaacaagacagaaaaattttttggctggaattgagatgacaaatacacaagtgaatatttaatttcatgtggcagtaagtgtcatgaagaaaaagtaagcattgcaaaggacaagagattgacttggggcagagccaagtggccatgagacagagatgtgaacatggagttgggaggtggaggaaggactccaggcacgggtgtagggggtgggtggaagcagcgccagagccctaaggcaggaacaagctcgctgggttccagaaggtcagagctctccatgtgtgggtcatggttccctggtgagtgtctaataagtaacaggtgttcctgagaaggtggcacacagaggtcagagggcagggctagggaaacacgggagtgagggcaagaagaaggccagtgcgtctgcaacagaagagtccagaaacacgacagaggaagtcagagagccaggaggggccgccctgggcaaggtctggcagagacttggctataaacacgatgatctcagccacagagtgtaagagggcagcacaaagggaagtaaaaacaaagccaagggcatatccttgttgtttcaggcatttaaatctgataagaacttgataactggagagaataaaagctacagcttgatgccccttctgtaatgactccagtgatcaatgctttcatcatgcaagtgaatcagatcatatcactatgaatgataaaaattgtgttaaagaatagccaggtaaatcgacctgtttataaaatgtatatgcccaattagtctattggaacaaaaatagaatgtaaaacaaaaaataaaaatacccacctaggtgagacaacttcaacttcaatcacctaaaagtggctcacgtatcccacccagatcatcagctgtgttgactgtggtgaggaataagacagaaatccagccgggtgtggtggctcatgcttctaatgccggcactttgggaggctgaggcaggaggatcacttgagcccaggagtctgagaccagcctgggcaacacagcaaagctccatctctacaaagaaaattaaaatattagctggctcagtggcaccacctgtggtcccagctacttgggaggctcaggtgggaggcttgcttgagcccgggagatcaaggctgttgtgagccatgatcatgccactgcactccagtctgggcaacagagtgagaccttgtctcaaaaagaaagaaaaagaaaaaaataaaaaaaggaagacagaaatgcatcggagtatgaggttgtggtttagggatggggagtgtggggatgggctgtgggaagggaggcatacagaaatgtataaggaggcatgagtcctaacaaactattcctgggttctggctagaggtatttttgtgacgatcacactgaccccggtggggtggcatggggggagcatggcctgttaatggctagaagtttgggttttctttctgctcctgaaggctgaggctgcaaacccagaacacacacttactgagtggggatctcactgcactttttgccttctcaattctccttgagaaatgcagccccacctttatttcttgagtgttctagaagaggtggaaaacagcctggactgtagtgggggtcagcccagcatcagtgtggtagtgagcaggggtggacttcgggagcaagagcagcgtttgccgcggggcttgcactcccagcagctcacccgtctctgtcctgaccctccctactgggcacgcagggtctctgtagcacttggccgaggcctagatacccagggtttcccactggaaagtctcacctggggctcatgcttctcacctgtacctgttaactcccacaaggcactccttacagaacacctcatggaattatttaacctcagttattaagagctaatagggacccatagtgttattttctccaagtagcgaataagctctgattttaagcaggcccattacagggagacaatatggtgcgtgaaatggcagtggtgtcagggggctaattactggggagcttgtcaagccacagaactggcctgctaatcattccttggcttattgcagctgacgtcatggggctttcccacagtgcatatgggaaaatgaaggaggcaatcacaagttttagttaaagtgcttaagttactactttctgtagctagcaggactataagtttaagcaagtgcaccgaaaagatagaagcggaatcaattcactcctaactgacttacccagttggaaaggcaaattcgtgggagtgaagttgttctactggtactgtttcctttacagagttatccttcagatgtgttcagaaggatggggcaggacacagtgaatatttgcaaaagctctagtactggcctttaaagctgttattcttttcaatcaatcctcatcaaaccctgccttggtgcaaaaaccagatgcagactattgggagatctatatacacaggatagaccctgaaccaccaacaagtacagcctgggttcgtgtggactcaggaccattctaccgtttctctgtttccctgcttctttgctgctgttcacagccggatcagctgagctacagtttgcacagctgcaactgattggactcccagttgccttttccagaacatgcaattggtgccataatctacaaaagagatattaaccccacaactgaggagattaggagcaaagaatgataagaatgaggacaaggtcaatccaagatggatggcgttgaaggcctgtggacacatcgctcagataactgaagtttttacagtaattggaaagatttgtgcatgtgggggaggcttcagtctaaaaggggaaatgagtaaatgttacagtggcttgttagtagttagaagaatgagcatgtgcaaattgctgtttgggatcaaattaaggcatatggtataagatagaagtatgctcagtggaggcagaagcaataagcggcacattgatgaattatgcctttgcttatacttctattttcagaatttgctttaggtcttccacttgattgtatcttcagtaatcataagtatttggtggtccttcctctgatatgaagcgtgacacttgtgtgatagaaagaaacatgtttatgacacagagcactcaggagagcctggcgcactgcagatgttcagtgggtgtccacggtgggactgctgtgcagagtactcacatttgaacatatgggaaatccaaaaataaaaggttttgaggatgatttaccatgttggattacataggaaaacaggcagccaagtggggacactgtcaggattccgccctattctgaaacacccacatatcctcacagcatcgtccgaggatgtgccctgggaagccgacttgatcaaccaattctgttccaatgcttctggaggtacggtgttaacatcagaaacaatttcttaggaaagaattttatctaagcaccacaagtttcttaatccccttttttaaaaaaacaattttgattcgaaattaattccaggggagacagatatgggtgtcctgttcagtcatataatcctatgaagactttccatggaagcaaagcaaaacaacgtatgattttctaagacagtttagggttttctgctatgcagctgaaatctagaagagtcgtttttggaaagaatcactacaaactacatgctgttttgaatagtccattgtttctcaaacacagccataggttgtgcatgagtagatggatgtatagccccagaagggatggaaatacaatcccagaagggatgacggtacaaccccacaaggatggagatgcacccccaaatgggaggctctggataacacgtacagttcctattaatgttcatgacaaaacctaagcactaggctgaaaatcagctttggtttgctcatcatcttgggttgaaagcctcctgttgcacacattcagcttgactgccacagcatactaataggtttaaaagaattagctgattacgtggtttttttttttttttttttttttttagagggagtctcgctctgtcatgcaatggtgtgatcttggctcactgagacctccacctcccaggttcaagagattctcctgcctcagcctccccgagtagctgggattataggcacgtgccaccacgcctggctaatttttgtattttttagtagagacggggtttcgccatgttggccaggctggtctcgaactcctgacctcaaggtgatttgcctgcctctgcttcccaaagtgctgggattacaggtgtgagccaccacgcccagtaaggttttaaaattccgcagacaacactgcagatgtagtttctctttcttttagatgaaggcttcacaatgctttgaagtaacttgtcctacaaaatatgggttgggaattaccagcctttggtactcttgtccaaggcagtgtaaccatatgaatggaagaagctcaactgcttatttctaggttctcattcctgccacattccctcaaacagagagttccagaagaacatgggtcagaaaagagagaactggtgagcatggctgtttttacttttcctaaagtttcccctagagctgttggaatgggtgagaaatggacaaatgcctttgagctctctctggaaaagagcaagaaaaagggaaggcaaaggaaaagtcaaggaagaggttggagaagggaaaggcacaggctgcaatgaatgtcaccagctaactcagtagcactattcctactagagcttgcacagtgctgcactgaggtgtacaggtgtacgagaaagcattatcctttgtttcattgctttgacacagctcacaatgcaaggtttcttaatcctcttttagcgtaggtttgtcaatatcactttctctctgaatggataacgatgatgatgatttgccatgactcttcacaattccacccagcacttcacttttcctattttcgagagcactttccctttctgaaaacacagatggtttacactattatattaggtcgtggctgtgacagaaacctttttttcttaccataattgcttggggagtttttctggctggaacacaggtacaactgaaagcatgcccttgagagctgagcttttgttagagtaaggactacaaaggcatggatttatatttttaaagacaccatgaactggttttatgtagctttattcctttgtcctaaactccctccacttcaaaaaccacctgcaactgtggtttgcaaattaactgcctctgacatctgaagagggggaaaaaagccctacaaaaatctacaaaacctcacttgctaccagtatgagggtaaaggaaagcaagggaaagaatattttttaaaaatttagtattgatttttaaaaagaattctttactagaagatgttatatacttagataaataacaatagcatagcagcacctttctggagatcatctccaatgatcctgcccaatcactgaatccaaaagatttcatttagtcaagaaaactaatataaaaaaggtgaaacctgaaggatatgctgacatgagatgtactattgcttccagtaggaccaaaccaatgaaacactagctatttctttattaaaaatagtttcttggctggatatggtggctcattcctgtaatcccagcattttgggaggctaaggtgggaggactgcttgagaccagcctgggcaatatagtgagaccttgtctctagaaaaaatttttaaaattatctgggcatggtggcttgtgcctgtggtcctagctactcagggggctgaagtgggaggattgcctgagcccaggaggctgatgctgcagtgagctgtgattgcatcactgcactccagcctgggtgacacagtgagaccctgtctcaaatttttttttcttttattataaaagcgaaacatgcacacctcagaacatttgaaaactaaagtataaggagaaaaacaaaaccattttggttccaatatcaaagataatcactttaacattctagtgcatttccttctagtattttttttttcctgagcaaaaattcttgacacattctgagttatgtgtgtatgtacaaaaacacactattttggatactgttcccatgtcctgtggatttctagtttaatataataccaaagtcctctcctttcccatattattataaacttttttaaaacatttgtggctgggtgcagtagctcgtgcctttaatcccagcactttgggaggcggaggtgggcggattgcttgaggccaggagttcaagaccagcctgggcaacatagagaggtgccgtctctataaaaatttaaaaatttttttagagagtgggttgtttcttatggcttggagcggtgcaaagagggtgagtttgcctttttttttttttttttttttttagtggaaattcaaaacaaggaagagacctccatcccagcagctttatactatcttgtaagccttttggaatatgctgcatttcaaaagaaaactagaaaaaaatagaaagaatatatgttgatgcaaatcctctatagattttctcatagttttatattcactctagaaatgtgatcagcagtccatgaaatctctttagttagatgtttatagacagagatttgagaccaggttagtaccaaggttgtattagccccacttagttatcacaggtaagagagggaacaggaaagaagggtgggtaggaatttcacctccacggggctttggacaagaaagtgcagagaaagaacacgaagtggatgaacagcctgagaaagaaaaggaaggctttctctgcagaagttagcacttaccagtctcttggattcttgctatcacccatttctagaggttcttttttttccaagtaagaagttattgaaactttgttcctcaaagtggtttggggtgacatgtgaccaccccactgtctctgaaatgaagtggtttattttcaggtgactgaaaaaacagtaaagaattttatgcttctgtggagacatcagagtcatcccagaaagctacagcgttcactggagcagcaaatttccagaggaaatcttatgttctcacctctcaattaacagatattcatggggcaaattctatgtacaagaactatagattttgtgtttagatggctaattgctgaaccactgcaaagctacaaagtgactggtatttaaagtctttaactccttgtagggtcacaaggtagtagctgagatcttatattagagtggtaggaagtaggaacttcaagactgctacgtgccaaagtcaagtgcttgcatcctatttatttaactaatttagaaagtgttatgggcttttggattgtgagtttctcgttctctttttctgagaacgagaacagctcttcatgtttcaggttaccaatttttaaataaaaagaaagttgctttaatttgtgtcagtttaacctggatttatgtcaacattctttttatttaaagggatatagcaaatgcaccattaataaaaccagaaaaggcccggtgcagcggctcatgcctataatcccagcactttgggaggctgaggtgggcggatcacgaggtcaggagctcgagaccagcctggccaagatggtgaaaccccgtctctattaaaaatacaaaaattagccaggagtggtcttatatcaataagaggcactgtgtgctgggtacagtggctcagtgtaactttgactggcctcccctttgtgactgtccatgtgaaagttgggtcatgtttgatgggggcatttctaggatgcgtggaagaaatattttttgtattcaacaagcagatgatgttatatgatggagatgaaacagtgcctgcccaactatccacctctaaggaaaccgccttgcccaaaacccccactgacagaattgtggccatttgtgtcactggaatctcagaaggaggaggatgaaaaagtagccacagaaataatgactgaaaatggccaggcacggtggctcacgcctgtaatcccagcactttggggggtcgaggcgggtggatcgcctgaggtcaggagttcgagaccagcctggccaacatggtgaaaccctgtctctagtaaaaatacaaaaattagctgggtgtggtggcaggtgcctgtaatcccagctactcaggaggctgaggcaggagaatctcttgaacccgggaggtggaggttgcagtgagccgagattgcgccactgcactccagcctgggggacgagagtgagactttgtctgaaaaaaaaaaaaaaaaaaagaaataatggctgaaaatttctcaaatttggcaatttgggaaaaaaatacaagcaaatccaatagactttccttctctaaaagtttctaaattatatttgacatttgaagcagaaagtataacattgtgtgatgtaactcttcatgtatgtgtaggaaatatttaagataattttaagttggagagggcaaagagacttgaagggaggtaaggtttctatacttcatccaactggcaaaatgtggatactaggagatctttgtggtgatggaatggttctacatcttgattatagtggtggatacagaaatctacacgtgataaaattatggactatttggccaggtgcggtggctcgcacctgtaatcccagcactttgggaggccggggtgggcggatcacgaggtcaggagatcaagacctgatacagcaaaaccctgtctctactaaaaatacaaaaaattagccgggtgtggtggcgggcacctgtaatcccagctactaggaggctgaggcaggagaatggcatgaacctgggaggcagagcttgcagtgagctgagagcgcgccactgcactccagcctgggcgacagagcaagactctgtctcaaaaaaaaaaaaaaaaaaaaaagaaagaaagaactattcatgcacattgtaacaatgtcaatgtcttggttttgatattgttgagatgtaactgttggggaaactgtgtgaggggtacagggacctctatgtactatctttgtaatttcctataaatctataattgtttctaattaacaagataaaaataaaagacaattgaaagaagtttcttgaaaatgataaaagcaaacatcaaagtatcattgtgattctctggccataatcaacattttagaaaagagaaaggttttcaaaagcaacatagtggatgagatggactcaccaattttcataaattttaaaatttcattatgggacaaatatgtaatggaataagaaagttaggtgaaaaagacatttaaggttggatttgaagagagacaggatggcagtcttatccagaaattcaggatgaacttccgtcttgattagatctgatacttcttgtcagacatacatctctacagcatgaaactggttaaccaatgtcaagtgtaataatattatgtacccttttgaaaccacagaatattctagggataaaagctaattaaactttgacagtttgtcatatattagagataacttagactagttatcttcttccataagtttaattagaagttatagaattagaattagtattctcagtaatattgataattggaagaaaaaggtaaaacaaaataaaaattctcttgtatgttggtggaaattgcatgtcagtaggacaccagcagatggcaaagaaagctttcaaaatgttgatagttacatgatcattgatttgtcattaaaataaatgtgagactgtttcaaatgccgttatagtaaaatcatggtactattcattttggtcttctctatttttaatcaaggacacttggcagcaggaaagttttgccctgaaaacttgacagaaagtcagtggcagtaggtgtagacagaaatgcaaaacttcaggtcttggatttaccacctggagctgaataatgttgctcttaaagtggctttgcagcattgtccaactgccagtgttaattacatggacaatttccaaccgctattagtttgctatatttgttaacatttaatatgaactggatcagacaactctggattatgaaggcttttttaaatggcagtttcttccatcataaaagtgcttatgggccaggcacagtggcttatacctataatcctagcactttgggaggctgaggcaggaggactggtttagcccaggagtttgagatcagcctgggcaacatactaagaccttgtctctacaaaaaaaaaaaaaaaaaaaaattagctgggcctggtataatctcagctatactgggggctgagttgagaggattactggattgctcgagcacaggatgttgaggctgcagtgagctgggattgcaccactgtactctagcctgagtggcagagtgagactctgcctccagaaaaaaaaaggtgtctgtggaggtatcataaagacaaaagtgaatgataaagattcacattgagagagcctgtttttctagtttgtgttttctgattgacctttgtaactgagttgctattgttcacatctttgctctacagttcaagcaagagaccagtcagatcagaattacattagtttagtatttttttacttaacccaagggcacagacatctgaccacttcatcagcctcaaaacagaatttgccacctgcttaatttacgcatgagttggcaaaaattattttctccatttagtgctgtctgacaacaccatgactagatcaggggattggatatttgatcttccaaatccgcataatgtgaaaacgactaagtgtaacaggaaattttaaacccagagagtattttcttttcataggcttttaaaaaaatttaatttcagtctagtttttttcatctttttctttaaacagatatttcacagacaaaccaacatgagaggccatgtcaataatatgtgaacaaatgtttctttaaaaaagagaattttttagaaactgatatagaaaatacagatttcaaatatggcaggaagctaaatgcatatttgcgagaggaaagaatgaaagaaaaaagctcctaggccttttattctataaatggatttgtattaaattatttcagattataccatagtttccaaggcatttattggtgattacagagagaatttcacttactagctgtgtggcctggtcaagttgtgtaacctctctaagtcttacatttttttttctctgtttgatttaaatgataatatcatgtgcaagtcatagagtattcattacggttacattagacaatgtatgcagctgtttgtatgcttgtcaaataataagtgcttaaaggttagctattatcattattattaaactaagccacattgagagatttaaaatcaaagccaaagtagggcattctaatttgtaatttgcataatgcttccttgtgaatgatctcatgtgaaccttacaacagcctttaaggccagtgtgccagaaaaccctggaagccccttcactgtttgccatgcaataaccccgaatgtgggcaaaggtggacttgcttgttggctgtctgtgaggcatagcccctcaaggttggcactccgttcccaagaggtgatttatgtacttcaaaacaactgcaggagatggaagcacatggtattcttcagattttaaatcttgctctgtgcctgataggacttttgcatttttatgacttcctaatattatagaggaatcctacctcgagtgccccacagaagaaaggagaagttataaccaaaagtctcctgcaaatcatcactgtcagtttccttcaatgtaacagcagacaaggataagttgcctcacaaaaggagtaggttgtgtcataaatcttgctcttttttctttcgtctgagcctgcaagggtggaagtacgcgatgtctccagttccacttggagagattcaaagaaggaaaactcattagcagagggacaaggaaccagtccaggcaatatctgaatatttattatttgattttatcttgaatagaaaagaaaggtgctttgttcagaaagcttctgattgatatctgtccctttgacttctgaacctttgcctccctgctttataacaaggatctattaattaacttggtgcttggcagaaagaactgagctttccccgaactctaagaattctccaaaaatggtcattaatgctgggaagaggatcagcattgtaatctcattttatacatgaagaaactgaagttcagattaacttcatactcaagcaataaataatttgtagagccgggcaccgaaggaacaaagggctgtttactgagagacctgagcttcttattctgactttgcctcctgttggaggttcaccactttgggccttagtttccttacctttgaatgggtttgatgaattagataggtgcagcagactttctctgtaaagggccacatcataaatgtatttggctttgtgggccaaaacattcctgcagagactactctgcaggaactattcaactctgcttttaaaagagggaactattcgctgaaacttctgtttacagatagcaggtaaacaaatgggtgtgagttatgcctgatgacagttaatttacaaaaacaggcagcaggttggacttggtccatagggtatgtttgcagaccactagactggatgatgtagaagtttgtttataactgctaatatttgatgactcagcttgttttaatagcaatgctattttccctaggaaagtcagcttgattattcaatcgtctgtggcttgtgcagtttgtggagtacttaaagatttttctgcagcttttcctttcttcttccatttttgaatgcctgctgtgtgtattgcaattacaaattattatcttaatgtcattctgcttagggtttagggtttgtgtggggggggagtggggagcaaggtgtgtgggattggagtgtggagtgcatgaaggtgggtgaggtgtggtctcctgggtaggatgactgacttggaatgaagacccaaacccttaggagaactttctgaatgttagttctgacctcagatgatcaacagattagctgcttttgctatattaagcaaggcttgagcaagtgtttcagagctgccaggaatgggggagggtgtaaggtaggaagatggaagaatgtgtctcaacttagaggaaaatatgatttctcctgttacaaaaatcaaactgtaaatacttctgttactgtggtcccaagctacatccaagagggtaagcactgctttcccatgggggacactgtaccctaggttcttactccccttcctgaactatgtgaaggagaggagaacagttcaactccatcattgtttaataaattcctctaataagagaattagagtattggtggggcatagtggctcacacctgtaatcctagcactttgggatgttgaggtgggaggatcacttgaactctggagtttgagaccagcctgagcaacatagcaagtcttcgtctctacctctacaaattgttttttaaaaattagccgggcacagtggcatgtgcctgtggtcccagctactctagaggttgaggtgagaggatcacttgggtctgggaggttaaggctgcagtgagccataatcacaccactgcactgcagcctgggcaacagagcaaaatatagcacacaggccaaactttaagagtaacagtgtggcaaatgaacctatttactctttataaaacttgtattattgctacacaaagcttctttggaatttcaaagtgaagaattttcttaaaagaccagagaatctgttgggtgtggtggctcatgcctgtaatctcagaactttgggaggccaaggcgggtggatcactggagcccaggagtttgagaccagcctggccaacatggtgaaaccccatctctaccaaaaatacaaaaaattatccgggtgtggtggcatgtgcctgtaatcccagctactcaggaggctgaggtgggaggatcacttgaggcggaggttgcagtgagccatgattgcaccattgcactccagcctgggtgacagagcaagatcccatctcaaaaaatgaaaaaaaaattagccaggcgtggtgatgtgcacctgtattcccagctacctgagttcaggaggctgaggtggaggatcgcagtccaggagctggaggctgcagtaagttataatcataccactgcactccagcctaggtgacacagggaaactctgtctcaaaaaaaaaaaaaacccaaccaaacagaaaaacccaccagagaatatatatcatgatagcttgcctacttctgtcaaggagcattatttctattcaaatgttatatttggcattaaaatcacaaaaagtcttaaatacttatttttaatacctccctatctctttaccatctgcctctccccacctactactttctgggaaaccactgcaaatgatttactttgtgtcctttttgaagttttttctgtacatttacgagtgtgtgcctgtatttggccggatgtgtgattattagacaataattagatcaccacatatgattattagacaatgtttctgcctatttagactattggtatcaccagatacaagtctgcctagctacaatgtgataatgccttttgataggtcctaggaaatattcagcacaggaagtaaaacaaaaacttccccttaaacacatagaattgcattggtatattccttcagaggcaggtttaatccaatcctctgaagtggaggtctgggtgtatttccagcatcaagttctactgttacctgaaatattttagatgattgaggcaagggttcttgttttttcagtcatgatattaactgaatcatgtttgcattctactttcctaccctgatattcctactgtaatattaactgctctaatatttcctcctctaatattaatctaatagtcccaggcactgtggtttatatgaaaacttgttgagtctattggatggagagaaatctgggtgcttgaagtagattacaggctgaaagaacctaagattctaccatagttagacaagccaagaagtcaataagcccaaggaagcataactttaagttccgtaacttcatccttaatttttcctgatttgctgaggtatctccattcatccttgctcacctactaatacctagaggatccctgcagccacctagagctgagcccatcttcataattctctcttgtggcatcagactcttgtctgtgatttcattttatgaatacgaataaagaacaaggctggaagagaaagatttaatagcatattttgctgaaaatgtgagcaattaaaatgggctgacccgaatgtcaaagatttagaatgtggattgctgtggagagaagttctacctaataagtgcagttgacaaaatgaggaatttttttaggacaaagggtaagtttaggaaaaacaacatctgttgtgagtatctgaaaataatgagcaaaggaagagagaaaaggacaaatctacatcaagtcctactaaaccgagatgtgcatctgacccgtgcatgtggggaaatcaataaaattagagcaaagtcatttctcaattttcatagatgagtgtattctttcaaaaattattaggtcctgtaagaaaatcaattttctgcatttttctacaggaaattatacttgattcaatgtaaaaaggaaactacaggaagaaaatgaatatgacagtattgagatcatgtgagaaaaagagaaggaaatgcgtgtgtggggtgtgtgtgtgagagagagagagagagagataaatagcacacaggagtagtaggaggggcagaatgaagggcatagacccttatcatatcataaaataaagaatttttaaagaacaaatccatgtcacagagaaactgtgaaaggtaatattggaaaaatatcctatgtgcttacttagttagaatctactataatggtttagtacttaaactgtttatttttccacacctgtaaagatgatacattatgtttggtttaatgattctgggtgaagtacagctgccctgtgcaaacacttggcattttatgcatcaccaaccccaggggcaagtcacacctttctgcccttaaatccttgcaggggcagccaagcctggagccttccccaagagagttgaaggtggaggtggctcgtacttaggataagattcatagagtccaagaaggagcaaatgcgatcccctctgtgcaggttgattcccttctccccgttttgggtgttttcccacatagcatttctggttaaagccctttagattcaacttagattaaaaatggaacaacatgagacaccctcccagggctcattcatctcctgccctgataggcttgttggattttagaaaaatactacaaacatgacaaatagttctgtagtataagtgtttctcatgcaatatttgggatatacctatccagcagaattattcactctttacctgaaattgaaatttaactggacgacctggattttatttggcaactctattgcttgagctctgggagcctccagagtatctgagaagtgtcttaggagggcagaccccatgtgtgtttggagtgaagagcatgggacaggcgctgatgcaggaagtgtaagtaaaatgacaaaaacacgcaaatctgacaggtgagaagagaaaaaccattccaagtctcttgctactttatctgcaacaccgtttcctgaggcggaaggagtgagccaccagccctttccttcccgactgttctcctgagagcaccccttgtgacttctgggccaggatctgcattttacatatttaaggagcgatttcagctggcaggcaatgagttcatcatacagaagaatggaccagacactgggaacgggttgtgtgttgggtgggggtggtgaaaatgggacacaccaaaagacatagtgataagctacagggacagggcagaccttccaaatcacacttactgcatgaatgcaaacacatacaaacatgctcatggttgatttttcaaaaatatatatatttttctcttcataaataactctcatttaatttattaacctgtggttgttcttggagaatttcctagtgagcaagaatatacggacatctaccatctctggtctggaggtagccagccagggtctgagctgctgggctccctgctgagctgcttggccaacgcaaggtctggaagcatctcttctcctaacactgagatttcagtctgcggtggtcaagaatgaactcctcttgtttaacccatatatttattttaaataaaattatcacctcaattccatatatctagttagaaggattttaacttggatttgaggacctttaaactcttaagcctgcggaagttctagactgaatgataattactgacatttgatgcacctagcactaaaatggagtgatacaatattctgacacaggcttttctttccaatttattcatcattatttatcttgactctaagtttgatgatcttcttgtagaatactctatattgaagttatgctgagttcaatcataaagttaagcctagttagacagtgggattttctttttggaacgcaaatgttatatatatatatatatatatatatatacatgtttcatatgcacgcattgtcatatatagcccacggtatatatatgtttcatatgcacacattgtcatatatagcccacggctatattattatgcaggttccagtgtcacagaaactcgttaagcttttctgtgtctccgtgcctaaaatctactgacaaaaatacagtttaaccacacacacacttaaatacagtttagtgggaaaaggaggtgctatttatacaggatagatcgaagttttaaaatagtgaaataaatctgctttctgttaaaataaaactcataaaatgtgcgaccaatattactgggtcatccgtttcttcttattttctcacagtgatatttcaggtcttttgggatagtcactttgtggctatcttggaataaaacagtcatttcaattctgtgatgggtcataagcagggtgtctggtcatttagggtcacagccctaaaaggccgagcctaattattgggagtaggagctggcggggatcggctcctaggacctgtgtggggatcttggaagtccctcccctctgggctgtgctgtccctccctcatggtgccgttgttgcagtttcccctgtggatgccagagatagagatgggaaagaggtgtgggagagtggccagaggcggggatagaggcagatagggaaggaaaacctttggtttgtaggacatgggtggtatcttgttcctggcaactatgtgtgttgacagcaagggcacagtctttggggacagtcgtgccatagccagcacaggggccaggctggctgagggcccgcgcactcacccgtgctgctctggatggtcctaacggtggtggtggtgcgcggcggcgaggacgacctcagggacacgcactcgtcgtcctgggagcagcctttctcaatggcccgcacatagctgtggctccgcatgcggaagcagccgggcatgggcaggtccagcgcttccacggcctgcgactccagctcgctgaacacggactcgcacacggactcgaactgcccgttcacttccatctcgctcacctgcgggcagacacaggcgttgtgacactcgcctccacctggtggaggatcaacctctccaagcatctgcgaacttcaatccccagaagaaaaagcagcgtctggttagattaagctcaaatgcattttatttcctttctgttacaggctataattgaatggcatccgcttataattccaaacaatagattactttttttttcttgtatttttagtagagacagggtttcaccgtgttggccaggctggtctcgaactcctgacctcaagtgatccacccgcctgggcctcccaaagtgctgggattacaggcatgagctaccaccaccagccgtgattacattttaaagaaaaaagggcaccgtttgtagaacgcaaggaaatgtggggcttattccaacgcatgacattcttatttataaaggcaaacttggagaagaattttaccagtccattgtcagagttcatgtattttggtatcactttttagcacaaacattttagaaacgagtatttttacagtgccttttgaagtgactagtttgtcaaataatttcagtgttaagcttaatttagtgcaaggtatggaaacatgccctatattttctggcaagatactcacgttttgcacaaaaatagactaaactcagatatgtcaaaatcttgaaaagcaccatcaagattttcaaactatttacaagtttcagtcttctttataaaaagcccatatgggctgactgttgtggctcgcacctattacccagcactttgggaggctgtggcaggaggatcacttcagcccaggaggtcgaggctgcagtaaggcctgattgcaccactgcattccagcctgggcaacagagagagatcttgtctcaacaaacaaacaacaacaacaaaaaacctgataagattcataaattattaatgtattttaaaaaaatttgctacagaaatatttggcgtaattggaaaaaaatctttgaaatgggggccctctttttttgacgaataagtttttattgatttatattcctcctgtatataacttacattaggtttgagccccacttaagaaaaaatattcctgactagatgttccagtcaacttctcactttttagttgacttgctagagatttgggagcatttctcaattttctgttaccttccaggacatcttatctctattttcctaatatcaaattcatgaggcaccgagaatttaacaaattaaactacaattacgttttgaatacttactgaaaactattacaatttttggctgtctcctcattttgtattatctgaagttgtgctccagtaatgactaatttctttaaacttcagataaaagtgaccaattaccttaaggcatatcaatagaaagagacatacactttttaataagaattctttacagtttaaaaatgctattttcacagtctttatctaatttgttatgtgaaatccctgcatattttccaggctaataactatatgtgtccatattagaaagttatatctctatatatccttgtttttaaagaaatacatggacacacatttagaggtaaaggaatgtatctgcaactatcaaatggagcaagagagacaaagagtgagcaagtgagccaaaatctcaacaatccatacatttcaatctgggtcaaggatatacaggagtctttgtattacatgtgtgactcttttttaaggttgcaattatttcaaagccaaaaataaagcaaatatatatgtgtgtatgtctatatacatctgcaaatgtatgggtgtatatatagacatatatataatatatgtatatgtatataatttattcatttttccccttttaatcaacatgccaaactttacaaagagatagcaaaatatttctgtcaaggtaacaaccattaaactcggatgattatctttccagataagtatatatgtcccctcttctactttgtataaaacttgaatcatatagtaaatataattctgcaacttgttggttttttacttaaccctctaggttaaacttatattcttttctttttttgagataggttcttgctctgtcacccagggtggagtgcagtggcacgaacaaggcttactgtagcctcaagcaatcctcccgactcattttcctggatagctgggaccacaggtacgcaccaccacgcctggcttttttttttttttttggagagacagggtttccccatgtttcccaggctggtctctcaaactcccggtctcaaaccatcctcccacctccacctcccaaaatgctgggattacaggtgtgaactacggctcctggctaaacttatattcttaacagaattcttcttcattcccttttatccttttattttcattatacacagatacagaaaaccatacaaaataaatatagaacttaatgaattataataaggcaaacatcctggaaccactacccagatcaagaagcaaaacttttctggacaccctagaagccctccacatgcccccatattcacaatctccactctccctctaatagtgcttaactagtaccctgagttttattgcgttcacttttgtgcatttctttatgttttatttcacccaagcgtgcatccctgggctctagttagtcttacccattttaaaaatctgatacactttaaaattcacctttaacatacacttattttgacttatctattgagcatctagattgtttgccccatagaggttcccatagtctgggttttgctgatttcatactcatggtggagttcatcatgttcctctgcattttgtattgcctgaaaattggaatccagattcagagatttgatcagcttcaggttcaatctttttggcaaggctagaggccatgtgtttatttcatcaggaggcacattatgtctagtttgtctctcttctatgttgttaggagttatctatgctcaatgtctagatttgttaatccttgggagctgcaaaatgcaatattctataattacttttataactactagttggaatattctctttcacattacttgtttacttaatgatttagttcatatagaatggtaggataaatgcttgatttgtcttctttatttactaattttcaagataaatttgttctctcttatattccatatgtaatcgatttttaaaaaatatcacattaactcatagatttaaaaatatttgatggttttaagtcaattgaaataattatccttaatgaacttaaatttgtcccatctttggtcagtgggagccttttaggttggtttgggggtctttttgacatgaaagtagtaatctttgagaacttctttgatatctggtatgacaaggtattctaaactcaacttaaacctttcctgcccagtcctggaatcagtatgtttccaaaaagccctttctttttttagtgggaaatggtattacaagaacacaatctgggtactagggagatatattgtcattgctactgggttaatcattgttcttaggccttttcagtgagaagaactaggatataaatactatagggttcttatgtaacctcttctatatatgtttattcttagatctttattccatactaagaatcttggttctcaaggacatgggagatgatggaattggaatattctataactatccatttgctttaacccatagtatatgcacagaaaacattatcagtactacccctgcccacatatgattaaagagcaaacaattttattttacatgtggtccctctattcttttctcatttttacatagttgtgctatatttacattgtcagagcaaataaacgtattatgctccccaaccagtgaacgctcatttagtcttagttctacaaataattgtgtttaatgtttgccgctacaggtggtccatgacttatgatttttctgctttatgatgatacaagattgatatgcattcagtagaaactgtactttgaattttgagtttagatctttttctgggctattgatatgtggtatagtattctctcgagattctgggtaggtgctcagccatgcaattacaagggtaaacaactgatactccaaagtgtactgtgttgccagtgttttttggatattgtggggtttttttgttttgttttcacatcccaccatgtttacaaaatgcccatttttgacttaaggtattttcaactcacaatgggtctatcagggatgtaatcccgttgtaagtagaggagcatctgtagttcttatgtctggtcattttggttgtttagagctcattgtctagtacatttctcagaatgtgttcatggaatcaatatttcctgcgttcatccatgcttataacagtttgtatgttttatacttgaaagtcagtttttctggatataaaaatctgactcacatgtttttccttgagtgtattaaaatgctacacacatcattttcttccagcataaaccattcctgttaaagggtccaatgataactcagttttcattttgttaagtaagttgttctttctgtccagaaatccaaagtgtttttaaagaaattctttaaagtcttgtaattttacaagaatatgtcctgatgttgattgttcagggtcaatttctcaggtacatggtgtgtttacatggtgtgttcttccaatatgtagcttcaaatcaactttttatttcaggagagtttaaaaaaatcattgtttttcttacttgttctgttcctttgattttcttctgaagggacttctattatctgtatgtctaatcttttttgtctgtttttgatatttgtcaatttctctttttaactcttcatttgtgttctctctctctctttctctctctctctctctaagagatagggtctagctctgttgcccaggctggagtgcagtggtgtcatcatagctcactgcagcctcaacctcctgggctcaagctatcctctggcctcagcctcctgagtagctggaacaacaggcacgagctactgcactcagccccatttctttttgattttaaaattttccttcctttctagttcctttttttttagtgtatttttacctttttgtagattttactaacctactttctaaaacatagcagtttacagtccaaacagcaagtaatacagagttcatttctcaacatggtcaccagaatagaatgttagctcagtttttgctgctctatgtcaagaatgatactgtgctgttttgatttacatcctacaaatgtgaataggcacctgtcactttatttactggcttttgacttatttactggcttttgtatttttttctctgattatttttatttataagctttgaccaagattcttttgggttatcttttcttactaatttgtagaaatactttaagcaactataacatttaccctttttgttaatgtgtgtcaatattcctcccaccaattgtattttaactttatcatatattttgccacacagaaatatttaattttatttagaatagatcttttactttatattttctagaatttgtattttattacaagtaataattctgaccacaatactatctatatattctcctaacatttattttaatgcattttgttactttgtgttattgcttagattttaaatttacttagatgtagtttttacatgggatgaagaagaattttagtgttccttcaattatatagtggacaatttgcttgaattctctgagcttcactttcctcatctgtaaaataagtataataatacttatctcataggagtactttaaggataaaaataaaataatgtcaaaatgcgtattttttttggagacggagtctcactcttgtcacccaggctggagtgcagtggcacgatcttggctcactgcaacctctgcctcccagattcaagcgattcttctgcctcagcctcctgagtagctggaactagaggcgtgtgacaccacgcctggctaactttttttttgtatttttagtagagaaggggtttcaccatattggccaggctgatctggaactcctgacctcatgatccatccaactgaggctcccaaaatactaagattacaggcgtgagccaccgtgcttggcccaaaattcatattatatgtctaggtatatggtacacactccataaaaggtggatattattttttgtgatagtgtagtgggaaaatagtagtaggaaacaaatatgttagtccaactctctgagactgagattcataaattaaaaaatgatctttcttacaggacagatgtgaaattaattagataataagcaaggctactagcatgtatcaggtaatcataaaacggtaactaattattccattgttattctttctactgttaatactactattactagcaatattattgccaccaataccagcaggtattgaagtcatttaccagttaagagtcaggacacttgggtttcctagcctctgtcactgactggctgggtacccacagacaattaatttatctaggtttccatttcattctctttctctctacacacacacacacacgcaagcacacaccatgccacatgcacacacacacacataatgaggggatggcctaagtcaaagtcacggctgagctgctggtattaaaacagctgcctagttacattaattttagaaaaggatgtagaaacccaacatgttgccagagaaaatatgtctgcgggcttctagtttgccattccagatgaaaatacctaggatttggacttgaaataaataaagacataaattaacttggaaatgacagtgactacatgacatatttttaaaatattggactttctataaatacaattctttcttctcaagccctactttaaaagccctcattttaaattagatgtacctatggtaaaaatataaaataataaacataaaaacatacttaatttttttccttatcatccaagcacaatctgtttttagggctcttttactgctgtgagtaataaatgacagaagcaatttagtttttctagaccaactccttggtgtactcaactttctaggagcctttgatgaataatgtgtcaggttttaaagggaaataagatataatgcacttaaattctatagtattatagcttctactaatgatctatttgagaaaatagctctaacatcttaaaagccaacctctttttgaaaagtctagggtatatacagtagcattgctttgaagaggaaactattctcctttgaataatgacaatgttgcaactacaacaggacgtttgaaattatccttaaagatactgtgttaccattcaaaagctagcagaaggcaagaaataactaaaatcagagcagaactgaaggaaatagagacacaaaaaacccttcaaaaaattaatgaatccaggagctggttttttgaaaggatcaacaaaatagatagaccgctagcaagactaataaagaaaaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcactagaaaaagagggaatcctccctaactcatttgatgaggccagcatcattctgataccaaagcctggcagagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaagccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagacgacatgattgtatatctagaaaaccccattgtctcagcccaaaatctccttaagctgataagcaacttcagcaaagtctcaggatacaaaatcaatgtacaaaaatcacaagcattgttatacaccaacaacagacaaacagagagccaaatcatgagtgaactcccattcacaattgcttcaaagagaataaaatacctacgaatccaacttacaagggatgtgaaggacctcttcaagaagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcatatggaacaaaaaaagagcccgcatcgccaagtcaatcctaagccaaaagaacaaagctggaggcatcacactatctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgcttggaaaactggctagccatatgtagaaagctgaaactggatcccttccttacaccttatacaaaaattaattcaagatgaattaaagacttaaacgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgtacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagtcaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaaccagaaataccatttgacccagccatccaattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattgaaaatcatcattctcagtaaactatcgcaagaacaaaaaaccaaacaccgcatattctcactcataggtgggaattgaacaatgagatcacatggacacaggaaggggaacatcacactctggggactgttgtggggtcgggggaggggggagggataccattgggagatatacctaatgcaagatgacaagttagtgggtgcagcgcaccagtgcggcacatgtatacatatgtaactaacctgcacaatgtgcacatgtaccctaaaacttaaagtataaaaataaaagaaaaaaaaagatactgtgttacttgaaaattgaatatggaactagaaaaatgatgtcattaggaatccatttcagctggccattctttctgtattttacctaaggccgaatggctacgtcatggaattgcagtgcttgacctgacagcattacttctcccatgtgtctgtgcaatgatttgttggtatcttactaagctatcattagaaagtgatgttgccctaaagaaggtcaaatgtgcagccagggactaaaaacagtgagctgcaagggtagtgtgctgctgggggaaattaaaagttctccataaagttatgaaaaccatgaatgtatataaatatttttccaacagaatattttaaatccactgatgtattctgcatgtatgacccctaggtttgtagaccattttataattctcaatgactgtgtgacctttaggccatgcagaataaatatgtgctccaaaaagttttaaatgttatattacctattgtgaaaaagataaaaacaaaacaagtccaaaatgcaccaaaatgaggctccagctatttccctgagaattgggataatgtatatcattggacaagcagtaaccagcacgaataggtttgcatgttcttggagatttctgtaaagcaaggaaacacacgatgggtcagcactgaaatcccacatgacagctttccctggctccctccctactctgcccttggagcctgccctgcagttcctgatttttttcttcaggactccatttagagcagggagcttaattttgttgatagggacagaatgagagcagtgtccctatttcagggtcttattttgacagatgtttcagtgatcagcctaccatttcataattttttctgaataccttgttttcatctataccagcaccacaccatagcatcactatcaccactgtcactgctaccaccatcacaatcacgaccaccaccaccaccactgtcaccatcactatcaccacaatcacaaccaccatcataaccaccaccgccaccactgtcaccattgctattaccataatcatcaccaccaccatcacgaccaccaccgccaccaccgtcaccatcacaaccaccactgccacccattaccaacaccaccaccaccatggtcatcaccaccactgccaccactgtcaccaccaccaccaccatcacatcaccaccaccaccaccatcacctcaccaccaccaccaccatcaccaccaccaccaccaccatcacctcaccaccaccaccatcaccaccaccaccaccaccaccatcaccatcaccaccaccaccatcaccatcaccaccaccatcaccaccaccaccacatcaccatcaccatcaccaccaccatcaccaccacatcaccaccaccaccaccaccaccaccaaatcaccaccaccaccaccacatcaccatcaccaccaccaccatcaccatcaccaccacaatcaccaccaccacatcaccatcaccaccaccaccaccaccacatcacatcaccaccaccaccaccaccatcaccaccaccaccaccaccaccaccacatcaccatcaccaccaccatcaccatcatcacaatcaccactgccattactattaccatcactgtcaccaccatcaccatcatcactgccactaccatcaccattaccatcaccattactatcactaccactaccactgccatcaccataattaccaccaccatcactaccaacaccatcaccaacatcaccaccatcaccatcactatcatcactgctaccaccatcaccatcaccaccatcgccatcatcaccatcactgccatcattatcaccaacacaccaacatcaccactatggtcaccatcaccatcagtaacattaattctcaccttgatgatcacagtgtcttccaaactagcctctctgcttctagcttctcattctctccaatctttcctatgtttttttgccagattagttatcctatgtcaaagttagattcatatcccttgcttgtttaaaagccgaagttttctttttctttttctttttttttaacagagaaagagtcttgctatgtcgcccaggctggagtgcagtgacgtgatctcggttcactgcaacctctgcctcccagtttcaagtgattctcttgcctcagcctccagagtagctgggatcacagatgggtgccaccatgccaggcttacatttgtatttttgatagatacagggtttcaccatgttggccaggctgatcttgaactcctgatctctagtgaatttccaaggaccctcttcattgtgctttatccacttacagagggccccacctcctggcagaccattgataccgggggcttactgcggctgaacccatggcatgctctttgcagcacttgactggacctcctgtctgatccatcaatggtctactggatgaatgactgcctccccacctcatgccctctcaattctcactaaccttcctgccactaatggctcctgaccaccgctgccctgacggccctcacctggctgatggtgctcatggctcgcatgtagctctcattcctggagcggaactttggtgatgtgagcaagcctgcagggtccaggctgtccaggctccggttgatggagacttcactcactgccctcaggtaactatgactccggatctggagtttgggtgagtgttcattggagattctggaagggaacaatggaagaggtgcattagtcacattccaaaatgcaggaagcaataacatgtggcactattgtcatttatgtagcaccctaaatactgggacaaatgacatagatgcccttctgtgattactaaactcccccacagtgtctcagaaggaagagcttttgacaggaaatcatcaagatctgatgacattcgagagcaattaacattctcttcaaccatgaactaattgcctcattcacatttttctagccatcctaggaagcagataataagcagcaattgtcctgcccaggaattctgacttgtgtaatttgtaaagcttttctttgtatctatttctttcctgtggccatctttttgtttttggactgtttggtaacagtaagtgggtatatatctatatctatatttttatctatcaatttatcttccttccttccttccttccttccttccttccttccttccttccatctttaactctctaatatagttgaaattgaacttcgtgaacagaacttacaccttagccattaaaaaggcacaactctcaatctttatatgtaaagacaagtcactacacactttgtattctttggatttattctaggatgcattgtaaaattataaaagtagaaaatgctaattgcaaatagccaagctatacagatgtgcacaaagtagaaggtgggtccctctgtctccccttgttcctgtctgtagaattccatacccttaaaagaactactcatagcagtttggggtatattcttcctcagtccttctattcatatataatcaatttaatgttagttattttatttaattttaattttttttttatttttttgagacggagtcttgctgtgtcacccaggctggagtgcagtggcgcaactttggctcactgcaaactccacctcccgggttcatgccattctcctgcctcagcctcccgagtagctgggactacaggcacctgccaccacgcctggctatttttttgtatttttagtagagacggggtttcacagtgttatccaggatggtctcgatctcctgacctcgtgatccgcccacctcggcctcccaaagtgctgtgattacaggcgtgagccaccgcgcccggcctttattttaatttttgagacagagtcttgctctgtcgtccaggctggagtgcagtggcatgatcttggctcactgcagcctccgcctcctaggttcaagcaattctcatgcctcagcccctgaatagctgagacaacaggtacacaccaccatgcctggctaatttttgtactttttgtagagatggggttttgctatgttggccaggctggtcttgaactcctggcctcaagtgacctgcctgcctcggcctcccaaagtgttgggattaaaggcatgagccactgtgcccggccaatgttagttatttttaaagtttcttttcacatggtattagtgcgatttttctttctttattagatttctttcattttggctgtaacattgttcctaattaaataaattaaagttgatagggaaaaagatgtatgcccccatagccgctattatttatcatcctagccagtgaaatcagaaaattttgaaaaataagtaatataaacattgtaaagagataagatttgagtatttatagattatgtaatcaattatctgtaaagtaagagaaaatcatctgaaaaaccatgagaacttttaagggaaatcctcaaggtagctagatacaaggtaacaatacataaattaacagcttttccacgtaacatcaaataaaattttaatgaaaaaaattccctttaaaattgcaaaacataaaatacacagaaattacaaaaaagaaacgcatcaaattttatgaagaaaatgataaaatttatggaaggcactaagtaagtgctaaattaatgcaaaaaacccccacaacaattttcctgtaaaaaaacttaaattttccctaaatttatctataaatttaacgtaattgcgacaaaaatctccatgtcaattttaccttttttctctttttgagatggagtctcactctgtcgcccaggtggagtgtagctcactgcaaccttcacctcctgggttcaagtgattctcctgccttagcctcccgagtagccggaatgacacacgcacgccaccgcggccggctaatttttgtatttttagtagagatggggtttcaccatgttggcccggctggtctcagactcctgacctcaagtgatctgcccaccttggcctcccaaagtgttgggattacaggcataagccactgccccataaatctccatagaaattttattcaaatgtaacaaactcattttaaagtttatataagattcagagcagcattattcataacagacaaaaggtggaagcaacccaaatgtctaactctgagtagatgaaatgtggtaaatgaactatttgactaaaaaaaggaatgaagtattgatacatgctataatatagatgaactttgagaacatcatgctaactgaaagaagcctcatattacaaaagaccacatattacatgattctacttacatgaaatgtccagaataggcaaatcgctaaagatagaaagtaggtgagtggttgactagagctgggcggggaaagcataggaagatggtggcattaggaagtgatatctgaagggtatggagtttctctttgcagtgataaaacagttctaaaattagttatagtgttggttgcacaactctgaatatatgaaaatcattaaattgtacacttgaaaatggtgaattatatgttatgtgtattatatttccacaaaaccgttgtaaaaaattacgtgagtcctcaaaataatcagatttccttacggagtttagagggtagactaaactgggcaatactagagaaagaaggccagttaaggtggttgcaatgttgctataatctaaacaagggaaaagggctcagttaagtattagtggtagtagagaggaagagatagatttgagaatccacacgaaaattaaatgtggttgatgagtaaggaggtctaaaggttctaagaacagccagaaaataaaaataaataaaaaacaaggggaggaatgccctttatctgatctcagctatattttattttttatttttatttatttttttgagatggagtcttgctttattgcccaggctggagtgcagtagtgcgatctcagctcactgcaatctctgcctcctgggttcaagcgattctcctgcttcagcctccagagcagctgggattacaggaacatgccatcaagcccagctaatttttgtatttttgtagagaaggggttacaccatgttggccaggctggtcttgaactcctgacctcaagggatctgcccaccttggcctccccaagtgctgggattacaggagtgtgccaccatgcccggcctcagctatactttatagctgcaatgatgaaaatgggtcatgttagtaaaggaactgacaaagcagtagaatgaaataaggactccagaaacagaactaagtatgtgtttgaatataatatattgcaaacgtggcagttggaataggcaaggaaaagatcaagtatttaataatggagttagaccttttttgcctccacttggggaaaaatgaattcctactaagcatatagatgaaaaataatattttaaaaacttaaagttctccaatacaatatagattatattttataatctcaatttctatacttaaacaatttaaagagaaatttatcaatgttttatgaataaaaaaacctataaagccttatggaaggcaataaagaaggcctaaagaaatgcaaaggaatatggtagagaaagactttagaagcatcgtggtaaacttagatgccataaagagaaaggttaatgaatggaagtacatgaaaatttaaaacttttgttcagccaaagatcctgtcaacaatgttaagaaaaatagtcattgtgtataagaacatatttgcaacactaagcagcaaaaagggttcacatgcataatatttaaattatgaataaaaataatgaaaccaacacaataaaaaatggtcaaagcctataaagagggaatcataagaaaataaatatataaattcacaggaaagtaactttatatatcaccaagcatatgacaaaatgctcgatctcactagtaattagagaaatgtggattttaaaaaacatacatttacacattacattcatgtacatccatcttgatgtcctcaaattgtaaagatattccctatattctaagtgtcctcttagtagcattgtgtacgattgcatctattcttaaagcttgtatggaattacttaatatataacagccaaaaactattcttaataatactaaaccctgagaatgtgataagcaaccactttttgcagctgcactgagggagaaaccaaattaagacagatctagaatataacatcgaaagtaaatctcttattgcattttactgttacaaaagataaactaggctgggtgcagtgtggctcacacctgtaatcctagcactttgggaggtctacgtggaaggaactcttgagcccagaccagcctgggctacatagtgaggccctgtctgtattttttaatataaaaaagtaaaagaaaaaaattgttctagaaatgtgccctatggatccttcaagtagtggtcaaacatgaaaatagtttgccaggtcaaggtaatattttccatgtgttacgtgctattatggtgattccagctgcatcgctttataataccaatgccaaaaatttcaaccaacaaacaaactgaaaaattcgttttccttttaagatcttttttagaaaaagagaatcgtagctggaagcatttataacctaaagttcacttctctttagaacttgcgcattagatgacaaatgtgtttctttgactattttgcaacctgacccagagcaatgatattgccaacataaatgatgatgccattccaaatgttatcagggcagtgacgggagtggctgtttcataaatggtgtatattcaaagaagaagtgaaagtccggcgttttgaaaaatgagcgtctgctggctgaatggggaaatgaggcatcattgcaacaatcattcactctggccactcgttatgaaataaggcacaattcccaaatttcaaagtgaaacatcattcagaaggaattgaatagttcttctctggtgagtcattcctgataaaacaatgcatacattaataacacacaaaatataaggaaatgaactgttttatcttgcccacttatagaacagagccctccgctatcaatataaaggttactatatgcccatgtgctccggatgcagaaacgctcattaaataaacaccaaaatagtgcatcgatgactttgtctttacctcaaaagaaagttgatctgctcagaagaaagacagtgtgcatattcagaaacattaactctctcatgttacgttaattatttccaatgttggtctaacgaaatggcactcttctttttccatccttctccctaaattacttatgctaagttaacttttcctagcttatcagaactaaagggagattttgattttttgggctgggaggtcccattcattatcatgactttaaagtacaaccaataatgggaagttcttaggtgacagtgagccaaccacacaaacaagcttgaccctttgtatccggaaggctgccattgcgaagaagagcgtgtacagtaatcatcagaccacaaagttttaaaccagtgtctcaaaagacaaaatgactaactttgcaacatattactggaaataacttcagatggctgggatgctttttcccccaaagaaggaaatgcttccaggttatggagtctaatgggagaatctttggaggtgatggaccatcttatggagccatctgcaccctaagttttgttcattttcacgttgtcttctctctgacttacaaaagtattggaatgtaaggctcttccatgggacccagaggaaacattttatggcctcaggaggttaatctaacttcattgtatttcaaaaatgaacgtatttggccttggtcatgacacttttatcaaatcatactcataaacattaatggcttaaactgagaggctttgatcccttgggctttggtgtggacaatggtacttagtaggtgacagttctctgttgaactagtttcagggaatcaaacacagggcattttagtagtcaatctgctttggtaaaacgaagcctttcttttcagtaaccttacctataatggctttataatccgtatagaaatgtaactttcattaaagttgtttacttttgtagttgcctcttgagttatttctactttataataatacctgacatttgttaccatttatccaatgcctggctactgttagataaagaaatcatgactttgagagatcacatagtgttgaaggtaattccaatggaaacttggccttttaacttccacattcctattctgtcttctccttctccttctcctcctcctcctcttcctcctcctccttcttcttcttctttttttttttttttttttttgacagagtctcactctgttgcccaggctggagtgcagtggtgcaatctcagctcactgcaacctctgcttcctgggttaaagtgattctccgcctcagcctcccaagtagctgggattacaggcggatgccaccacacccagctaattttttttgtatttctagtagagaggggggtttcaccattttggtcaggctgatcttgaactcatgacctcaagtgatctgcctgccttggcctcccaaagtgctgggattacaggggtgagccactgcgcccggccaacatctccttctatttcttggggaatccagcctggattctcatttgggttcctcttcctctaacttgcccttacatgcttttattccctaatactttataattgtttatattctgtttttattgtacattctgtttatggacaatctcatctcctcaatggcttctactaccaaccttatgctaatcactcccaaatctatttgtagtctagagatctcttgaacttcaaaactgaagttttaagtaactactgtacatttctatccagatgttccacaagtaccaaaaaattgtcatgaaccccaaatgaacacatacctttctcctcaaattttcttatttttttaatccacattgagatgaatggcactgaaatctacccagtcaaccaaactagaaatccagaaatttatcctgtctctttttcttaactgtccaaatccagctgataatcatattttcttgtttctacttcctatatacatttaaatatggtttcttctctctctttccttgtttccaactttttggatttggggttacatgtgcaggtttgctacatgaatatattgtgtgtgatactgaggttttggggtatgagtgatctcatcacccaggtagtgagcaccacagtacccaacagttagtctttcgacccttgtcccctccctccatcccctctctagtagtccccagagtctgttgttgccatcttcatgtctgcgtgtacccactgtttagctcccatttataagtgacaacatgtggcatttggtttttgtttcctgcgttaatttgcttcagatgatggcttccagctgcatccatgttgctgtgaaggacatgatttcattgttatggctgtgtagtattccatggtgtgtatgcaccatatttctttatccagcccactgctgataggcacctagattgattccatgtctttgctattgtgaacagtgctgcaataaacatacacgtgcatgtgtccttttggtagaaggatttattttcctttggatatctacctggtagtgggattgctgggtcgaatggtagttccatattcagttcttgcctctctctccttcagcacttcttggtctactgcttcctcagtccaggcttcaccttggttctcctaaccatgctcctatcatgagtcctgtatccttgaatgtatctctcttgtcctgctagttacttcgacactctcttacggaggctccttgggtgaatcctcttaaccacaggagaaactctaaactctttacctgattttccagtctcctcgtttgctgtttccccacgtgatcacgcatgccctcgcaagtttcatctttgcacacactgtttctatggcctggaatgctctccttcctctgctttccacccaccaaactcttcaactcattttagcaggtcactgggtgttagaacctctatttaggtcatttcccttcagaaggcctcctttgttcttcccagactaaagtcctccatctgtacccctatagtggcttttatacttctctgttacacacttttcccattgttgtaattattaatatttggttatacgtttgtgtactcttcagatttctgagctcttagaagcagaatcaatatttcattcattttgttacacagtggtacactggcacttaaatgtcttactttaattaccactaataacccctaacacttgagtgcttcctttatgccgggcactgtctttaaatcatctcatgaaatggatgagtaaataaataaatgaagagggtaactcagttgatcattattctagacctaaaatactttgctgtaaaacatttttcattttctttcttttttctttttgagtcagggtctcactctgttgcccaggctggagtgcaatggtgctatcacagctcactgaggcctcgaactcctgggctcaagcaatcctctcatttcagtctcctgagtagctgggaccacaggtgtgtgtcactacacctggctaattaaaatttttttttgtagagatggggtattgttatgttgccctggctggtcttgaactcctggtcccaagtgatcctcctgtgacccgacaaaattttttttttttttttttgagacggagtctcactctgtcacccaggctggagtgcagtggcacgatcttgtgtcactgcaacctctgcctcccgggttcgagtgattcttctgcctcagcctcccgagtagctgggactagaggtgtgcgcgtgtgccaccacacctggataatttttgtatttttagtagagacagggtttcaccatattggccaggctggtctcaaactcctgacctcgtgatctgcctgccttggcctcccaaagtgctgggattacaggtgtgagccactgtgcccggacttcttcttcttcttcttcttctttttttttttttttaatgagatgcagtcttactctgtcacccaggctggaatgcagtggcgcgatcttggctcactgcaacctctgctgcccaggttcaagtgattctcctacctcagcctcccaggtagctgggattacaagtatgtgccaccacacccagctaatttttgtatttttagtggagacagggtttcatcatgttggccaggctggtctcgaactcctgacttcaagtaatctgcctgccttggcctcccaaagggttgaggttacaggtgtgagccaccacggccggctcataaagttttattgtgatataatttatacacagtaccataaaagtcacccttttaaagtgtgtacttcagtgatttttagtatattcatagaattatgtaatcataattactactgaattttagaacattttcatcatcccctgatccaatcttatgcccattatagtcactctccattcttccctagcccaaatcccacatctaccccttgtctctatgcctttgcctgttctggacacttcatgtacatggaatcatacaatccgtggcctttggtatctgtcttctttaacttagcatgatattttctttcctccctccctctctccctccctccctccctccgttcctccctccctccctcccttccttccttctctttctctttctttcttctctctctttctctctctccactctctctctttctccctctccccctccccacccccctctctctctctccttcctttttacgatgggttctcactctgctgcccaggctggagtgcagtggcatgatcacagctcactgcagcttccaactcctgggcctaaacaatcctcctgcctcagctcccatgtagttgggactacatgtaggtgcaagccactgcatccagccctagcatgatgttttcaaggttcatccgtgttgtagcatgtatcagtacttcattcctttgtatagctgaataatattgcaccgtatgaatatacaccaaaatctgtccattcatcagttgatggacagttggcttgtttttatttttttggctattatgaataatgctgtaataaacaatcatgtaaaagtttttgtgtcagcgcataaaaattttataggaaaacatttgagataaatgagcaagaaactttacataagggggtgggacttctggaatgacagagaggaattaggttaacatattggcaaaacgattaaaatcaaccattcctgaactaagtaaccaaaggcagggaacgaacaaactcatttatccaagaaaaactgctgattttagataaaaacaatggggtctttggagatttaacttggggatatgcccattgccctgctccccggtgctggcatgctagctgtgaacagatggcagccttgcagccaacagagtggatgcacccttttggagctctgttgaaaccaccatctccagtgaacagttaatatttttactggtctcacatctcccctcgaaagcctggatcccagggcatcagaactatttgatctgattggaagctctgctctgtggaaaagccctatccccaggctgttattgaaaacaacaaagaacttggcccaaaatttcaaagaaagacctagggaacttgaaaagttctgatatattgctgagaatctagaagactttatgcatgttacagggatgtgtgcatgctgaggaaagacctgggaaaggaaaggagctccatcgctcacctgtggctgaccttgagatcctgcacaagcaggaagtaaatactaaggctgatttgtaagctgcctgaaatttggaagtatgccttcacatacagtttcccttagcaaaggtggaagacttgttggcttaaggtatttaaagacatattctgaccaatcattggctgatcactaaactatgctaatttcacagtgaacccaaggaagccaggcttaaaaatactgttgtccttgggaatctgtgggggattggttccaggactccctgcaaataccaaaacctggagacgctcaagtcccttatgtaaatggcatagtatttgcaaataacctatgcacatcctcccatctattttatttatttatttttgagacagggtctcactcccatcatctaggctagagtgcagtggcatgatcatggctcactgcagccttaacttctcaggctcaggagattctctcatctcagcctcctgagtagttggaactacaggcacatgccaccataccctgctaatttttttgtatttttagtagagatgaggtttcaccatgttgtccaggctggtcttgaactcttgggtccaagcaatctgcctgcctctgctcccaaagtgctgaaattacacgcatgagccaccgtactcagcctcctacttcaaataatctctagattacttataatactgaatacagttgacccttgaacaacacaggtttgaattgtatgggtccacttgagcactggttttcttcaataaatgtattgaaattttttttttggaagatttgcaacaatttgaaaaaagctgcagacaaactgtggcctagaaatattttaaaaattaaaaaagaattaggtatatcacgaatgcataaaatatatgtagacagtagtttattttataacttactaccataaaatatgtacaactatattataaaagaggggtggggggtggctcacacctgtaatcctaccactctgggaggccgaggcaggtggattgcatgagctcaggagtttgagaccagcctgggcaacatggtgaaacccgtctctactaaaatacaaaaaaaaaaaaaaaaaaaaaaattagctgggcgtggcagtgtgtgcctgtagtcccagctacttgggaggctgaggcaggagaattgcttgaacccgggggttggaggttgcagtgagcagagatcgtgccactacattccagcgtggcgacagagcaagactccatctaaaaaaaaatatgtattataaaaaattaaagtttattaaaacatatgcacatgaaaatttatagaccatgcatggcaccatttgcagtggagagaaatgtaggcaaatgtaaagacgcagtattaaattataactgctataattaattgtagttcatatcatactactataataatattgatttgaactagattaagataagatacatattgtaatctctggagtaaccattatgaaaataatttaaaaatatttagtaaagaaaaccaaaggattttttcactagaaaaaatatatataacacaaaagaaagcaataatggaggaacagaggcaacaaagagacacagacatatagaaaacaaatagcaaaatggcaaatctaaatcctaccatagaaataattatattacatgcaaatggattaaacttccctatcaaaaggctgagattgtcagactggataaaaaacagaatccaattctatgcagcctgtcagagactttcaattcaaagacacaaataggttgaaagcaaaaggcttgcaaaaatatagcatgcaaaaaacaaaaaacaacaaaaaaacaaaaaacaaaaacaaaacccaaaaaagaactggagaggctatactaatttcagaccaaatatactttaggacaaaaaacaaagttaataaagacacaaggggcgtcttataacaacaaaagtcttagtacatcaggaaaaatcttacaattataaacatatgcacctaacaatagagtcccaaaatacatgaagcacaaactgacagaattgaaggtataaatgaataattcaacaatagtagttagacacttcaatacttgactctcagcaatggataacacaattagaaatcaacaaggaaaccgaagacctcgaagacactatcaaccaaacagaactaacggatacctatagaacactccactaaacaaaaccagaatacatactattttcaagtgcactgaactatctctagggtagaccacataataggtcataaaacaagcctgaataaattttagaagattgaaagtagacaaagtatgttcagtaattataatagaagtaaactggaaattagtaacaaaaggaaattttggaaccgcacaataatttagaaattacactaaacattattttttttttttgaggtggagtctcactctgtcacccagactggagtgcaatggcacgatcttggctcactgcaagctccgcctcccgggttcacgccattctcctgcctcagcctcccgagtagctgggactacaggtgcccaccacgatgcccggctaatcttttgtatttttagtagagacggggtttcgccatgttagccaggatggtctcgatctcctgaccttgtgatctgctcgcctcggccttccaaagtgctgggattacaggtgtgagccaccacgcctggcctacaccacacatttttaaaaactgtaggtcaaagagaaagttgcaagggaaattacaaagtattttgaactaaataacaatagaaacccaacatatgaaaacttataggatgcagttaaaacagtagttacaggaaaattaataactttaaatatctatgttagaaaaaagaaattatctcaaattaataatctaaactttcaccttaatagtcttgaaaaagagcaatttaaatccagtgcaagcagaatgaagcatataatagctattatagtggaaataaatgaaatggaaagcaaaagaaaaacgaattagttgtttttgaacaaaagtaggctctttaaaaaaatcaatactttagcaagattaaacaagaaaaaagagaagaaacaaatgatcagaattagaaaaaagagaggaaacattatgactgacatcagaaagtaaaaagattgtaagagaatactgaagtcagcaactgagacaaaatagaaaaaaattctaaaaaaacccccaaattaccaaaactgcctcaagaagaaataaaaaatctgaatagatctccaacagctaaataaatttaatttttaaataaaaatctttccataaataatagttcaggctcagatcgtttcactggtggattatgtcaaacatttaaagaggtaatatcaatagtctatcaacccttccagaaaatagaggaagaataaatatttccaaactcaatccatgagagtagtatcaccctgagatcaaagccaaagatactgcaaggaggccagatgtagtggctcatgcccgtaaccccagcactttgggaggccaaggcaggcagatcacgaggtcaggagttcaagaccagcctggccaaaatggcgaaaccccatctctactaaaaatacaaaaattagcctggtgtggtggcatgcgcctgtagtcccagctacttaggaggcttgagtcaggagaatcgcttgaaaccgggaggcagaggttgcagtgagccaagactgtgccattgcactccagcctgggtgacagagcgagactccacctcaaattaaataaataaataaataaatggtgcaaggaaaggaaactacctactaatagccctcattaatatacacccaaaaattcccaacaaaacaatagtaaacggaatcccacaaaatacaaaaaggattacacatgatgaccaagtcagacatacttcaggaatgcaaggttggtttagtatctgaaaatcaattaatataatacaccatattaaggaaacaaaggactaaacccacaagatcgtctcacatagaagtagataatgcatttgattaaacccaacagctattaatgataaagactgaataaacttgaaatagcagaaaacttttttaatctcacaaagggcatttactaaagaccagcagggaatatcacacttaatggtggaagactgaaggctttttctataagactgagagagggtggacgcggtggctgttgcctgtaatcccagcactttgggaggccaaggcgggtggatcatgaggtcagaaattcaagaccagcctggccaagatggtgaaacctcgtctctactaaaaatacaaaaaaattagccaggtttggtggtgggtgcctgtaatcctagctactcgggaggctgaggcagagaattgcttgaactggggaggcggaggttgcagtgagccaagattgcactccagcctgggtgacagagcgagactctatcttgagaaaaaaaaaaaaaaaaagactgagagcaaggcgaggataactgttcttgtcacttcatttcagcatcattattggagtttctagccagtgcaaacaattaagaaacaggaacaaaaattttacataatacccaacgtattcaaacctgaccaatgaaatctggacactgcacaataagtcttggctttgtcattaactatttgaaagactgaaaaaagtgactttaaactcttgggattcagttttctaatctgtaaaatgagagagctcaaaatttctatgaagctataataacgggagcttcagtttacagtgaatctcttgatgatattgatcattattggccaaaattattcacagactatttttatttatagactcagggtctaactcaaagccactttctgtctgaagctctccctaatgcctgcgctccaaatgagtctcttctttttctgccctcttatggttgcttgcttgcacatctatttataagcttaacatggattatattgaagtcagttctgcatgtccttcttaacctggagatgtgaaattctcaagggcaggaatcacatgtcctccataacatccagcataagcgtcatgcatagttggattagtcatgcatatgactcatgcatatgactcctccagcataagcgtcacgcatagtaggattgcagatgcccgactttcttcctttgttccagatatttgcattgccggccagagtccctttacaaattttacgttttttgcaacaacacagttttccttaaacattaattttccttctgtttcttaggagtgtgacttcataaagggatctatttcaccaaccaatgtgccccatccgaagatctcagtttatacacagggacaacttctaaagtttaagatacaaattagaggaacaaactcctatagaccccttctatattcttgttcttcctccgtaaaggtttgacacggggcataaatgtcatcattatttctgggagacattgctattgtgaagagctgtagactttggtatctcctagaagctcagggttcagggtagggtgaaagggagttgagagaataatcttggggattcagttgatgctgcaacttattatttgctccatctatattgctctgccaaaaaaaaaaaaaaacaaaacccaacctgatttggttggggatttctgaatgctcaactggagaaactgttcaaaaaccacaggctcactatgtgcaaagccacatgctagaagctggaataacccattttagttatcaagttggctttatccaaaatgaaggtgttgtccttttcataataattcatcagacgtagaaattatcaacataaaatgcaattctttcagcgtgccaaatatgtttatccatcatatttagactcttgtggcacttggaacttaaatgttctttcctcagttatcaaggctatgcaacattagatttaaagcaatacaaaatgaatgccgactatgcatgacgcttatgctggatgtcatggaggacatgtgattcctgcccctgggaatttcacatctccaggttaagatgaacatgcagaactgacttcagtgtaattcatgttaagcttataacagatgtgcaagcaagcaaccataagagggcagaaaaagaagagactcatttggagtgcagccattaggaaaagcttcagacagaaagtggctttaagttacaccttgagtggtaagactgtcaccaggtaaaagtgagccagacatagtcattccagatccagggagctgcaagggcaaaaacctggaggcagaggtacaggcagcggccggggtgccagacactcaggatgccggtgtatccaaagctgagcctgttctggtcagaggcctattgaagtgaggtgtaatgctctgctggtcagtttcttcatcaaaacgtgggcttcccgagggcagtgaccacagctggcatcatgggaatacatcattgtaatccccaatgtcagcacagggtccgacatgtattaggcctccttatatgtttgttatgtaagtgtgtggggggcaggggtggtagggtgtgaagcctggccaagacattgtgacaagaggcccagtgggactgtgatgagggcctggagaaaatcagggaactgcggaaggaagacaggaggggcgacacagggccaatccaagaggaagcagttgagaggtcagacctgccgagttctgctcctgggtgacaggaggcaagtggcgacaccttttacctgatatctagagtacagtcaggcccaggggaattagtttctttttttgggagcagtaaggaaataatctatcttaatacttcaatgtgcctagcagagttttattgccagctggctggggatacagcaggcagtacagaaagaattgtttccaaagtatgccaggcaggagttttgggctacaggctgctttcatgatcgcaggaggtctgtgtgagaacgcggtcatacacatgtgggcaaatcactgtccagaactgaacagcaactaaagctaagtggggcacctcttccttctggtccagggctgccagttttataaaaacaatcctttgcattgcctcaaaataactcctgcaattaccttcacttaatttccatttgcgtaggaccaaattgatcaccaaatcaattacaacaatccagataaaaatgtgattttctgtggggggtggttccctgtagcataaatagttttacagcgggaagtttgttctggtggatttggctcttcaattcgttgaacactggttcatcagtctgagttttggttgggtccgtgacactgtgcaagccacagcttcctctttaaaacagagctaacaatatccaccttatggaattgtgtgaatttactgcgtaataaacatctgtctgtctctctgtctttctcgtgctcccccttcattgtggcaaaatacacataatataaaatccactgaattcaccattttaagggtacagttcggtggcattaaggatagtcacatttttgtgcaatcactgccactgtgcatctccaaaagttttttcttatcccaaactgaaaccctgtacccattagacacgaactccccgtttccctccctcccccagcctctggcaaccaacattctactttctgtatctatgaatttggtcactctaggcacctcatataagtggaatcatacaaaatttgtccttttgtgactgtcttatatttctcctggcataatgtcttcaaggtccatccacaatgtcgagtgtgacaggatttccttccttcaaggctgaatcatactctgttgaatgtgatttggtttatccattagccatagatgaacacttgggttgcttccaccttttggttattgtgaataatgctgtgatgagtacgagtgtatctgtttcagtcccttctttctttctttctttttttttttttttaagacggagtctcactctgttgcccaggctggagtgcagtggcgtgatctaggctcactgcaacctctgcctcccaggttcaagctattctcctgcttcagcctcctgagtagctgggaatataggcatgtgccaccacgtcgggctaatttttgtatttttagtagagacggggtttcaccatgttggctaggctggtcccaaactcctgaccctgtgatctgccagcctcagcctcccaaagtgctaggattacaggcgtgagccacagtgcctggtctcagtccctgctttcaattctttcaggtatatacccagaagtaggaatctctctttaacagaagaacttcgtcttttctatttcatttctcagtaattttgctactaacatttggggaccaacacaataaaaacaaaccatcatttcccccaccctgaggaggcactttgttgctaattcagtgccagttttaaggatgctaaataatatagtagtacttcagggactattatggccatggctgaaaatagaaaaatgatacttctattagttggtgaaaaacagtaatagaattaaaactcaatataatattgttgagaattcattgtattgccaagattaagacatccagaaaaacaatttcataagcagttagagattgctgaaagactgttgacaacagtatcagtttatgaaccagtaagaaaagaaataactttattgctaagaaagatgtagtgacagtttaaattgtaccaggcagcccacaatagtaattcttaggaagggatgtaagtagtgacctacatgctgctttgagctgaatacaatgtgtttctttcaattttgagagcagatgtacttacacagatgtaagctgacactgacaaattggagcagttaaagctagtgtaaaagtattttgatagatttttttttcacaaattgcttcatattctgacttcactttaggaattctaagagcaactaaagagagacccttaaataattcttttgatgttggttttcttctaatccctattgtcaaatgctctatgtctatctgaactcactatcagcatgctgaaaggtcacaaaaaaggtatctcttctatgtaatcgccttcaatggttctgaacacagcaatcatgtatcttccaagccttcctttctttaggtgacatgaccctccactcctcttatgtcaacatttccaggctctccataatcttgatgactcttttctaaagtcagacaaattgttaatttctctttgacaagaaggcaccccgaatgatacttcacctttcaaatgtggctgacaagtgaggaatacagaatggccattatcatccacattctgtaggaaatcctgctaggatgcagcctgggaaagctttggattgcatggtgtgatggttaatattgagtgtcaacttgattggattgaaggatgcaaagtactgttcctgggtgtgtctgtgagggtgttgccaaaggagattaacattggagtcagtgaactgggaaaggcagacccacccttaatttgggtggacaccatctaatcagctgccagcccagccagaataaaagcaggcagaagaacgtggaaagactagactggctaagtcttccagactatatctttctcctgtgctggatgcttcctacccttgaacatcggcctccagattcttcatcctaggactcttggaccttcaactacagactgaaggctgcactgtcggcttccctacttttaagattttggggcttggattatcttccttgctcctcagcttgcagatagtttattgtgggactctaccttgtgatcacatgagtcaatactctttaataaactcccctgtatatatacatctatcctattagttctgtctctctagagaaccctgactaacacacatggcctataatctcattttttacttctggtaagctctttttgggtgacttttagatcttctttatatcaaatgatgttaaatcatcccaaattttgatcctttgcttcagttaacgggaaatgaaaggcctatcttttttttttcttttttttttgagacggagtttcactcttgttgcccaggctggagtgcaatggcgtgatctcgtctcactgcaacctccatctcccaggtacaagcgattatcctgtcagtctcccaagtagctcggattacaggcatgcaccaccatgcctggctaatttttttatatttagtacagatggggtttcaccacgttagtcaggctggtcgcgaactactgacctcaggtgatccacccatctcggcctcccaaagtgctgggattacaggcgtgcagcactgcgcctggcctattctgtcattcttatgcaatacatgcatatatcacctattcttgccagttatgtgtagcagctaatgtgatgagaaaagcaaaaataacaaaaccacaatttactgagtgcgttacatggccctatgcatttaagtgctttacctacagtatcttatttatcacaccagtattaaggattattataacaattacgaagtattattatacctattttcaatgaggaagctgaagccgacaagtttgtaaactcaaaattgaaagctggttctaatttctgtagtcttaaccatcctgtaccctcccataagcatgtcatctatatccttactcaaacgctagcaaattattcactaagattgggcaaatcagtaatctcctttggtaacaccagtgatcagtgatcagtgagttggctcagtccgttaaccaaaaagctgtttaaccaactacatatgttcctattgcccaggcctcgtttgtttgtttttcctgcaaggtaattgtgatctactgtttccaatgctatcctaagtacagtcacattcctgtgatgtacctctctcaactaagacaaagagggaaatacgggtagttccatataccccttgttaatacatctatgctgttttcccattttcgaaatcatcccaaaccatcaattttaaagtttattttagaattttgcaagactcatatgaaggtaaatatttgcagtctaaaaaaatcttctcttcgggaaagtgagatgacatttactcttttcctggtacattcctcatggttcctaaaatatcaccaatagtaattgtgcaatcatatctgggttccttcagatggaaacaaaattttcatggctttatatgacttcttatttgtggtagttatctggtttttgttctaggttgagcttaggtgagtggcgtcaactttgtcagcttggaattgggcaggaaatgagaatcaggggccacagggaagaacaggggtgagaaaagcaacctcagtgggtgccagaggtgtagctgagtctgggcacagcctcaagtttgtttgtgtgcatggctgtgtttgttgtatctgtttatgtaggtggtggatgggcattccctggctgctttggaaggctcagaatctccatgcacacttgcaaacttttttttttttctttttttttttttttgagacagagtctcgctctgttgcccaggctggagtgcagtggcgcagtctcggctcattgcagcaagctttgcctcccgggttcacaccattcttctgcttcagcctcccgagtagctggaactacaggcgcccgccaccacgcctggctagttttttgtatttttagtagagatggggtttcaccatgttagccaggatggtctcgatctcctgacctcatgatctgcccaccttggcctcccaaagtgctgggattacaggcgtgagccactgcacctggctccacacttgcacacttttaagatttttacacttcatttaaactggtaaaaatgatgatgtcattagattctgataaattataatacctaaagctacccttaaaaatttgtacaaagagatatactcgggcacggtggctcacgcctgtaatcccagcactttggaaagccaaggcaggtggatcacctgaggtcaggagttcgaaaccagcctggccaacatggtgaaccccgtctctattaaaaatacaaaaaattagccaggcgtggtggcaggcacctgtgattccagctactcaggaggctgagacaggagaactgcttgaacctgggaggcagaggttacagtgagctgagatcacacctttgcactccagcctgggcaacaagagcaaaactctgtctcaaaaggaaaaaaaacaaagagatacactcaaaaacactataaataaaaatagaatcctgaaaaaattaagtatcacattggaaggtgggaaaaataaaatagggaaacaacagacaaaataaacagaaaacaaaataaaaaatggcagacttaagccctaacatgtcaataattgcattaaatgtaaatagcctacatacgtcaactaaaaggcagagattttcagagtgattaaaaaacacatctataagaacctcactgcaaatataacaatgtaggcaagttgaaagcaaaaggatggaaaatttatatcatgcaaacattaattaaaggaaaataggagttgctctactagtatcagataaagtacactacaaagtaaaaaaagtcagagatagggaagtacattatataatgatatatcatgggttaattcatcaggaagacatagcaatcttagatgtttatgcagcaaacaacagcatatattgaatgaaaaagctgatagaactgaaaggagaaatagaaaaattcacgattgtagttggagacctcagttactacctcccaacaattgacagaactagacagaaaatcagcaaggatagacaagaactcaacaactccataaaccaatagactcaaacagacattagagaacactctacccaagaacagcggaatactcattgtttccaagtgcccatggaacatataccaaaatagtccatatttggggccataaaaaaaaactcaacaaacttgaaagaactgaaatatacatagtgtattctacaaccacaatgacatcaaatgaaaaatcagtaacagaaagataacaagatcacctttaaacgcggaaattaaacaatgcaaagcttaataagccatagataaaagaggaaatcttaaggaaaataaacaaatacactgaactggaggaaaattaaaacaagcatattagaagttttgagacacagctaaatcagtgttgagagggaaacgtatagcactaaatgtatatgttagaaaagaagtctcaaatcaataattaagcttttcctcatgaacctaaaaaaagatcagaataaactcaaaacaagcagaaaaacaatataaaagataaaatacttgaaaagaatcaaagttcttctttgaaaaggtcaataaaatggataatttttgcacaagcctgacaaagaataaaagagaaaagacactaatgaccaatatctggaatgaaatggaatatcactagagattctgcaggtataaagggatactatgaacaactgtatacttgtaaacttggcaatatagatggaaggaaccaattgcttgaaaaacaaaaattaccacaattcacctacttttcaacagatattagacctgtaattcttaaggatattgactttgtaatttaaaagttcctcaaaaagaaatatccaggtccagatggtttcacaggaggatgtcaccaacttctaaagaaaaaccaaaaccaattatacacaatcttttccagaaaatagaagagaagtaaacattcccattataaaatgaatttttataaagctagcattaccctaatatcaaaagcagaaaaagacagtacaaaaaaataaaactatagacctcatgaataaagacacaaatgttcttatcaaaacattggcaaatagaattcagtaatatatataaagaattatacaccatgaccaagtggaatttactccgcttggatgggatattccactttcagaaatgcaaggcccgttccatatctgaacattaatgtaatctattgataccatattaagaggctaaggaaaaaaatcatatgaccctatcaactgatgcagaaaatgcatgtaacaaaattcaactctcattcatgataaaaagtctaagaaaaatagaaataagagcgaatatcttcaatttgataaggaacatctaaaaagatctacagctaatgatatacttaatggtgaaagacagaatgttttccccctaagatcatgaacaagacaaagatttccactcttatcatgcttattcaaaagttctggaaattctagctagtatggcaaggaaataaaaggcatagagttggaaaggaacctagttcacctaggctcaaaaccaccacctagttcaaaactgtccctgttttgtcttgtcatctgtttgcagatgacatgattgcctacaaaggaaatctgaagaacttaacaaaaaaacttctggaactaagtgaattcagcaaagtcacaggatataaggctaacatacaaaaatcagttgtatttctctatgtagtaatgaacacctggacgcagaaattaaaaatccaataccatttacaactgcttagaaaataaaatacttaggtgtaaatctaacaaaatatgttcggatctggtgagctgaaaagtacatggcactgatgaaataaatcaaagatgattttaataaatggagacacatagcatgtttatgagttgaaatactcaaaaataggagaaatgtcaattctccccaaattgatatgcaggtttaatgcaactcttatcaaaatctcataaagatttttgtagatatagacaagattttttaaaaatttgtatggaaagtcaaaggaacaagaatagctaaaacaattttgaaaaaggagaaggaagggggaggattcagtctattcaaagacatactctatggctacagtaatctagactgtgtagtattggtgaaagggtaggaacacagaccagtgcaacagaatggagaatcaagaaagcccaaaacctccctaactgattactgacaaaagtgcaaaagcaattcaaaagaggaaagatggcctttctaataaatggtgctggagcaattggacatccacaggcaaaaagacgtaagtctcccaccttacgcaaactcaaaattgatcaagggcttaaatgtaaaatatgaaactataaaacttttagaaaaaacattgaagaaaagctttgggattctaagctaggcagagttcttagaatcaacactaaaagaatgatccataaagtgaaaacctgataaattggatttaatcagaattaaaaactttagctctgtgaaatacctgattaagaagatgaaaagataagctagaaatagaagataattgaaaatcacatatctgacaaaggattagtacctaatataaatacagtactttcaaaacccaacagtaaaaaacaagcaatccaattagataatgggcaaaactcatgaagaaacacttcacagataaacccaggagaagagttcaacatcactagtcattaaggaaatgaaaattaaattcacaataagatagtactccactcctatcataatgactacaacaaaaaattaatgacagcaacaaatgttggtgaggattcaacgaaaagggatcattcatacattgctggtaggaatgtaaaatggtacaaccactctgtaaaacagtttgatggtttgtctaaaacctgaatatgcaactactatatgacccaagaattgtactcctgggaatttgtcttagagaaatgaagcgtatgttcactcagaaacctttataggaatggttacagcagctttgtttataatcgccccaaattgcgcacaaccaggatatccttcaaggaatgaatggttaaactgtagtacatccatggaatacttctcagcaacagcctggatgaatttccagagaactatgctgaatgaagaaagccagtcccaaaaggttacatactgtgtgattccattcatgtaaaatgacagagttacagaaatggagaacagattggtgattgcgaggggtaaagaaagtggtggggttgggagggaagtgggtgtggctataaaagggcaacatgagggacccatgcaatgatggaaatgtttgtatcttgactaccagtgtcaatatcctctttgtgatattgttctacagttttttgaaatgttaccacggtgggtggggggggaaaactgggtataaggtgcatgagatctctctgtactatttttacaactacatgttaatctacaattatctcaaaataattttaatctcaaaataaaattttaattaaaaaaatcccaccttcagacaatgaatgagtcaggatgcaggaaaaactaatagtgtggttcaccatctagttcaaagctggacattggaactgagtttgtacctaagaataagtagaaccaagttagtctccaaatttttaaacgtctgccatgatgaaccagggtctgtgtgtgtggcagtgagaagagcacacttgaagaatgtactcatgggtggacttgggacctggttggagacaggcactactatgcataaggcctgcatcttccattttccctgtctgataggtcagtgctgtcactgtgggagagagaaggcaggcaggagaagggaggtggtggaattttcctcttattcttctctgagtctctagaaatttgggtacttcttaatgaccagacacatgtcctgaatattgctcctgccttacccccacatcactggctactgcaaactcctaatagtcaccttgatgccataattaaggcaaaaaagactggaggtggccataggaaaaggcatttaaaatacattttgatgtgccatgaaacacagatgaatgcccattcattggctatgttttacatgggctttagctgtagaaatgcaacagctctgaaatttatacttagagaaaataactactcattcatctgaacaaaaacataaaagttttccaggaaatgtgaagaatcattaacttcacagattctgaacagaaagtataattgcatacgctataaggcagaagtatatttgaaagcatttgtgagtgaaatggaaacatgccccatcaatccattatcaccagaatcacatagtatttaaatggccacagatactctgactaaatcaattaggtacaaagacagaaataatgagtactgttggtggtcaaaagcttttccagataggtgtttaggtgttggaaagatgacttctacccacttttattacctttatgccatggtaaattatagtaatttcttatgccttgggtgaaagaatggaaagataatattcaccgtattgaggatggtttaacttttctatagagaagcaccgaacaatcactaccacatgaaaagggataaaagctttctggtcaaaatgtactctattatgctagcaatataagctattcgacatattctgttgtggaaattcccaagctcccaagattccgataaggaacgtgctgcacgagctcagggcagcaaggagattagacaataaataaacaaagctcccctttcacaagctgcggtcccatggctgagaatccgctcttgttcttctctcttctaacccctgggtcttgttcttcccttcctcttctctgggtctttattaattgggctttgtgtctattctaatgaaaaaggcaccgatgctccgtcccactccttcctgcgcccccgtggaaggacggtggggggacgacggcgtaggtccaggggagctgagagtgcgtctgtgtttccccggagacgcgctcggcccgggggcgggtggcggcgtcagtcccggggaggaccggcagggggcggtcgaggctgaggactgcgcaggaccgcccgggcgggacgtgccgtgtgtactgcgggacttgcataataccactctccaagtcagggtgccttccaggaaatcctgagcgagttgctcattcaagtttttccatgtttgacgttggtgacttaatcaaagaatcaaaggatgtcaggggcctggattgctgttatcttctttcaaaggctctccttcaacggataaaaaattaaggctcagagcagctctgggtctaactagctagttagtggcagagctgacgctgtaactgaggtctactaactgcctgccctagctctgaaaaaaaaaaaaaaatccatgtggccactgccagcttctatttacaagataaatttctaacgctgaaagaacattctctcctctcccggtcccttctgagttcgcatttctgtggcttaagctgcaagtggtgaagcttatttcgggaacagaagcgcaaatttaaaatacaatagaattatgaatagattgcaatatttgactattttataacaaccatagactctgatggtaaaaacagttaaaacctaagcctttctttcttttcttttctttcctttctttcttttcttttctttctctccttccttccttccctttctttctctccttcctttctctccttccttcctttctcttcttctctccttttctttctctctttcttttctttctctccttccttctttccttcctttctttctctctttccttcctttctctccttttctccttttctttctttctctccttccttccttcctttctctccttctctctctctctctctttctttctttctttctttctttctttctttctttctttctttctttctttctttctttctctttctttctttccttccttcctccctccctccctcccccccacccccctctttctttctttctttctttcttctgtcccggagatcttaatgagctccttgtgtattctttctttcttttctttctggtctagtgtagctgcctgtcgtcttttaatatatttaggaataaggaggctttgtgaattttacattcatgtgatcattttgggaattttattaataatattattatatcctcaatttctgagccccaccccagaacaattaatttaggctctaagggtgtttttaaaaacaggctattcaaaatgtggttcttggaccagtggcattggcaccccctgggagcttgttaggcatgcagaatcacaggccccacttcagacccgctaaattagcatctgcattgtaacaggacttccaggtgattcttaactgcactaaagtttgaaaagaccaactctaagcccccgataactccagtgaacatttggcagagggcctcacctcttcagcatggtattgaacggagcccctggtccttaccttagtgttcctgtccataattaacttggcagagcccatttaaaagaagagaacatttttacttgtgctttaagatcaggctgaaagaatactggaatgaaggagttcttaatgagctccttgtgtattcttagatgggacttaaaaatttttttttatttttttaatgtgaaagggcactattgatacacaaggaactcgtgggaactgaaaaaaggaaaccagtttctaggtgggctctgttgcctgtatttgactcactcaccgataacacactcataaactgacacacacataaactctgttgggctctcaggatataagaacatttggtaataaactaatattagcagataatttatcttttttgttttgttttattatactaccaagcataacacagtgttttgtatataccaggtgactaactattgttggcagcaagaacagtagataaatatttatggaaggaacgctgtgcaaacagtaccctctaggaacaaaatgttttcctaattagttagaatagttaatagtttattgttattcatgcaagaattgagcaattgggattgatgatttcagttatctggtttgcttttggataagatgacttttgatcccctagtgctgaaaacaagaactggcagagcaagttctggtgtacctaacaatagtgttcataaataacttcctgccacactgataaaaacatctagctaaattcatttttaactgatagtaagtgctatttgtttttaactgattttccatgccacatatttgtaaatctatttcactgtgttctgggagcacgaaagactggtgctacattaattcaagcatatattagagggaaatggatataaactttctgctaatatttccaggtagcctgacagtcagatgttagaagtattcaattgccaagttaaaaagtaacaggaagaatcaaaaaatatttttctgtgattgggaatccaagctgggaaatgagacttctttgccttgtcttctactttcaaattggggtgctcaccttccccaacatctcccagcagctgccacctcacctccttcctcctacttaataggaataattttcagctgctctctgagggaaggtctgcagcagtcgccaacttctgggtttaggcggcatccttaagctgttccagtaactcagtgccaaaaagttcctcttggtgagtgccaggatacaaaaaagctgagatttcctgttaaggacttagcaaaagcctggtcaagttcaacctgggtctgccaggtacccaaagccttttctcgttagtgacaaggtaattcaagaggaagaatgtgtaatggtcagtgacggcaggacttgtggtaactgtggagtcttagaggcaggggtgctgagaagtcgttatggtgtgagtatcatataggacatgatagatggatggaatactagtgatgccttttcttagcccatttaggagagactgtgtctgggatgtctgaggggttctgtttcagatggcaggagctgtgtcatggaaaggtgacatattcgtcctgctggaagggctggcttgctcaccgctgctttgcctctcgctcctggagatgatgtctcttatgaaacgggctagtgggggatagtggtggtgggcccagtcgttccattcggttatttggcctaacttcttaaaaatacggttttactgaaatataacataaatgcaagagtacatggtcaggtcataagtttacagtgttggggctcagaaacctgtaccccaaaatatggagctcggacatgctgaactgaataagcctctcaagtctctctgagctcccagtcccagtctctcatcctggctctctctgaagacatagagtgaagttgttctctaaagttccctcatctgcctaaagtctggacctgccaaagaaaacaaccacccccttcctcccaccacctcctgcactccctgcctactgtccctttcctgcgttttcactaactgaactcatatcgcaggaagaaagactgaagtctgtccaggtaaagaaagtctcatctggacggacttttttcacaaaccactgtcgctctgcaggccccacaggctttgtcccaggtcactgtgtgttctttaagcccattgaactctcctaaaaatcatttagtacctccctaaaataatacacacttccccatctttctttttccttaagaagggtatgtaagcatctggatcccactgggttattttgtaacaattctccttccattcccctgtgttatgcacatcgatatggtttggctttgtgtccccacacaaatctcatgtcaaattgtcatcctcacatgttggcggaagggcctggtgggaggtgactgaatcatgggggcagacttccctcttgctgttctcttgatagagttctcaagagatctggttgtttgaatgcgtatagcacttcccccttcattctttcttcctactgctccagcaatgtaggacatgcctgcttccctttccccttccaccatgattgtaagtttcccgaggcctcaccaagcacgcttcctgtacagcctgtgaaaccctaagccaattaagcctcttttctttataaattaccctgtgtcaggtagttctttatagtaatgtgagaacaaactaatacattaaatttgtgtgccatttcttctattaatctgccttttaaaagttgattttcagcaaaccttcagagggtgaaggggaagtttccccttggcccctacaacagctcaaaaaattgtcacaaagtgaacatgcccatggaatcaactttcagtccagaaagtgaacattagttatattccagaggcttgctaccttctttccccttcccagagataaacaaccctggcttctgataccatagattcgtttggtctgtttttgaacttgagataaatgatgtctagatctagtaaatggtaaaggtgcagcttgaactcacgtccttggaattcagaacgaatgcccatgtcactgtacattctgccaagacactcagccctcaagagctgtcagcttctgtgagtttcccacccccatccggcacaggattgatgagcagagaaatgaccagtgagcagcctgagggaaaagacggggaagatggtaagtttgtgcattccgcatacgggatcaccagcctctgagtaacagatcgtgtgcactgaatggaaaacagcattcagaaagggactatagatcctcagaaatctagaagaggatatgtggctaattttagaggaaacattaactttggcttttaaaggttaccagtctcataaccatcatctggagctctctgtctccagggaaagtagtgctagcaagtcaggaggagtgtattcttctgtgtttgtacagccccagtgaaatgaatcctctgaaagtagtcagtctcttctgttttttcattttccaggttgcatgggcctcagtctagatccaagagaccggcctcttggatgaacaaatgcacgcttaacctttaacatgggaccagttcttggcttccttgcttagggagcatgaccactcttggggctgtgccgactctccgttataaccagaaagtgaagatgctttttctcctcaccccctgccttccctgcgccagtgccagcacatttctttagggacattatgctatttctctaagcctgaaagtgataaagaggaaattatgtaacatttgctcagttgctatttaaaaaacaaaaacaaaaacaaaacaaaaacaattcaaagagatcactgggaaaattatttcatttaattaattaattaattttgagacaagttctcactctgtcacccaggctggagtgcagtggcacaatcatggctcactgcagcctcaacctcccaggctcaagctatccttccacctcagcctcatgagcagctgggatcacaagtgtggccaccatgcctggttaatttttaaaatttgttttgtagagacagggtctcactatgttgcccaggtcagtctcaaactctcaagcaatcctcctgcctcagcctgacaaagtgttgggattataggcgtgagcttttgcacctggtcagaaaattattttttatgtgctttttgggaaaattattttatatatgcttataaaagcaaattttcaaggccccatacattaaaaaaacttacatttaaacaatagttcagtttctttttaaacacccattcataggtatggctggggtgttttggcagagagcggggaaagggtttagatgaatattcggaaggaaattcagaaatacccccagggaccagaaacttcatgataaaatgcatcctccacagggagaggcatttcaaaaccagcccatgtgaatcaagtgaccatttcagggaagaaactgaatatgttagagacaaaaacaaagtgtagataattttataaaagtggaggtggtggaagaatacgcggatgtggctggagagaagggagcgatgggttatataagtttatatcttaaaataaatttcttagagctctgtttgttattatttcatattgagaataaaggaagcaaagcagttctaagcctttttatttggaatttttcatacaatattatgatgatcatctcctcttgaaaaaacaaaagagatgtaaatgtcattccaagggcatttggggtagagagtatgtttcaattctgaaaggggttccaaatcagtgataaatttgggtcagcaagacaagaaaaatgttttgcattttgatgttcaatactgtttctttcagtacaatgacataattggactaataggaattggccccctgacccctcagatattaagagaaaaggctgaccagaaacaaattctttagatctaaagtcagagtcctgggtaggtggtccttttctgagctggggggatgtgtagtgtgtgtgtgtttgtagaactcaaatggaatgaatccttcgtaagtaagcagactctcacatctgttcttctgtttttgctttttaccagccctttactttgtgttcttatcaatgagacttactctagaatttctgattaaagatatatctttaggagaaaaatttaattgcatgcatcatagccttgaactaattatatttttgggtacaggtaaaaagcaggtcaaggctgggcacgatggctcatgcctgtaatcccagcactttgggaggcagaggagggtggatcaccggaggtcaggagttcaagaccagcctggccaacatggtgaaacaccgtttctactaaaaatacaaaagttggctgggcgtggtggcaggcacctgtaatcccaggtacttgggaggctgaggcaggagaatcgcttgaacccaggaggcggaggttgcagtgagctgaaattgtaccattgcactccagcctgggcgacaagagcaagactccatcttaaaaaaaaaaagcaggtcatgcctcttattttagctgatatgaggaagataagacttttgaccaaaggatctaggttagcaataaaaacaggtttctcaatagtgtgggctgtataggcaggtttttcagggctgctggggatctctcactagaaggcccaggcagggagacctgtgcacagcagcggcaagtggggagagattcaaatcccttaagaagcaccagagtggatgactttggagccagacaactccatttgtgaagcagaaaggctaggcatggatacgggaaagaggaagaaatgatcattatgttctaaggataaatattccctgggagagctggccaggaagcaaatggataagcagaggggatgaggacctgacagaaagggagatcctgccctggagacatagcgtggctcagggtcctctctccttggccccagccagtcctgcagccttgtaagtcacgtggcgtttatacagggaactgcagaggcatgcaaaacccagtctatcccaacctgagctcaccctccatatcatattactctgactaggtcatccccccacgacccaggcccaaagaccaccgttccttttcttgaccacccgcaggtggtgagtgagcaagttttccaaatctagctcccaaatttctgtctgtgttgtcctccctccttctgtcccgatctcagagcctagatcctggtagagttctcctgtcctgtctccctgtatctctctgcatggaaggattaatccttaaaaggcaatgccaccagttttgctgttgttgttgttgttgttgttttagagacagggtctgccatgttgcccaggctggtctcgaactcctgagctcaagtgatcctcccaccttggcctcccaaagtgctgggattacaggtgtgagccgccatgtctggcccagcaatcagttttttccccaaaactccaaaactttcagtggtttccattgcctaccaaattaagcccaaacccatagtaatccatccaagccctctcggatcatgcctgaacactctctgaggatacaggtaatactgcactgctgtggacaagaaagacgacacttgattgtcctccagtgggcctgcctcattgctttgttcatgctgccccattgttttgatctcctccatctctgcatggcaatattctatctattgtttaagatccagtttaaatcccatctcctccaggaagcttgcttgctctgatgcaaagagaaggaagctgcctcttcatcttttccacatctttaatgggctattatatagagtggtcagtgcaccctttttttttttttactctttctttcttttctttttttttttgagagagggagtgttgctctgtcactcaggctggagtgcagtggtgtgatctcggcttactgcaacctccacctcccgggttcaagcgattctcctgcctcagctttccaagtagctgggaggcgcacgccaccacgtccagctaatttttgtattttttagtagatacggggtttcactatatgttggccaggctggtctcaaactcttgacctcaagtgatctacctgcctaggcctcccaaagtgctgggattacaggcatgagccaccgctcccggcctgttactctttcatagaccaccccacaggcttaaaaaaaattttaaattacaaaatatagacatgctcatatggaaaatgtaataactggcatgggtaaaaaataaaggtatcctttctccacagtttagttatttaaagataagttattatcatgtatctgtatttattccttattgctactgtaataaatcaccacaagcttagtggattaaaacaacattaccttattatgttacattcctggaggtcagaaatatgaaatgggtctcattggctgaaatcaaggtgtcaacagtgcggtgtccctttctgcaggttctaggggagaagctctttccttgccttttccagcttttagaggcctcctgtattcctggatgtgtggcctcttcctccatatgcaaagccggcagtggttggctgggtctgtccaggtccccctccaacgctaacttttccgcctcccttttcacgtgtaaggctgcttgtgattatccaactggatcattccagataatctccctattttaaagtcagttgtttagtaaccttaattccaactggaatcttaattcttccttgccatgtaacatattcacaggttccggcattaagatgtggatatctttgcaggctattattctgtctgccacaagatcctttcatgtatttctcctactttataatatcaatatcaatatggaaaaggatttatttatatattttttagagacagggtcatgctatatgttgcccaccaggagtgcagtggtgcaatcttagctcactggctcactgcaacctcgaattcctgggctcaagtgatcctctcacttcagtctcccaagtagctaggactacagacatgcacctccatgcccagctaattaaaaaaaatttttaaaaacgttttttgtagagatgtggtcggtcttgttatgtttcccaggccggtcttgaacccctgggcttaagtgaccctcctgccttggcctttcaaagtgctggggttgcaggcatgagccactctgcctggcccaatgtttatttttaaatatgtgattgttaaaggtgtgagataccagacatatgatattatgtatcttgttttttaatagataatttatcttgtacattttttatgtcagttcattcagaggccctcattatttttagcagttgcacagtatcccatagcatgaatatttcatgatttacttaatattttcctactaatggacagaaattgtagcagctttcaatttttttttttttttttgagatacagtcttgctcctgttgcccaggctggagggcagtggtgcgatcttggctcactgcaacctccgccttcctgggttcaagctattctcctgcctcagcctcccgagtagctgggactgcaggcacctgccaccatgccggctaattttttttgtatttttaatagagatggggtttcaccatgttggccaggctggtctcaagctcctgactttgtgatctgcccgtctcagcctcccaaagtgctgggattataggcgtgagccagcagctttcaattttgtaccttgtgtgtatatgtttgtgtccttagataagattgtctacagcagagatacccgtaaggggacctgctgggagcaaaggataatttatattttcaaagggcatttacaaattttgatctatatttacatattatataccattaaataaagtagaaattttaaaaacatattgctgttcaaattcttataaattcaacaagttcagatcttttcttgatggattcaactacttctcatctaggtacaaggtacacaccgctacatttgattaaacatgcttgatttgattaaaatacagctatccttgttgttgttattgttgtttttttgttgtttaaaaactctacgggagattctattccaagcttggaacagtattccaagcttggaacagtattccaagctgttcccaatgaccatcttggtgtggagacacaaagaatgcctcaatgatcattaaagttcacttttgctctaagatttttttttttttttggacagagccttgttctgttgtccaggctggagtgcagtggtgcaatctcggctcactgtgacctccgcctcctgggttcaagcaattctcctgcctcagcttctagagtagctgggattacaggtacgtgccaccacgcctggctaatttttgtatttttagtagagacggggtttcaccatgttggtcaggctggtctcgaactcctgacctcaagtgatccgcctgtcttggcctcccaaagtgttgggattacaggcgtgagccactgagcccggccttggtccaagatttaaagtatgaagcattcggcacaaaacaaagactaatcatgtgaagagagactttgcaggtgttgatgatgcataaatcagaagaactcaagggagacgccaaatccctttagaatggcccaagtttttctgggtagggggaagaaaatgcaatggcaatgactcaccaaagtccaccaaaatgttttcactgtactgatgagctatcaaacatctttacagaccttcaatgcacaattcctctttgttcttttaaataagaacgtgacttcccatcttttcaaacttatatttgaatgtcttttaaaatgcctttgacctcaattattatgacttttcttgttttttaaatgttggacttcaccaaaattaaaaatttttgtgagtcaaaggacacctcaagaaattgaaaagacaatccaaagaatgggagaaaatttttgcaaaccatatctctgataaagaacttatatctagaatatataaacaactcctacaactcaattattcaaagacaaatacctcaatcaaaatgggtaaaaaatttgaatagatatttctccaaagaaaatatacaagtgaccaacaagcatatacaaagattctcaaatggttagtcatttgagcaatgcaaatcaaaaccacagtgaattactacttcacaccttctaagacaactacaataaaaatggatagataagaatatgttgtccaggatgtggagaaattggagcgcttatacacatctagtgggaagaaaaagggtacagccactttggaaaacagtctggcagctcctcagaaggttataaatgaagttagtatatgaaccagcaattctgctcctagctatatacttgggaggaatgaaaacatatgcccacataaaaacctgtacacatatgttcataggagcattactcatgatagccaaaagtgaaacaatccaaagttcatcaactgatggatgaataaataaaatgtgggttttccacacagtaaaatactatgcagctctaaaaagaaatgaactactaatgcatgctacaacatggattaaccttgaaaacattatgctaaatgaaagaaagggtcacatgtgcaaaatgtccagaatgggcaaatccatagagacaaagtagaatggagctatctggggctgtggggagggctggagggaaatggggcatgactaccaataggcatggggatttgtgggtgctgaaaatgttctaaaattgatagtggtggtgcacagctgtgaagatacaaaaaaccattgcatcgtacacttaaaaaatgggtgtgttatatagtatgtgcattatatctaaataaagtggttactacaaaaagcaatatcctttggaagttgcttacatgtgaatataaggcttttccctttctatggatgccacagcgatttcgagaggggtaatactggtggtggtgagaatcttatgtgtcctcataagtgaaaccgatgtttaagcactgaggtaaagtgcttaaattaatctgctttttgtctgctttttgctcctggcccctggctggtgggctcatttttctctctgtatgctgatcttgtgtgtccaacaaaagcataatttccaaatttgagcatgaggtcttttgtctacaatggaagtcattgcacagactagagtgtaaagaaacaaattgtgtttgtgtgtatgtttgcaaatccatgtgtaagtgggaggccgatgaagggagaagtgtcagcccccaagccattgtttgttcctgtgtgctgcatcctaggctcccccgagttggcctgtttaggcgcacaaggcacctcatctcggctgcttctttcttggaccccccctagttgttgggtctcgatgtgtagcaacaacctgggggccgggtactcaccaacctctatcctagccttcttttctatcaaggtttgttttccgttttcttcttctttttcgtaagctgttatagtctctggaatgacttgggtctgccgtgtatgtgttattttttaagaatcctggagaatctatttttactcctctgttcaggtgtccaaatgctgaagacattttctcccaatcaacggcaacccacccacaatgtcagtgcgttctctgattaggcctcttgatgacggccggatccctgcccggctctgcgcccgcgatgctcctggggtgcccacacagaactgctcctgacgaggaaaaaagggggacgttccaggcccagtctggatccagtgcaatgagcgagagccttggggaaaaggcgctgccagaattttattttgttaaaaactgtattgagaaaacaaagataatctctagaattggttctaaaattcaagtgaaacctgtaaacatgcaggtgacagggctctggctgcctccctggcctcgtcttctaccccttgtcccttgtcctcctgctgccagccactggccttcttgctgctccctgtatcatacaaccacgctcctgctgcaaggccttttctgggtttgtaaaatgaaaacccaggtacttctccctttaaaaaaaatccaccttactttacagactgaaaaataatgactgcttcccttctcatatgtttttaaataatctatgcagcagttgtgcattcattcacttcatttgtgctcccactgatggaagtagttttgaagaacaggctgtattagtttcctgttgctgctgtaacaaattaccacaagcttagaggcttagaaaacccacagagttattatcttacagttctggaggctggaaggctggaatgggtcttaagggctgcagtcaaggtctcagcagggctgagttgcttacggatgctggaggggacagcctgttcctttgctttgtaggggcccaaggaaaacatccccttcgccctctgaaggttcactgaaaaactggctgacaaaaagcagattaatagaaaaaaaggcatgcaacatttattctaatgtgcatagcatgggagaattgcaggagaatgagtactcaataactcagtggagtacagatcttataaagccttctgcctaggggagggggacatgggggaatgtagaccattcttttgaggggcagtaaatgatcattagggagaatgaatgggcctagaagacagaaattaacttgtaaatggaatttggattttgaatgaacctgggaggtattgtcttgtgaaaaggtctgtccaggtgggtttgcatcctcagtgttcttttctgagatagcgaatgagatttacagggatgggaggtggaaggcaactgtggttctctttggggtctggttcccaggtggataagagaataccgaagaaaagcttcgccctatgccttaggagaaacagaggattgaaagggagcaggggagcaggtcagagagaccttgaggactttgaggctacttctgtagttcagtcatattttggggtaaagtgtgctggcttccttcagccttttttccctcctagaggcagtctatatttcttggctgtggccctttcttacatcttcaaagccagtggtgcagcatcctccaatgcttccttctctctccaactctgcttctgctgtcatctcctcccctgacccagaccctcctgcctcccttttataagatccctcagatgacattgatctcactgggataatctcttcatctcaagatcctgaacttaatcacatctgcaaagtccattttgtcatgtaaggtaacaaattcacaggttctagggattgggatttagacatctttggggggcattattctcccatccacagaggtcaaaggctgagataattcaaatgcattattttgcaccaaatgctcccatttggtttttatgatgacgatgatgatgactagataggcccctatgtagtactaggaaaccaaaaatagttacagaaaatagaaataaacctgttaaaatacttaatgagaataaaccagtaaaaattacagaggcacatgtgggcttagtgaataatatctttctaatgcagagaagatgtcatccatggaaaaggctatcagtggtatgtgtggtcttgggtttggactagctatggtgcgtgccagcatggaactctccaacttcagcagtccttggttctgacaaggaactctcagcatttgaccaatcacctgcagtcacaggtgagaacatggggccctcactgagcaaagaccaagccttttaagtgtacctcaaaaataagctaagttaatggaaaataggagtgaatgactgcagtgtttatttttaaattgctttcaagtggtgcatctgttgtataaaacaagacatttcagctcaataaatttttggacaatgtctcctctagttatcagaaacttggtattaatgacgaactctggcttctagctcaaagtcaaagaacagtggaaaatgaatgtgcttcaatgaggaaccacaacctaatagagatttcatggagtgtgttgttcgcatttttacattgtcttagatgaaagcagtgaataagtaccaaatggtgaatcttgaaacccatcatgggagaattagcagtggttatttgtgcaacaagcagaagtaatgagtattacaagagaacttaggtttctaaaaacaagtttaggaaaaatgctcatgataatcaaaataggaacatcatgaaatggctttagattttttgggcatagatatatggtcacattaaagtaaatgagaggggccaggcgtggtggcttacacctgtaatcccagcactttgggaggccgaggcgggcggatcacaagatcaggagttcaaaaccagcctggccgatatggtgaaaccccgtctctactaaaatacaaaacttagctaggcgtggtggtgggcacctgtagtcccagctacttgcaaggctgaagcaggagaattgcttgaatctgggaggcggaagttgcagtgagccaagattgcaccactgcactctggcctgggtgacaaagcgaaactccatctcaaaaaaaaaaaaaaaaaaaaaaaaaaaaaaaaggtaaactagtggaaaatgaacttctattaatatgaatttcctcgtgacttcactgtggtttgtattatttaactaagatgagtcatacgaaagtagtattaccatgagtacaatggaggctgcatgatcctcttggcagttttacctcgttcttaccggtattcattccttctaaaatattaccagaaaactatgcaaaatgtgggcttccttttgactctgttggtgctcagaaaccgataccccaaaatatggcactttgatatgtcgaactgaagaaggctctcaaggtctctctgaccccccgccccaagctcttatcctctgtctcttgcaaaacacaggatgaagttctctgaagtgccctcacctgcctaaagtctggacttgtcaaaaaaacaattccctttggttctttcccaagtctttattaactggacttatatcacaggaagaaagacttaaatctgtcaacacgcctggactgacttctgtcacaaaccattgcctgctctgtgggtccaatagactttgtctcaggccactgcatgttcttcaagctcattggattcccctaagaagaatttactacccctgtaaaagcatccacacttctccatcctcttttccctaagaagaggggtatacaagcatctgtgctttttccaaagtctttcttcatctgaaacatgagagttggactagttataattcctcagtttccttccagtgctaaaatttgatcgtatcgggaaaagatgataatatggcagaaagatagggaggaaacttttaaaagatgaagataggtgactccaaaacaacagaataagctagatgtttttgcctcattcccccctgcttaatcctttcaatcctcactgcttgggaaaggtcaattttcactaacctgccctgccttcaaaggaagagaccatggagagtgagttgtttctatcccacaaacatttcaaacctgtgagatactaaaaataatttctacttctacaacacctttttttctgaggattacaaacaactatgattaggttcatctggcaaatgggaaaatttgctctttgggttaagtagcttttcaaggtcattacacgttggcaggctcctctggcactcagctttgtgaatcagatgtaatccttacagggtcgggcttggcaatcctatcactatcattctagagctacttttgccatataatgtagccattataaaggagagctacaaagcacctgtaaatacacagagaaatagttatgaatcaatgtttaagtgaaaaaagggtagaacacaaaactacatgtccattattgttacagccacctaaaaatatgtgtgctatgaacaaaacagtgaaaacacatgctgaaaacaaacaacagccacaacaaaaccattcctgttctgtggtgatattacagctaattgtttcattttcaaacattcttctaatgtgacagatcatttatacatttatcgattcattcgcacaattaatttagcacgtactctgtgccagcacctacagtgctagtatatcacagaagaaacagatggatattatggtgctagtccttgattgagccctcgctgtgagtctagcaggggagagacacatgtagacgaacagttctgacacagtgcaatatgtctcgtaatgagggcctttcggataatttactagagaaatgtttagaagatataattaacagactttaataacctactgcaatagaggctgtgggaagaatggcaacaaacagagaggaaagaacaagtaagagtctgagcatgaaaagcccccttgtgataagtttcaacacagaggtgccagggagccatccagaaaaagctggaaacttctcagagatgtggagctcagacggaaggccggggccgaagaggtaagtttgggggttaaagtcaagcagataatagatgaatctgcaagggtggatgagattgtctaaagagactatattggataagaagaggcagtgatcaaggcaggaccatagggtgtatcaatatttaaagggacaatgaaggaaggggacccccaaaagacactgagaaaatgtctgatttttaggaagagagcaaagagagaggggcatcacttaagtcaacaggaaagttcctagaagatagtggtcaacagtgtaaaatattaaggaaatgtcaaaaaagatgagcttgcagaaatatccctcggctgtggcatttgggaggacatgagtgaggttaagagtgatgaggacccaagagttaatgagaaatatcaaggaggtaacagatatgaaacaacaataaaaaggaaatatctgaatttaggcaccatgctaagataactagcaatgatatttttaatggtcagaagctatgttttaggaaatatcataagcagtagctctgatacatagattatttcagagtcaaagaaaattcttttagcctaactgtgggcaaatgttggtaagttcttcatggctttcaaatatcaactaggtacagtagctgacttttagtttgaggagatgcctattagcccccagatggtatgttagaatcagtggaaaattgtaaaattctcagtctccaaaaaaaattttagaatgaccttctttctctttgttcagttggtagacaagcagatgcccagtgaatggtggaacttggctcttctttgtttggacagtttcaaaatcttcctaagtctttgcttcttttactttttttttcttttttttttttgagacaggatcttactgtgtcacccaggttggagtacagtggcatgatgatagctcactgtagcctcgaactcctgggctcaagcaatcctcctgccttagcctcctgagtagctgggtccacaggtgtgcatcaccatgaccggctaatttttaaaattgtgtgtagagatggggtcttgctatgttgcccaggcttgtctcaaaatcccgggctcaagtgatcctcctgccttggcctcccaagtgctaggattacaagcatcaggcattgtgcctggccagtctttgtttctttaatctttaaaatgaataagttggattaggtcatgattttcattatctagttgattagaggaaagcaggaaacagacatcagatttaactcaaggaagagtatttgcctgcatttccttttaaattggatatatccacgaaagaagttggggaaaagggaaggactcatggcttgtagggaagtggatagtgcatttgtggcggcaggcagtggggaaggtttcctttgcaggagtcattgtgaggggtttggcagggcttcagcatctgtcacaagggggttggtagatttatgtgcttctctaggaggcccctgaacttgctttcagcatgagataaatcactgtcactttgcagacaggcacagacaaacatggaggctactttcgcttcattaaaacaaaagaaccaaccaggctcccgcagatgtggtttctgcctctcagaaatgacagaatcaattagtgcaggttcacctagatggtacaccatggacatggcttttgggctgcggcaataaagacctgtcaactatgatgatgtttctggggaacggtgggggaatatgtggcagctcctcaggatatgaaaaatgatatccctcagaaaagtaggcacaggcattgtaataatacacttgacaagcaccttatcttctaggaactttgcaaggcatgatgataattactaatcaaaattggcttaatatagcgtagcagtactcactagaaatcagcgcagatgggaaggctgtgaaaaccagcatttttttctcttgtaatttcatatacagttgttactacaatggtgtcagaaagctcaaagtggcttataagaacaatggatccaaaagttggcttgagtccagagctgtcaaagcttagtctgcactgtatgatgccatttattgaaggaaggtgatgtgcacatgtgcgtgtgtgtgtgtgtgtgcacgcatgtgtgtgtgtgttagacagggaaagagatggattgatagaaatcttattcagacaaaaacacaatatttacttaggagtcaatgataatcattatgcaatacatggcattatacacagtcatgtattttatgtgaattaaaatgtattttcctagagagtataacaatttcagtaatactgaatgtaatctactgaaatgaagcacaattgaaataagcaaatgaagctgggtgtggtggtacacgcctgtggtctcacctactcgggaggctgaggcaggaggattgcctgagctcaggaggttgaggctgcagtgagctatgattgtgccactgcactccagcctaagcaacagagcgagattctgcatttaaaaaataaaattaaaaaaaggcaaatgggcaattcatcattttttaacagcaaagtaatgtgttaatccctgtctgctcccacgtccacactggggaccaccccccaccccactatagctggctggctagagccctaccccaggccacatctaacctggtatcatcgcactgcagaagccctatgccccagccctgtaaccagctggccctgtgtactcacgggcctgcagggcagcagccctcttccctaactccagctgtgggtacttaagatattatgatggggctgggcacgatggctcacacctgtaatcccatcactttgggaggctgaggtagatggatcacttgaggcctggagttcaagaccagcctggccaacatggtgaaaccctgtctctactaaaaacacaaaaattagccaggcatggtggtgcatggcctgtaatcccacctacttgggaggctggggcaggagaactgcttgaacccaggaggtagagattgcagcagtgagccaagatcataccactgcactccagcgagactccatctcaaaaaaaaaaagatattatgatgggacatctgccttggcgtcatactgatctctttgatggaaactttgacctcttacttcccttctctcaaccccttctgcatggagtttggaccttgagctctgcaattccatttgctgtcttggcctccactgcagaccagaaggaatgggatggtcccactaacctgacaatgtgtggcaccaccatctgcggccacacctcaccatacaggccagcttctttgggcacctgtgtcagcccagattgagcctgtgttagctgaactgctggaataatgtactggggcttgtgcatgtaccttccagatcctgttggtcctgcctgacccctcagccttggactctggccctgcttcctggacagagcagcctcaggatggctcatgctgctgccatctgtgaagcctggccaccgtgcttcttcctccacctgcggcactgctggtgtctcgacctccctcagggacgggtttgcccaaccccattgagccgctgggcctgtggaggctttttcactaggagtctcaaggccctcagtaagtatcacagctcacaagtgcggcgctgttaatatcccatggaatacgactcgaccaatgaaaggcaggagaccaggaggaattagcagatgaattgcttgccctctctctctgagaaggactgtttcagcacaccacggttccatatggcctctccagagtcatccatgtgatccaatggccagctctgttttcttccacagcccatgtctgatccgtgaatgcaccctgccagccctgccctcaggatgggcacatacctgtccactgccccaccctgttctcactctcactgtcccggagggctgtgtggctttccctgacttccatccttgcctccctccaatttcttctcgatagagcagccagatttattcctttgaagtgctgctcctccacccaaggctgtcagagtccccgtgtcactcagagtacaacccaaagtattgacttccattcttcccccttccaatttcttcttgatagagcagccagatttatccccttaaagtgctggtcctccacccaaggctgttagagtcccatgtcacttagagtacaactcgaagtgctccccgtggcccatgctgtctggctcccttccctcctgccttcttgagcctagctctctctttgcgctctctgctgtggccacccctgctctcctgcatggcctcctgcacaccaggcacacctccaggacttgctgctttctgtctgactcactttccccttgcacagctgcatgccccactctgcgaccccctgacactatccccttgtgagtgtggcctttcgtaatcactttctctgaacagcacctcctcctgcttaactttttccttcttagccgttatcctagtcttccttgctctttatgtcacttatctgtcttgctggtttttgtcttccctactaggatgcaagctctgtaagggcaggggctactgcctgttttgttcactgtggtatccccagtgtccagcacagtgcctggtacacagcaaggttaagtaccagctgaacaaatgaacccatgaatgaacgaggacaccacatatacttaaatgcttcattcctaactctgcacgtctcctcccttctcctttgtcaagaagggcctggctggctaggtcccagttgtctcttagttccacctgccctcagactctcctgtttggctgcacaacttcctttaacccttctctaactgtggcagcatggaaggtgacagcttggaggtcagtgatgaggcaggaaacttgttagctaggacagaacatatacagaagagactcagtgcagctgacagtgtgcattattgtgatacatgttcaaagcccatctcaattataggcatggattcatttatttctgacttcaaaactctccgtgtcaaagtcttgctcttactaccttgttgaacttgactatagcaatggggaatggcacctggaaagggtcccgtggagaacccacccaggatgctgtcagtcagcactgaccatggggctgaaggtggaaggttcctctatgtataaagagagcttctcacactcggggcttttgtgtgggacaggaaaggctgacataaaacaatgggattgagtcattcatgtgggaccatacgtagccacaaaggtgtgacttggcccactgcccccctagagggcagattgcagaagttggcagaaatgtcacctaattatcaaggtggctgtgtggctgggagttactgctcaatctattcagcagcggaggaagctctgccagttctcagcacataggatctggctaatctgataacatatggaggagaaaaagtgcgtcactggtttcctctcgcaccacgcctgacttctgcaaagcagcttctctcccacttatctcccactgcgaagccttaggcattcattcctgtgtgatggagtcagcatcctgaagaatatggaatatcttagagatgcaaacgatccaatgaatacttatttattggtcagggagaatgtaactgaagccaatttcccttgtgagttactcacttacttccaaattggcatgagtgtaagactccgtggacatatataactcattctagccaggatccagaggatcacagagacacccactgagtgtcctaagtgacaggggagatggatgtcatgaaaagccaggaagaaacccccaaattccttgaaacagacacagagattttcttattggaaactaagctaaacacttatttaaaaatatattttctcccttgtcctcatctgttttcttttctcttttcttttttttgagacagggtctctctctgttgccaggctggagtgcagtggcatgatcttggctcactgcaacctccgccccctgggttcaagcgattctcctgcctcagcctcctgagtagctgggactacaggcgcccaccaccacgcccagctaatttttgtatttttagtagagacggggtttcaccatgttggccaggatggtctcgatctcttgacctcgtgatctgcccaccttggcctcccaaagtgctgggattacaggcatgagtcaccgcgcctggcctgttttctatttttaaatttacttgtattatttatttgtttgtttatttttagagatgagggtctcactatgttgtccaggctggactcccaactcctgggcccatgcgatcctcccacctcagcctcccaggtagctagaccgggagatagatagataggcacatcacctattttcttagggttccagggcttgttgaatacaaattatccaaataaaacacaaaggttctcctcatatataccaaccaaaacccacaaaaaaatttgttatccttgtattgtatgatctcgttggacatctggcagtgctgggaggaatgagcaggtggaatgagcagagccgcaggattgggccagtcttaaagagatgctatccgatggtcaaagggctaatacgattaaggagttaaggaccaacatcgcccactgagttattgccaattagtagccaggtttccccagcagccccaagcaaacattatcaccagcattgattactgatatcgcccttctgtatctctgttctgggttctaatgcagacatagagagagagaaattaatttgtgattaagacaggcaaagcactcagaactgtagactcaagattgtcctgggaaatcttccatagtgaagatttggagggaacaactcttctcttctcatttctcactggcatttaatactatggaaaacattctggttgtggagtgtgaagtcctgggcttttggttctgcccatgacctgtcattaatgcaacagattctccggtatacaaaggggctgtttaataatcaaatgagatacaaatgacaaacttttacaattgtaaaaactacatgaaaacttaatgatttcatgagtactgtatatgaaaaatgtttctaataattgtaacattccattggtaggattcaggtagtgtgttctcttaagaggccctaaagagagggaacatgcgctgagtgacagcccaggaggaagcagacacgtaaggtgagctcgatccacgaatatgctctagacctgtcagtaacagccgcttagccactgagctaagagctgaagtcagcaggagatggaaactgtcggatcctcaccatgctatcaaagcaaattccagcagcaggcacattgctggtaaaaataatgctcagaattcatattttaatcacttaaaatgcatttactcatagtttcttcttcatggctgaggtgcatcacgacccttccatgagctattatactcaaagatagaaaatagtatcagatgctatggactgaattgttttcctcctgattcatatgttgaggccctaatgcccagtgtgatggtatctggagatggggcctttgggaggcaattaggtttagatgtgatcacaagggtgagaacttcatgatgggaatagtgttcttataagaagagacactggaggccaggcacggtggctcctgcctgtaatcccagcacattgggaggctgaggcaggtggatcacgaggtcaggagatcgagaccatcctggctaacatggtgaaaccttgactctactaaaatacaaaaaattagctgggcgtggtggtgcacacctgtagtcccagctactcaggaggcaggggaattgctttaacccgggaggcagaggttgcagtgagccgggatcgcgccactgcactccagcctggcaacacagcaagactgtctcaggaaaaaaaaaaaaaaagaagaagaacactcaagagctctctctctgtctgccacgtcaagacagtgaggaggtggccctatctgctagccaggaaaagggccctcagcagaacctgaccatatcggcaccctcatctcaaacttccagcctctagaaaataaacttttgttaagtcacccagtctatggtattttgttatagcagcctgagaatactaccagatgtaggtcaaaggatgaaaaatatgaataataacaaaagaaagaaagctttgtactgttaaaggctggtgagcatgaaaacagaagcttctgaacagttttaaagcgggagggaggggtcaggtgggtcactacacatagtgttggaagagtgtgttttgcccaaattgatcaaatgagaaaaggactcagtgtatcataatgtactagggaaaacaatctgggatactgtaagtcctgcttccccagtgatatggttttgctgtgtccccacccaaatctcatcttgaatagtagctcccataatttccacgtgttgagggagagacctggtagaagataattgaatcatgagggcaggttcccccatactgttcttgtcattgtgaataagtctcaagagatctgatggttttataaggggaaacccctatcgcttggctctcattgccgctcttgccttctgccatgattgtgaggcctccccagccacatggaactgtgagtccattaaacctctttttctttataaattacccagtcttgggtgtgtctttattagcagcatgaaaatggactaatatccccagtcattgaattcctgtaaacacaggcaaacacattagtttagaataggtaaaacacttagtgtaaccaaacccgaggttaatcattcaacttgccagtgaaacgcttccaacagaggagaggagtcagtgagagacgaataaaggacagagacacaaaagcagccacacagatccatagtcagaggacaaagctggaggcagcttggtggagcaggttgcttcatggtcagccagtgagccctttggggtcaatgagggaaggaagtaccttccttttagggacagggacagggacagagatggacctacagggatcaaaggctacaggcagctacaatgtaggaaaaaaacacagtccagggccgaccctgggggattgacttggagaggaaagtaggattccagttccctgaggaagagcctcatgggacttggcacatggagggtggttgagtaccctggtctctgagcgtatctgtttctatggttttatcgttgtctattccctctaaggttgtttatttatttacttatgtatttttgagtaacatttgtagcttgcacacaggagatgctaagtatatgcttactgtatagggcattccaggtgaggtgcttaacataagttgctcagttaactctcacaatatttatttaataatagataattagaaccatttttaatttaaaaattttaacattctgatctcacttaatggcctcaatagacttttttttttctttctttctcttttgagatggagtcttgctttgttgcccaggctggagtgcagtggtgcaatctcggctcactgcaaactccacctcccaggttcaagcgagtctcctgcctcagcctccccagtagttgggattacaggcacctgctaccacacctggctaatttttgtatttttagtacagacggggggttttcaccaacttggccaggctggtcttgaactcctgacctcgtgatccaccagccttggcttcctaaagagattacaggcgtgagccactgtgtccggcaatagacccattttaaaaatgaaaaagaaaaagccacaaccagagaagtcactcacataaggctgcaaatttgtaaagtccagatttgtacactgttctgccttctcttattatttcaggctgcctctaagtcagcaggactgggaccctacaggcatgggtgctaccagaaagggagagggaagaagaggagtgtggctaaggcgtgctgtcccttctgcgggggtttcttcatagcgttcctctcattcctgaaattattccatttccagtggtattgagggtgaccagcagaccctgttgtaccatgtcacttaaaaaacgtagtgccttttttttttttttaaatacaggaaacacaaaaacattgttaatattttaaaattatcatttgaattttacattgttacctccggggcacagtgaatgatcatggaagctagacagaggcttgccaagctgtctccccgcaatactcagctcagctacttaaagtgtaggtggttgctatgggcaaccacttaaataaactcagggaaagtgttggggagtgagggctgcggagtgcaggcagttaatggatttacctaattcaaaacaaaacaaaacacctataaatttttccccaaggatcattcctccctcccgctaatactcctctacctgagatgattgttttctttaagacagccaaggaaagagaaatgacaatgaggatcttaacctgttatctgaatagtgaagtccatctcaaaatattcaaaaaggaagagaagctggaaaattctaactgttgatcaaatattaccactgctgtaagttaaaaaaaaatccacctaattttaaaatggcccctagattgttcttcccatggtagattgcttatactcaaccccgagtggcatagtctcagaacccagtcttcccagcagggaattggaacagcaggttttatgattatactttcctattttggtgggtgggaacatattttactttatatcttgctttttgcttcattttcattttctttaagtgattaagtgctttgagatgccaagccttcatgtttattgaagttacttttacacttttagctaattcctgcactcttgtccaaggcctgtactcccatgaccatgctgatatgttatgaatatctctttttgttataactaggcctttttgtcttccattcctttgcataaagaatattacccattcaactagggaagtggttgtataaattatagtacaggaatataatggaatactttgccattgttaaaaagagtgtggttaacccacaagcatttatataaaacaatgtttaagacctaatttcaagtgaaaagagcaaattgtagaacagtatgtataaagaaagtttagacatgggtatatataatatatgcttagaacatttctgaaaagattcataagaaacagaattcttacctctatggagggctaaaaagggaatgaagaggggagggggactttaacacattattaaaatatttcttggtggtgttaaaatttttatgagtattatattttgtaataataaaaaaggaaatcttcccattatttctaaataaaaaagagacatgtgggtatggtgtatattggagaatggcgtatcactacggcaagcaagacaaaataatagcagcagcaacaaggagatctgacctgtggtattaggctgtttttgggtcactagaaagaaatacttgaagctgggtaatttataaagaaaagggttttaatcagctcatgattctgcagggtttataggaagcacggtgctggtagctgcttctggtgagtcttcaggaagcttacaatcatggctgaagatgacagggtgtcagcatgacacacggtgagagcaagggagcaagagggtggggaggtgccacactcttgaacaaccagatcttgcgtgaactcaaagtgagaacccagtcgtgttgatgaggacggcaccaagccattcattagggatccgcccccaagacccaaacaccttccaccaggccccacctccaacactggggattacatttcaacatgggatttggaggggacaaacacccaaactataccacctgtccttggttggcttttgatttttggtgtccttatttatctgtgtaacttcgtatatcagccctttccggtaccatcctaatctctgcttctaccattctttccctgcagcagtacaactttctcttgtctcttacttgatttcaaactgtctccaatttgtctctctctatctcatctagaggcaggctagtatagtggttgataacatgggctctgaattcaaatcccgactgtgacacttctagctctgtgaccttggaaagtcaattaaatttatgtgccccagtttcctccttgtataacctagttaataatgattcttgtcttataggtactattagttattatgtgaattgtgtctggcacagaggaagtgcttctaagtgttagtcattactattcttcaaggtgattttttggggggttaaaattagatatatttcaacaagaaaaacaaataaagaagccaaaagaaaaaagtaagagaaaagcacaagaaatgcagcaaaaaccacccagaaagcctcttcacgagaagaatgactgctgagatgttagaagatatccttccatacatatatactcatgtaaataatatagaatatactttcatctaaataagaaaaaaaatctctcttgtaattggctttttgactccacgccacgcaggccatctgtgtttttgtttgtttgtttgtttgtttgtttgtttttttgagatggagtcttgctctgtcacccaggctggagtgcagtggcgtgatcttggctcactgtaacctctgcctcccaggttcaagtgattattctgcctcagcctcccaagtagctgggactacaggtgtgtgccaccatgcctggctaatttttgtatttttagtagagatggggtttcaccatattggccaggctggtcttgaactcctgactttgtgatccgcccgcctcggcctcccaaagtgttgggattacaggcatgagccaccgaccccgccacgcaggccatctttctaaaacaacacttacatcacttcattatctggctcggctatcagtggtttcctattgctcactttattaaaacaaaatgaattctctggatatgtaaggatcttacttagaaaagtcctcactttctatccaaagatggcttcccatttttaaatactcttctaatacatcagtcagcttaatttctttatactcagacaaaattcctcctccgtagtctgttgcctctcagtgattattcagattccaaatcgaatcctttctctttcatgaagtcatcccttcctattttcaattcctattagtttttcttttttttggacaaatatagcacttttagttagcggtaacatacataatgtaatttcaaaacttacaaataatgatacaaaattgttttcattgctcttggcggcactgaatcgtatatgtgcagtggagacagagccttatagctctcttgtctccctcagggcatttagcagcttgaaaactttgattcctctggaaagaagtcttggttgagagtgagatgacttgggtcctaaaccttgctgaagagcttaagcgaggcacctctttacttggggcctccatatcctcatttgcaatataaaagggttggaatcatctttgaggatccttttagttttgcttctaagattttttattcattctctctctgaagaaaggctacctaaaaataatgccattggtaaagtggtaaatgtttagaaactgactttttgggaggaagaagctctgcctcgtagagcgtgtcgatttccatggtgtaaatatttccatcacggccaatatcaggctcccaggatgacaaaactgaatatggagttgggaagagatgtccaccattggctctcattggacgactggaccccccctagcattgtggagtggctcctttcaatgaagaaatgcagcctcaggctagatgagcacagccagctagcttcgtctccagcttctctcactctaaaactccaacacaatctttcttcactgagtggagaaggcgacgacaatggaaagtgctcccagcttggcttttcaaacccaggctctgaaggcacaaaccccaggaggaggccagtcttctcaggcacttgtacccacagcagtgtccatctcttttggaatctggcacaggaatgatgctaccgaggtggtggcaattttatatgcagttggtaatttggatctgttccgagagctctcagctctgccttttctgggaaagaggtgtggtccaaagaactaaaagaaggttctgagctgtaagtcaagaacaatgtacagatggtggaaacagtctccagactgttcagggaaaagtcctcagagtttcatgagtcagtgggaggaaagaagttggagagaaagtagagggctggagccgaagacccaggctctgcctcgtgaggctcacaaccatgagaaagccttggtgtatcagtaaagtgttggttaaaaatcaactcgaaattccttctgacaccgttgggaggatcttatcatatgtactaaaaacatttgatgactgttatttatacttatttatgttaaacaataggaagaaaattaaaatattactagctatcaggatagatgatattttctcttcattggtttatgtaggttcatatatatatatatatatatatatatatatatatatatatatatataattttttttgagacagtctggctctgtcggccaggctagggtacagtggcaagatcttggttcactgcaacctctgcctcccgagttcaagtgactcagcctcctgagtagctgggatcacaggcgcacgccaccacacccagctaatgtttgtatttttagtagaaatggggttttgccatattggtcaggctggtcttgagctcctggcctcaagtgatctgcctgccctggcctcccaaagtgctgggattacaggcatgggccaccaagcccagccacagataatttttaaagaatgttgcagtagttaatgtgatcattgaagaacacccttcccaacttcaaaaggactagttaatgctggtgctccctgccccctcatagaactagaaggaactgggattccccagatgaactgaaggaaatacgctaatattcaaagtggataacaatactagggatggctgcgtggatatttttaacatgctaatgtgtacctgccagactgagctcccagcctccaggtgggctggcaatgcaaagtagggttgagaaggaacagggagcttttcagagaaccacagattcagaagcagagggagggggaagaattgaagagaacacagacgcagtgaaaggatgctgggcagatgttagatggcagctcaactcaaccactgcgcattaaagttactcatggagggtactgttcagggcactttaggcatagagggattgtgtaatgatgcgttagcatttgttcaacatcccctctgggatgacgactctgtgccaagtgcttcaaaaacattctttcagatagcattgaatctcttcctacacgagggacagagaaaataaaccagtgcttaagaaagctatattaccttgagaaatgttaacacagtgcttcgggaattcttaggaggaagaaataatggctgacagccagaggttaaatttgagaagaagatttaaaagaatggagactttcttctcatcttctcccccattagatcgcaagttctgttgtactgggaatcctgactactataatatatcccaatgcttagcacatagtaggtggccaaaactgataataatgatggcgatagctaacatatgtggagcaactactgtgtgccagggactgtgctaagtgcgccacatacactgcaccttctcgaatctgcataattacccttgaacaaccagtggcttgttgaagtggcgtgatgttacttcccatacaagtgttctgtgcttgtaagggaatagcaggaaagaagatctcaaaggagaatggtgtcttactgtgacacttttgaatgttacatttggaactttgtgcctagacaacatgggattcagagataattttttagcaacctggtagaaagtcttagagaaggagttggagcagagagaggctgggggcgtcaatacaaattggtccattgcaatcactcaagtgaaaaatagtaaagctggaagaggtaagaggtgagttgcaaagtttcaagactgtatttaaaaaatggtcattccactgatagaaagggaagtgtcaggaagagaagtgatatatttagggagtactgtgttatgtgggtgctttgaaatctcttcttcctgaatgctgagcttgaaaatacaggatcaatgcacatgatcagacgatggtgcagatcttatgctaaagtcttagactctttaggctgtaaagatcttatatagatattttgtctgtcttgctcaggcagaattatcaaaggtctcagaggaatataactcagcttgtttcaaaagaggccttggaagttttctctaacaatttccaaattaattgatgtgataattaataactttgcacttagaagttcctccttgcagctaacctgaattccttgggctgcaattttgatctcatttcctcctggtttatagataggaatgttgatgatgttgctatttcaaatgcatcttctgtaaagatacatttatttaggacttacacccagcttgcttctaaaaaggattagaggcagctcctaatatgtccacctaggcttccttttaaagaagcttttctcattcctgcaaaatgtcttccatctgcatgcataagaagaatttctttaataataaatgatacagcaaaagtaaagctaataacgaactatgctgacaaaatagtaacctgtaaacaaaacaaaacaaaaacaaaaagaaacaaaaaaccacaatcctttcttatgccaggcaatgcagatttttctcatcagaaaataattttgaccaaaactatcaattttaacaccgccagcctctgaattttaagttcctttcttctttgtagtgcctgcttttgccattcttagactcgtgtgtgtgtatgtgtctgtgtgtatttttctcttccacttgactctggaaaaccagattttagtaaagcatttagtgaatattgaaaccaaggtataaatgatggacacagtacttaaattattaaaggtaccaaatgtttgttgcatgaataaatgagtgagtgagtgattgcatgaatataatttgtgattgtaattagggtgttctctttacctcgttgtctgcactttaacgggaacatagatattaaattgaataaatggcaggtggcagacagaaaagacgaaggaattttgaggctctctgcaaagagaagccgtcctggaaggacagtgggcagcatctctgatcagcactacctaaaggaagtgaggagtctttgttgccagaaaccttagccagggccttccctgctcccctccctctgctgtcttagggctttgtttacacagccccttgaagccagctgtcaagggtgcaaacctggtctgccatcctttgaagaaggttcaggttacacatggtaagccacagaacagagaaggcccaggattcattattgtattagtctccacagagctgaacccaggctcctaagagtccgtcccttcttcctgtgtcctctgtcagccagcgccttctgcagctctgatcctttggtcattggtccttctttcctgcacctgaggctaagcctgagtcaagatgttctcaagatccttcctgtttcagctgcatgtctgatgtttacacttgcgactcagaactcacttcactgcaggcttctgacgccccttcaaatccatgcttcactctcacaatctgttttgaatgtctgtttttcctgggtaccacttctcagttgtccacacccagttgatcttcctttcccctccattattaaacatcttttaaatagctcatcactgcagtcttagtaagttcaactttccgtccagctttttatcttttctggtttcaacacctgggctcaaatcttagctctgacatttgattgataggtaaccttaaaaaagttatttaatctctctgagatggaaatttgtcatttgtaaaatgggcaaaattgcatgcatagagttctgatgatcaaaagaaaacacgtatgtaaagcccgtagcactcagtcaggcacttagaaccttgttaaaatgtaaatatccctcctacttaaaaaaaaattattttaagttttgggatacgtgtacaggatgtgcaggtttgttacataggtaaacgtgtgctctggtggtttgctgcacctatcaacccatcacctaggtattaagcccagcatgcattagctatttatcctgatgctctctccctcccccaatccctgactcttaacttttaaaaatgtctcattccttctctctagaaaagtatcgggactttcttttattcttttgcctcctttaaaggcacacaaggagttctctcctctctatagtcatgatcattgtagagacttttcagtctacgcaggcttcctttcaacacaggcttcctttcaacacaggcttttctaaagagtaattatatagcaagaaaccaggatttggtacagactacaatactcacacatgcccacatcatttggaggagggcattcatatcccaatgaaggaacatttttttaaaaactaggagtggtgatctgggactcaatgtaataggcgattgcttgtattagctgtttttttcttttttaaataaagctgatttctaacaaatatttgaaaggtatttagataatttgtagatgagcaagtgataatttttctgtgagcaagaatgactttccctgttttaaacgtgtcgcgtttcttattatattggaaagtgggagtggggagttagaagtatagaggataatagaagaaagtattatagtcaggtcgcgtttcttattatattggaaagtgggagtggggagttagaagtatagaggataatagaagaaagtattatagtcagggaagaatgggacactaccctgggtttatatcactgatcactgaggacgtaaattcacaatttcgtgtggcaggttgtattttcttgttctccctactttgtgaggagcatttgctattatacgttacaatgatacggaggaacaggtaggagaggaacaaaaaagcatttaggcaaaacagagacatttcatactacttagaacagagatgggatgatacaaattgctatgttcccaatacagttcatatctttggggaaaaaatagcgatgctccaatcttcatcccatccccctctttctctaacaagaaaaggaaaacgaggagcagtaggtaggtaggaggggagtgtatgacgtgaggaacaggcaaggacacagcatgtccaggaggagaaaaggggagcaaaaaacgtatacaagataaacaacaacaacaacaaaagagactccagcaagaggctatggttttgggctcctcacgtagaaatcaatgcatttaaaatatccagaattaaagttgaagaagaacactccatctacctcttctcaaattattttctttaccaatactacttccttttgtctttaaactgtgaaccactactctactgtgccttgttcttacaattatacacgtcagtgctgaaaggttcctgggagacatttcctgtagactaaggatagcacctgtgggcatctcggatcgatgaatcatggtggctggagcactgcattgagactggttcaggggctcagtctgttctcaatgggtagggtgatggaatccatcaatgctgggattggctaatgctgtcttccacaggtttggggtgggaggagttgtagggagagccgcccaagtggtgccatccacgctaagagactgagactctcatttacgaggaggttcagagacattaatcaatttgccaaaaggcacacagctacttagtatttttccaaatttaaatttaaatttttccaatttatctaaaacaaacaaacaaacaaaggttcagggccagggggaaaaatgaagattaagaggattaaccatcctgaaaatgaaaaatgatttgccttcaaggcatttagaactgaaaataaatcttcctgaagccttttgttagacactttatcaaaattgctaggagctctgactggctctcttgcaacagcctggaatccttctccccagtttcagaggagtttcaaaatctgtaatattatagactgactatttcttccagggggagaatttttcttagtgcttggataaagagatgaagtattaagacactttaaactattattcatgtaggattaacagatatttgaatttaacttcagaatcttttaaatgacaccccacttaatataatttttaaaaagttctttctgcagtgtatcaaataaaagtcccagatgggatttggacttggttttaactaatcatggtagcaggcagtagtctcagttctagaataaatggcactccaagtaagagacttaagttcttcatcagtgccaggctgcaacaacatgctttgagggaactctggcccctaaatgtctcctctacttgcctggaaatttactattaaacattcagaatttttttgaaaatgctaatattcttgggtgatacgccatttcaaatttattgttagctaataagtaaggaagaaggaaaagctagtgatgaggtggagtgatttgttaatagctgtgggataagagaagagagtgaccgaaataatagttttccaagagtagctacaggaggggttttgctggcccaaagatggacttcattgtctcaaaactactcctaacaccagaatgtttaactgaccttaggccttatatgtctgaggacccaataactaacactaagcagctgatgaaaaaccacccacataaataaaccctcaagatgccttcggaaaatagaaaagaaaagagaaaaacaatgtaagaaagtgtaggagtgccttctcttcaacatttctgagagaagatgggagttgaaaaccttaaacaaaatgttgccccaatctcacttgcctaattttagttatcttggttcagggctatgattcatccctaaagctgtgaattactgaggaggaaggagggaaaaaaaaatcgacttaaatgtcaaagaagtaggaacataaatatagttttcttttttgaggaactagaattccaggatatagggatcttttttctcataagggactgaatccttcaaacttctagaaaaataatgatctgcagtcaaaacatcatcaaggaatgaaagacagaattgattatgagtcatgtcatgtctgaatttttgcctctatagtgtattttcctttttttcttttgtatctctttcaatctggttaaactattaattaattaattaattttgagacagggtctctctctgttgcccaggctggggtgcaatggctcaatcatggctcactgcagccttgacttcctgggttcaaatgatcctcccacctcagcctcccgagtagctgggactacaggtgcacgccgccacacccagctaatttttgtagtttttgtagagacaaggttttgccatgttgcccaggctggtctcgaactcctgggcccaagcaatctgcccaccttggcctcccaaagtgctgggattacaggtgtaagccaccgtgccaggccaatctggttaaactagaggtcactaacaattgtatgcagttgaagatgacggaggtttaatgtgtagactgtaatgacaaagggaactcataaaataggtgagtgtgaaacgaatggaggtaagtggaactatgagaaatgattctaggggatgtgatggtagcacagggaaggaagatatgtttgaatggttgtctaaggttctcttgtgatccttttgtggatcataatcataatgattgagttttcacagtaatatatgagatgtgcttccttcaaaccttgttatgatgttggcacactatccgtcttacataaacataggaaaaaaaagttctctttcctgccaaagaacaggggacaacagaaatggtgtggggaaactccatcctaagtaaaatgttttcaatttagtaggtgttctcctgtccatttatcaccactttgaatttctgtaagtggggagggatgaaatagcagtcactaactcatacccagttcaacaacttcaccgtctgaaggagctgaccctctaccatcagcctagctgtcatctgcatgtttgcctctttctgctctgaaaacttctgagcagtaaaagaaatatatggtggtcacaaaaatacggtccaggacgttggaggagggtcatattgtgaagaaggcaaatgagaaagaaagagtttcaatgacttcagagtgatcctccacatcctgaagctatgagagtagcccagggcacaattgtgacattgatttcagcccctaccctctagccctgtcctcagtctcctcagagcactcttctcatcttcctcatggctctacatctttctgttctcctcttacctgggtattgctgtggacaagagcaattcctctatcttatcacccaagacccaaagtgtcactcagtgaatgtgaccaatgcatcttgatgacaacctaacgggatacttaggaggtggaaaggactctggaggttgccggtttaagtgactttcttgcccattgcaatccttttcttgcatcttctggaagatgttaaccctatggccatgactacctaacattgtgtctagtggagagatattttaaggtccatagaagaatttttttttcagaagggtccttggcctccctcatttcatgtcaccttggtccactgcctttcttacaaatccagttcttctaatttaattttctgagcttctgctaggcgcgccaaagtgcaatgaagacttgtttctgttttttatttccacgaatttttttttttttttaccttgtgtggcaatgttttgggtccaattctgttctccaaatagatatattgaagtcctaactcctactatcggtgaatgtgaccttatctggaaatagagtctttgtagatctaatcaagccaccaagtttgtggtagtttgttctgatgattcttgaaaagtaacacatgtagtaataaaggcaaagaggaagggcaactggaagccaaagaaagaaggaagaggtttttttcttggcttaatttactgatgcactggtattaatttttgattaaaatgatccagaattgttccacatgaacccttgaaaaataattcatgggaggccgtctctgtccggatctttaaaatacaacatactctgctatttaaataaattcccatcgcacaatagtcagctgtttttcagtgctcttgattaacaattgggtttgttttccttaactcgactgctttgattttttgttttattttgccttttaatattttatttagtaacataaatgcatgaatagtaatgttcatttcatcaaaatatggaatcaaaggcacttaaaaatacgaattatccgtaatatatttttcaggtccaaatggaattctatctatttctacattccaagactctaaagaatttactctctataaacagcatttagaatgaaatcaggtcttgcttaaaataatcaatctcagtggtttcctgcgtagcgctattctttgtttacaaacagcacaaatacagttaaggactacagtcatatgctgcacaacgacatttcagttaatgatgcatataatatggttgtcccataagattataatactgtgtttttactgtatttttctatgtttggatatatttacataaacaaatacttaccattgtgtgagagtcgcccacagcattcagtacagtaatttgctgtataggtttgcaacttaggagcaataggccactccatatagcctaagtgtgtaataggctagaccatctaagtttttgtaagtgtactctatgatgtgtgcacagtgaaatcgcttaatgatgcatttctcagaatgtagctccgtccttaaatgatgtatgactatatttatatttgcaaaacaaaacctttttaaggccttcaattgtaatacatatcgagtgcccaaatttaaaaatgtatgtcaagaaccttcacatatccaattttaaagcacggtcacactctataagcttctctaagacaatctcttctattatgttactcaattatctgaaaaattcaagagtcttaagaaaaagttcttgtgtgtacttcgtgcctgagcaaacgttcaagaattgggatacatgtatattctcattgaccagaaatttcaatccttttcagaagccattctggattcttttaaatccagaatggcttctgaaaagatgggatttcttctgcttcttagagatgaggggttcagcttatgatcaatgcagaacacatctgttgcctctctctacaaagggactggggtacggacgtcagatctaaagtcacaatcaatgtactgcactgctccacctgtaggatgtttctgccccacttactctaggagacacaccatctgagcctcggtgataatacaagcacctggactatcgcaagtgcagggttaggactactcacttgagtgtggtgagttctgtaagggatggctgagtagccttgagatagctttctctccgcgcagcaacttttggagaaggcttaggactcgtgtctgagtctccactgtcttcatcccccatggccttgatataactgccactccgcattcttcggcatggaatttcatcatctttacctcgtggggtgtaccctgtccattcatcttgtggaacctattcagatagaaaacagataaatcactttttataaaagcctacctttttcttttctttttctttttttttagatttaacatttctattttttttttttttttttgagatggggtcttgctttgtcgcccagactggagtgcagtggtgcaatcttggctcactgcaagctctgcttcctgggttcatgccgttctcctgcctcagcctcctgagtagctgggactacaggcacctgccaccacgcctggctaattatttgtattttcagtagagacggggtttcaccgtgttagccaggatggtcttaatctcctgacctcgtgatctgcccgcctcggcctcccaaagtgctgggattacaggctaacatttctaatttttatgagtacgtagtaagtgtatatatttatagagtacatgagctattttgatacaagcatacgatgtgtaataatcacatcagggtaaatggggtatccatcacctcaagcatttgtcatttctttgtgttacaaacattccaattatcgtcttagttatttaaaaatgtataaataagaccaagtattttctttttttggtatggtgctggatattggtaatataattatctgaaactttagacattaacctttcaataacaatattttattgtaataggctcataaatattttgaatatgtacaaatccacgtctctcagtctttaacatgactcatgtagtaggaaaaattaaaaccattggctttgaatcatttgtacatctcagttttctcatgctgataatagttgagtcaggcataagaatgccatttgaaaggagagcaattttatttgagcttttcagtgatttgttttcaattgccatttaagattcgggaatgtttactgattgatctatgccttccttgaacctttcgactttaccatctcatatccagtctgtcttcttcctaaaccagtggtctctaccagctgcatttactccccagtcacttattctttctgaatctttcttaatttggattcagcttccttagatctgcttaaagcactctctaaaggtttccaatgatctcctaatggaagataatggcattttcttgcttttattttttcttggcctctgcacacccgtgcacacacatacacacaaataacacctctttgcaagtttctccccttttggccttctgattgcttgacttacctggtgtagctactacttgtctgaattgttcctttccttttgctttgctggatcctactctaagtccctaactgtggataccacaacaaaatcatattgtcagtgcactgctcttcttttttctttccacagtcattttttctgagttcagcagagcactgcactacgttttagaagccatcttcatgactttctcttcagttcctcttagattttccacttcaacatgaactcaacctagatctcattccttcttcatttttcatgacgtgaaaaaaaatgcataataaccactctttttattcattaagaagtaacatagcaaacatactatagtggacagagcactgcacaaggcttaagtaaaagagaccaaaaaacggggaggctggttcttgccctcaacatatttataacagagacgagaagagaaacgagagttagcagtaatggtgatgggaaaggaggatccaggaaaggctccctggaattggccaggtttgcaatgagaaaataaaaaggcttttaatattttgatgttaactatttactgcttatccattaaaataacatggtacttcattattaacatttaactgtgctaaaaaaaaattgcctataagatctcatttcatcaatacaacaacctgtgcatatttttctgtttttctcaggtgagaagcaggaggtcagagaaggtgagtaacttgccaaaggacacacagctaaaacggcagcactagggttcgaggtgtttaactcctaagatcaaaattatattaatcaaaattttatgatttatgtcactttgaaacctaaagtgttaagaaaattgtccacaatagcacacacacatatcagacacagatttctaaatattataggttctaaggaagtgagaatagatgttctactaaaagagcataattctttcctttttaattgttaattcacctgtataactggaaagtttagatctaagaacttcagattgaagagatgctactattcatggtcttgaaaacagtggtttgtaggttctaattctgaaaagtactaaccaagatgaagcatcaccctgcagcatgttcattttatttaataaattcttatattgtgctcctgtgtgcaggcactgttctaagtgctttttaaatgtcagctcatttgatccacacagcggaggggtggtattattattattcccattttacaaatgaggacactaaagttatgtagctcactcagagttacagctaagaaggggctgagtttcaatgaggcagttcctagggccatatcttgaccactgtttaatgctccttgtctttctaggctgtgctttgtggcacctgcagaactgagcaattatagtcccggacacctttgtgctcatcacatttgatacacttgtcatttattaattatgctagtaacaatgtaatgtttttacttttgtaggtaaaagcatcaaaatcaccacagcaacaaagatttctcaggaaattataaatgctgagaacagtcttgttttccttgcattggcaggtgactcactgcatagatatgatcatcttcagagcctcattataggtttagcaattacattttaaaaattaacttggtacagctgagggtcatagatgacgcacaccacacttgctatttctcaatcctgatgtgaagttcataagcattgctctctggagtatgtcagagactaatgacaaactgattagctcatatggcttatgcaacaaaacatggcaaattttgttcagatatttttttcaaagttagtttatggtagaaatttgggctcatactagaaacagtctgtaactgttgtttagggaaccagctgagaagtatttaacctgtgtatctttcaattaatcttacttttcaaatgatagcagctaagaagttatgtggaagtgacttccattggagtggaatttgaatagtaatacattatttatatacctaaaggtagcatacaacaagattacacataaaataatacagtaatccgttctagggaaagtgtaaagacagaaaatcgagaccttggagaagaaaaacacaactgctgaactgtaagggccattaacatcgatataatcgagtcagtttttagtttttgtttcttaaaccctaaagcaaaagggagacattgcttaggtagatagttttagaagaaagcatataaagtgataagcataccaggcccaaagagtgaaatgttactgccttttgattgtaaagaaagggagaattacatggctgcagctgctattgtgagctgggcagaggttgctgtgtctttccatttcagctgcacagagagaaaagatttaggaaaatccaaagaaaaagataaccttgcagctgtctctgaaaagcctgcgttattactgtggtggcagtttcaggagctggaagtcttggtagaaggaaagctggagcagagacaaagagtgcaggtcctcattgatttcaggctggtgggatgccctgcttgtgtgcaccagcttaggagggggttggactcaacaaacataaacaaataataataaaagcaaactaatacaggttagattttatagtagttatggatgagaaaaaaggattaattgctttttaattattatgtttaagcattagcactccaacagagatcttaatttttgatgaaacaaaatgaggattagtgtgcattgtctatttcagtggtagcccgtctataactgaaaccatatgttatcattcagaaaactggaagacctgcccttgactaagaaatggccataatcaagtgctaacatcctctaattacaggatagggatgtagggatggtttttttttttttttttttttttttttttttgagacagggtcttgctctgttgcctgagctggagtgcagtggcgtgatcttagctcactgcaacctccacctcccaggttcaagcgattctcttgcctcagcttcttgagtagctagaattataggcctgtgccaccatgcccagctactttttgtattgctagtagagacaggattttgccatgttggccaggctgctcttgaacatattgaaagaactatttcaatacctttttttttttgaggtggtgtctcgctctgtcaccaagactggagtgcagtggcacgatcttagctcactgcaacccctgcctcctgggttcaagagattctcctgcctccctagtagatgggactacagatgcccgccaccatgcctggctaatttttgtatttttagtaggattggggttttgccatgttggccaggctggtctcaaactcctgacctcatgatctgcctgcctcggcctcccaaagtgctgggattacaggggtgagccaccgtgcccagccaggatgagaatgctttctgaattgaaatgatgtcactgcactgaaggatgggctctgctggaagtggagtatcttttggtgctgacatttccccccactttaggttttcctaaactcagttgaaagaggaacacacggccggacgcggtggctcatgcctgtaattccagcactttgggaggccgagacgggcagatcatgaggcaaggagttcaagtccagcctggccaacatataaaaccccgtctctactaaaaatacaaaaaattagccaggcgtgatggtgggtgcctgtaatcccagctattcaggaggctgaagcaggagaatcgcttgaacctgggaggcggaggttgcagtgagctgagatcgtgccactgcgcattttactgaatctaagatactaatgcaattgtcccaacattttttgtgtcactaagaaagaaataaacatcatcaataaattctgacactccatagaatatataatttatcccaatatccaaaatgctaaaacgtgtaaactatggctcttagaatcaattaaaaaccttttaaaaatatgtatgagaagaaaaacaagaaatgaatttattctgggatagtaattgttgaacttaatgttcatatttagtaatgaccaaattaatataagcaattacatttatcatgtcatgagtttggaaaaaaacataagttcacataatgtcttatgatccttacaactatcatgaaggatatgaagagtaaatattataacctcagtttgtcaaatagagaaactgaggtcaggagagattagtaactagtgtagggtgacactgcccaagctgaggtctgccattcacagttcaggaatctcccccgcccccttctagcatattcatatatgtcttttgacatgtcttttgggtaacaattgttattttttgataaactacaaagcacatattttagataagaaaataatatcatagtgttttaaggtctgtttgaaggaaaaaattaataaacaaatagtgggttacaaccctttgaaagaaaagttacaagaactactctatcagatgtaggaacgcttagttttaaaagtctctccccaagggcatctagcttgagtgccccactttggctgggctgcagttatcaaagtgtagctaaatagattacagtctgtgccaatgatggtctgtgagacgatgattgagagatgaagccatgtgcacgtgactctttgagagcggattatctcaggatgggaagttgcatggtgaggtgtggagtaatgagaatgcgtgagattttgggaaatctgagagccacaaaaggaatgaagacacttagaaagccgggacagctgaaatgaagcatatgtcctgaaaatatacaagggcaggcctgtgcgattctgtgagctattctgggttgcagagatttgggaggaaaactgatgaacccaaggctgtgagtacataaagcaaagttctatttcatcaggaaccaaagaactgggaggaaggaacctaggcatttggttgatttggtgaaaacaaaggcagtagagcaaggaaaagtagcaattgaatggtgggcatgagggataggcttctatttgcacagttacccctcagcagctgttgattccttcccaagcacaaggtatttcaatgacagcagccaggtaaataagggtgcttggcagtgacttagggatcaacctgtttgactttcctgtgcttgaaaaggaatggtaaataggaggagaaaaatgtacattatgaaaggagagttgggcatctgacattcatgaaaaaatctgacaattatggaataatctcaatgagctaggggcagtgcctatgttactttatgttaatctttgcagcagttgtatagaataggcattactatttccatcttactgcttcaaaattgagattcaaaaaggagagttaggcatctgacattcatgaaaaaatctgacaattatggaataatctcaatgagctaggggcagtgcctatgttactttattttaatctttgcaacagttgtatgaaataggcattactatttccatcttactgcttcaaaattgagattcaaaaaggtaaaatgcaatggctcatgcctgtaatcctagcactttgggaggccaaggcaggaggatcacttgattccaggagtttgagaccggcctaggcaacatagcaagaccccatctctacaaaataattttttaaatgtagctggtgtggtggtggtatgtgcctatagtcctagctatttgggaggctgagacaagaggattgcttgagcccaagagtttgaggctgcagtgagctatgatggtgccaccactctccagctggccgacagagtgagactctgtgtcaaaaaaaaaaaaaaaaaaaaaaaaagatgaaacgacttgcccaaggtcataataattggtagaaatgtgcatttgtctgacatcaaagcttttaataatattaccttgcctctgatgaatccgtgatgattaagtgaatgaaccaataaactaaaaaaaagaagaagagaatggggtgcacgctcccactcaacagtcgtggtttttaaaataaaatgtaaccattcaaataagcataaacgttctcgtgtcactaattttctagcactgctaaaagagggttcaaaataataaacacttaattctgaagtgaaagagtgttgttgtttcctggtctggggctgccttaccaagtattgtttgcagctgctgtttaaacaagcatgaacagtttggaggagggagtgggtgattagaaaacttgcaggacagccacacctttaagggtggcttgggagccttgaagcatcccaacagcgttttagcatttgtaagaaggctccaccctggactttaggttcctgcctacaactttttagagaaatggctgtaatgtgttggccttctaagcacttttagtgggctctcagattccctactcactcgatttctttgcatcttctttgcagctgggagaactgcttttctgctccacacagctttcaccttgacaaatgcgacttggcttaaatgtccctttagcctttttagcttgctcttctcatagcaaaaacagaaaaaaaaaaaaaaaagagcaagaataggaaaattacaattatgcaatgtgcagatccctaggcatgattgttgcttcccaatcaggagaagatttccctggcaaccgccctttcttactcccctggaagcccgaaattggtggaaaacttaatttgttttagattgcttaaaattaccttttaaggataagagtaaatacctacctctttaaatagaatttataccctttgtcacagctcttccaaataacatttttaaatgatcttgaaagaatagaacattgtaaacagtgatacatacggtaatttgcttaccatgaccctgtagaattattcttacccacaaacatttacagtatctgcagggtacccagcaccatagcaggggctgggtaaatacaccaaaagcattttataaaacacagtctctggtgttaaaggagtttataagttttgagtggatctggtgaatctggagggtggaggaaggaaacgagtaaagagcagctttaagtaagtcaagctgagtcgagtattaaatctcagtacctctgaatttcctactgggtttgaagcttgttcccataaatcccctttcctggtgatgaaactgttccttaaaaattgaacatatgtgtgtgaagtgcaaatgccactgataaatagccctgcaggggaatggcagagggcctaggtctgcagtccccaagggattggggagccatgggcctttggggactagtagaaaatgttactgaggtgctggatgacatcaaaaggggcactaactgtggataagacactctcgtgatatcacatcaagaaataataactaagatgctgggtgtggtagaatgcacctgtagtcccagctacttgggaggctgaggtgagaggatcacttgaatccaggagttcaagaccagcctgggcaacacagtgagacaagatattaagattctagtatgatgtagggacaggaagggaaatgaattttattaattattcacccactattttgacggtagtgaatacgtataggtttagctatcccagttccacttctggttcttgtagccaagcctcctgattttgctttgggaaaagctttctcctcaattcgaggtccatgtatttcaggagtagcccaagagttggggtaggacaatcagcaaatcacacttcctggcttcattgcttggctcagggcagaggtgaatgatctaagcttactcagtcagcaagcatctctggacctgtgcatgaaatgccaggacaaagatacctcctctctcactgaatatattaatagggatgcatgtgaccttaggacttgtcggtagccattttataacatctaatacacaaacataatttcacgtaatacaaaaaccttatgttatcttaatgccattgcaatgatgaaaaaattgagacttagtggtattaaataacttagaccaaatgttacagcttgtcagaattgaaagacaggtttgtcttactcaaatttctacactcttcttcacaccaggctgctgtctataagagtttcaaaactttgttatagtaattttctattaaacctaaaattcaagtgttaagttgctgagagatacaatcccatagcattttggaacttgtaacaagtactgagtgttagatgcttggcccagcactttgggaggccgaggcgggcagatcacctgaggtcaggagtttgagaccagcctggccaacatggtaaaaccctgtctatactaaaaatagaaaaattagccaggcttggtggctggcacctgtaatcccagctactcaggaggctgaggcaggagaattgcttgaacctgggaggtggaggttgcaatgagccaagatggtaccattacattccagcctgggtgacagagtgagactccctctcaaaaaaaaaaaaaaaaaaaaaaaaaaaaatagaggtctaggtctatggtaaatatattttttccactgactatataggagataagctaacttagagcccctttttagtttttaagataacttcattttctggtgtattggaggcatatctgttggcttggaattgttagttgagccatcatagctttccattattgttatagttactagtgtgctggtgtctatccaccatatcctatgatgtttgtggctataattcctagttgcaaacattgaattccctgaggcaaactagaattttgtgtctggtgttcagaagcagagatgtgggtagaagattagtgaccttcctcttgctgccaatagaagcccacatgtggaaacatcattcatcaacactaatccttggtgttgtctaaaatcacataaacctctcagcacatctgtctgttgctatacacacccaactacttgtcaaacttgtatattaattttttccttaggacacaaaatctgataatgttattattaacaaatagtatagctagagtctataaaatatcaagtcaatcatctcaagtattaatacttaattttaaaattaaaaattttaaaaaaggtttcggcaaatattttcctttagtctattatcaattttgaaatattaagtttcttaaatgaggcttacttgtgaatcattaacttacatatttgacatttataaacaaagaaaaatctcaatagatttaagaagagacacaactcagagcctcctgcttctcgtcatcatcatctgattcccactgcatcttggggctgtttggactttttattccaagctacatttataacacctgaaagcatacggcattcaaacgggccaaaataatctttccttcctgaatcccatccattctaatgcaatgaaaccgtcaaaccacatgcatctagttcttgagatcgggaaaataactgaataatattttggtgtcctcatgcacatgtgtgattcaaaattccactttcataatcatcatacagggaagttgcctcttgagggtgtgtactttaagctacgtttcaatctactttccacaggcagcaagatatctataatgaacagaggatgtcccacaaacatgtgtacagatgagtatgatacactcaatagttatccaaatcagtgcttccaggctagctcaaggtccattgaaaggaaatgttccaactggagtattcattacagggttctcttctttcactttaaactgattactttgtggttaagctggagttaaaagttccacttcttctgtgactttatcaaaatgctttagaagtattcattcacttgttcaacacatatttattgagtatatacagtcatcctatggtatctgtgggggactggttccaggataccaaaatccgtggatgcttaacttcctgatataaaatggtgtagtatttgcatataacctatgcattatcttcccatatactttaaatcatctctacattccttgtaataccaaatacaatgcctgcacatcacttcatttgtgtggattcaacatagtactcagggttcagcaaattcaagttttgttttgtgcaattttgtggattttttttccaaatatttttgacccatggttggttaaatccacagatgcagaactgatggatacatagagaggactgtatcatgaaacaggtgctattttaggtactggggataccgcaattcacaggcagagaaaaaaatctccgttcctcaaagaactaaaaatagaactaccatttgacccagcaatcatagtactgagtatatataggaaaataaagcactctaccaaaaatacacctgcactcacatgttgatcacagccctattaaactatactaaagtcatggaatcaacctaggtgctcatcaatcgtaggttggataaagaaaatgtggtacatatacactatggaatactatgcagccataaaaaaagaacaaaatcatgtcctttgcagcaacacaaatgcagctggaagccattatcctaaatgaattcatgcagaaacggaaaaccaaatactgcctgttctcacttgtaagtgggagctaaacgatgactacacacagacataaagatggcaacagtagacactgaggactccaaaagaggggatggtgaagggcaagggttgaaaaactatctactgagtactatgttcattatttggatgatgagttcaatagaagcccaaatctcagtgttatgcaatctatccacgtaacaagcctgcacatgtatgccctgaatctaaagttaaaaaataaagctctgctgtcatgaggaagggaaaggacagacactaataaaatgggcaaaatgtatgttaggcaatgatacgtactatggaaaaatgaaagcaggaaagggggaagactgtgtggaggagaggtgggtggtgggataggcatgttaatagtggcatcatcgcaggctacattaagagacctctaggtaccgactgactggagtcagggactctgccctggggtctggtggcagagtgctcaaggcacaaagaagcacagatgagaaagtcctgaagaaagggcaggactgccatgcacacagcgggaggccaggtgagtggagtggagtgagaggtggcagaaggtgaggacagtgatttggggagtgtgggggtccatttcaggaggctttacaggctgtggtaagggctgtggcatgtacttggggtgagatgggagtagaatggaggctttgatgagatacagacacattctagttcaagagaatcacgcaggttgctaagttgagaatggctcaagggcaacaagagtagaatcagagacccttggaggctcatgcaataacctagattgtagctaaaggggaggagccagggcagagcagcggtggagggagaagatagggccaagaggtttgctaacgatgatctggatgtgtggactgagaaacagtagttaagggcgactccaaggtttttgacctgatcagctggaaggactgaattcccattagctgagatgacaaggcctaaagaaggagtagactcaggatggaaattaggagttcagtttgggatgtaggaagtttgaaatgcccatgggtcatctaagcagagatgttgaatagggtagcttactatctaagactggggcttcagggtggctgcaaacatccctgtgggcatacacctgggacttagagctctgagaatgaaggaggtgacctaaggagtgagtgttggtagaagagagaaatggtccaagagccatgtccactcagcattgctccacccttagaagtttggagctaagaaaccacaaactaggcaggcttaaaacgatcaacaaagggtgtgttgtcggtcctggaagctgagtgaaaaaagtttttcaaagagaaaggagtaacgtactgtcacattgacttcttcccgtgatcttaatcccatgggacactaagtcagcaacgttaattttatctcttagtctcagttgccatagacaaaggattctgctgttcatgaatagctttatcttcccagcaagatgcaaacttcttgagagcaaggcttttgttttcttctttttctctctctctctacagcagtggcttttaaatagcttttggctacatctcacagcaagaaatacatcttactttggaaaccagtataagcacgtatacaagtgaaagacagagagaaatacttaaccttttggcatgccacacactgtctttattttcattctcttctgttgtattctatttaattaaaaataatggtgtttgtgacccattaaattgatttcactaccactaattagttgctaccattgcttagaaaagcactactgttagagtgtctgccacagtgctctgccacattcattattaatcagagagacactgttattcatcttcattccttctcaagtaccttctataaagcaagtacttaatagatgcttgccaaatgaatagttttgagaccctaaagtaatacttcttgaattgggctccttggtctttagttacctttacttttactgattgtacttctgtactgattgtagtcgtgtagaagaatatttcttaaaacctctgtgtcttcagaataaacacagacctgcatgtctttttaaagaggtccctgtgtagccaagagtcagacaaaacaccagccagggttggagatgacagcccagatgaagtgagtccatcatctgggttatcacatgtgcaaagttagggcaagaatcctgaagtttgaatgctttttcatgttcttgtacatcagcctctgggggccaggggcagtggtgttcaaaacatttttaaaaacaagacaggccaggcacagtggctcacgcctgtaatcccaacacgttgggaggctgaggcgggaggcttgcttgagcccaggtgtttgagatcagcctgggcaacagagcaagacctcatttcaacaaactatttaaatattagttgggtgtggaggcatgtgcctgtagtcctagctacttgggaggctgaggtgagaggatctcctgagcctaggagctgaaggctccagtgagttgtgatcaggccactgcactccagcctgggtgacagagcaagactctatctcaaaaaaaaaaaaaaaaaaaaaaaaggacaaaaagacaaaacaaaacctttaaaaaaaaaactttcaagaacaatcccatctttttattataatttacatagtattcaatgtcaatatgaaatattgattatttaaaaatgggagtagaaatctttcattaaatatctatgacccaaagtcgatggagctgggaaaatcattagtactaacaatgtcttagaattttgaaatgcccaactacagaaatgatatataatttaacccagacatttcatttaaagaatctttaaaataagagccaggtacatggtaaagtcctcaataaatgttagctaatgtttaaatccttctctatagagaatgcttataaaagtggcactgaagaaaataaaatatttttccaccatgtaattcttacttaggtagtttttcacttataaggaaggaggatggtgcaatgaatacagtacatcaggtcaacctgagttcaaatctgactctacttagaccagacatgtgattttggcctaattacctgaacatcttttaacttcaggttttcaaacataaagtgaggacagcaatacctacttcagagactgactataaagatagagatgatataaagtaacatatgacatgctaactcattcaaagtgtatttgtaggttgctttttcatatagtaatcatgtttaaataacggttaagttcccacatggtgcaaacccttaaagcttgtttcattcatgatagagctgacccttaatggattgtgcaatagatccaagactctctgagcttgggggtgggagggggtggagggtggggaaggttagtacacttgggggaatctctagaggcctgtgtataggggactgtggatcagtcagggttctcagaagagaacaggaaaaaaaaagatttattttagagatgactgtggtgagtagcaagtctgaaatccacagggtggtctggcaggctggaaactcaggctggagttgattctgcagtcttgagacagaatcttgtcaataaaacctcaatttttggtcataaggcctttcaactgattggttgaggcccatccacattatggagggtaatcttctttacataaagtctactgattatagattttaaccacgtgtatacaattactttactgcaacacctagattagggtttgattgggcactgggtactctaaactcagcaggtggctgcacagaactaaccatatagacaggaattcgggtgggcagcttctgaggcagtgggagggagacttgatgggcagacagggccgctgcagtgcttattgatattcagattctcttcagctgtgagctgcatatgctccgttcattttctgaggaactatggtttgggtcaaagacgtgagtgtaaagaccatctcctcactggttgttcaggagacccacaaaggccatgtaagcaaagtgagactcttactggctctgtaccagcacctagcaaggtgcctggcatgtcaatttcattgacaatgttctttaagggcaaaagagtcattcatggaatttttatttcttgttgacaaatgaacaggaaaatctacagtcacctgaaacatcccaccatggtaaataaacaggaaattggccaggcgtggtggctcacacctgtaatcccagcactttgggaggctgaggtgggcggatcacgatgtcaggagttcaagaccagcctggctaacatggtgaaaccccatctctattaaagatacaaaaaattagccgggtgtggtggcacatgcctgcaatcccagctactcgggaggctgggggcagaagaataccttgaacccgggaggcggaggttgcagggagccgagatcttgccattgcactccagcctgggaaccagggcaagactctgtctcaaaaataaataaataaacaggaaatttatagactcatcttttatttaagccctttgtattctgaaagacaaagaattccataatgcccggccttgataaaacaaatatagagctaaccttaaaaaaatcaagatttactgtagcaacttgcacatactactaatgtaacactgatcacattgttttaaaaccatttgtttatagatcagtctcacccaccaatctgtaagcaacttgagaggagggatgatgtcatttgtctggcagagaccaatattcattcctataattctagttctaagcagagtataaaagaaaacaacatattgtaaagtaaaagtgctcatgaaatctctaattacatcactcaggttgtacctattttattcaactgagaaataaagtatggacacctttcatcccagattttcctctaccaagggcagggaagaaacctcgcaatggttgtgggcaaacagggatcatggaggaacacatctccgtgcacgaagttgctggtgcatgtgtgtagagggggtatgaatgaccagtatccagaagagaggctcttttggcatccaaggagctgcagttggatgttgctgtggagatatttggggaagcaaggccacaacccccagcagggtcaactgaactctactaggcccagagagacccatcaccagatcatggcaggacgagtcaaacagaatctgaagactgtcatctcaccctgtgtattccaaagcacattttatggatcaccaatccttttttttttaatactttaagttctgtgatgcatgtgcagaacatgcaggtttgttggatcaccagtccttagaaatgttctgtgaaatgtggttccaagagggtttgggagatgctttatactgtattgttctcttaaagagtttccatccatatgagcatcttaaagattctaggatgtctgccaatatagaattctgaatacagtactcagtttctcaaattcaactccttttcttcacattaatatctattcaaatcatcctttgggaaatgtcagcttcttcacatacaaacaaagaaattgacatccagaatgtaaattacagcttatatggctaataagtggcagaactgggttagaattcagatctcctttggcccattgcactttcccagttcatcacactgcaactatttatctcaccactgaactcttcatgaatacctttcaacaaattctgtgaaactgttttgatctccctatatcaacatgtagaagacaaacatgaaggaatggctactgtgtataggagggactcagcctttggaaacttcatattttgtgtcaagcctgtgccaggatatgtttcattcaagttatcagtgcaaatgagaggtggtaatagagacatgtaagtgacatggatctatacaaataggtttgggtcacatcttgtattttacaccaagaacctagatcatgccaaccttttgatggtaaaaactgtaatgagagaagaatgcttcgtcaagataataaatgattacctttgcatatagaaataaccagaacccatgcatgcacactccattattccttctgtctcccgacattgactggaattcagtctttagtatcctctctctgtcacacacacatgaacgcacaagcacacttcatattcagtgatgatgtttttcctattacaaaaactgtgaactacccatggacagtaataatgcagatatatttcatttgagaaaggctttcttttgtcattttctttctttacctttttggtgatgagtcaagctgacctgctgggtgagatggttcagatattcatgcttcctcctagtaacgatgctggctttctgcaattcaaatgacccactacagctgcacgagtaggcacttagccacctactccagttagtaattattcgtttagactaaaaaattctgaatcaatagaaaaacattgaattaagcctcatttttgatatctcatttgacaaaggaatcatgttatttttccttgcagtggatttagataaacatccagaaaaaaaaaatgttttgtgttggaacggccacagagaaccttctttttttttttttcccaggagggaacataattctaagtcaggaaaaataatttatgtggcttcctagtttctgcccaaaccagccatatgctctcaatattactggaagaagtctgaaacagaaaatacaaagtaggggcaagaaggcccttgtgggggatgcaggggtggaaaacgggaggcagcttaggtgccccccccatcactgaggcagaggagtgagagcacctttctcctttgtacacccacttgtctgtcaactttcctccttccatttgaggctgctcctggatgtaaattttgacctgctttcagttgtaataaatacatgaggcatagaagtaagagaagctcaaatagctttctaaaggagaatctcataaataacagtagcttttgttgtgccctattacattggtggtgtaattttcttttttctttaattttctatgaattataagattccttccttccttccttccttccttccttccttccttccttccttccttccttccttccttccttccttccttccttccttccttccttccttccttccttccttcctccttgtttttttttgacagggtctcactttctcccccaggctggagtgcagtggtgcaatcacagctcactgcagcctcgatctttcaggctcaagcaatccttccacttcagcctcctgagtagctagaaccacaggcacatgccaccacgcccagttaatttttgtatttttggtagagatggggttttgccatgttgcccaggcttgtctcaaactcctgaccctcaagtgatctgcccgcctcagcctcccaaagtgctgggattacaggtgtgagccaccgcatctggactgttttgttttgatttactaaacagcttttatttttctcttctgttacacagaaacaaacaaaaagataattattttgtttgggaggcatttgggtatcatgaaatatttaaatcagagatttctagcacgtgtgatcaatgaaaatagagggaaactaggacttctgaactgatttccttttggagcattctcatagatgaatctacaaggatacaatgatttgtctgaatgataaatttacctgaataatttatctgaatgataaaattttgatacctttattaagatacttgaaggtgttggtttacaaaagattaagtaccacagtgtaaaaattctattgttgcattaatttgattagcaatgaaaaactcagaatccatttctaaagaagttgataatacaaataaaacatttacctaaagactgactatacacaaataatttctgcaatttatccaactcataaattggtatagagatttatgggccgggcgtggtggttcacacctgtgatcccagcactttgggaggccgaggcgggtggatcatgaggtcaggagatccagactatcctggctaacacggtgaaactccgtctctactaaaaatacaaaaaattagccgggtgtggtggcgggcacctgtagtcccagctactcaggaggctgaggcaggagactggcgtgaacccaggaggcggagcttgcagtgagccgagatcgcgccactgcactccagcctgggagatagagcaagactctgtctcaaaaaaaaaaaaaaaaaaaaaaaaagatttatgtaatagatgattaatcatagcactggttgtaaaagcaaaatgcatggtagtgaatactgttccccaatatgtattgctaatatactagttctttaacatgtgatgttaatatagtacaaagtagcttcattaaagaaagagttttgatttgattcaatcctgtgttcccggtgtctggaagtgagcttggcacacagtagatgagcattaaacatttgccaaatgaatggacactccatataatcaaatatatgtacataggtgaatgtgtacgtacacatatacatatttgtatgtttgactatatgtagaaaatagcagaaggcgaatgttaaaatggtaacagtgatggctgcctttggttaaataagactggaacacggtgggggagggagcttttacttttaaccctgtatcaatctgtactatttgaatttttttcacaattagcatatgtaacttttattaaaaaatgaattctgtgaaagaaccccaaatgtacgaccactggagatctgcattttagaatttgtgttgtctttacattatctcaccttaaagatacaactccattatgtacacgataacctaaggaacaggctttgactggaaattgatgaaacttggaccacagaatcagaaattagaatcttcaaagaatcgtcattacagattatattttgcttttccatttcttcagcttcaaccagaattttatattcaaagttaagaaaatttacatgtaactgtatgcaaaaacccatatggcctgtgtcagtctgtaccacttattttcaatgagataaaatagcttatttaaactttgaattttcccattgggtttagatgatttagctgtttatccagcagccctatacttaaaaatagatgagatgacatttgtgggttctttaaaaaaataccctttggagaaagaagcagaacactaatgccatatttaccatttacattatataagaatggcaagtttttatagaatgagtgcttcatagaaaatatcctcctttctggccaggcgtggtggctcacgcctgtaatcccagcactttgggaggctgagggggcagatcatgaagtcaggagatcaagaccatcctgggtaacacggtgaaaccctgtctctactaaaaacacaaaaaattagctgggcgtggtggcgcgcgactgtagttccagctacttgggaggctgaggcaggagaatcgcttgaatctgggaagtggaagttgcggtgagccaagatcgcgtcattgcactccagtgtggcaacagagcaaggctccgtctcaaaaaaaaaaaaaaaaagaaaatatcctcctttctaacataaaagctatagctcttctgtaaccagtcacaatcattgcatatatgagggcatcccacataagtttcattatttgatgattataattaatttaatggaaacataaacatggttggaaagtttccaataatagcataggaagatttttctctcccttctcccttccaattatgtagtgcctccccgccatcgccatcattcttttatcaattatttattgtgtgtctgctatgtgggaggcacagttgttataaaacaaatataaagttgatgttgactatatttaacttgaccttatatacctatttaataattatagcaacctgccaaaaatgagaagtgattaatattagccctaaacctgctgtcatacgattccacagagttcaagataagaattaacataagttaagctgaaaatatactgtcacctgaaattgcaaactgggtaggtatacaggagaacgatagtcaattaaagtatgaaatattcaaatcagtgttccaatcttggtagcattgctgatggcaaaggatgatgacaccaggaggaaatgaaagcaaacacatcactttcctactcagaatagtacacctatcttaggatcttactgattttatttattaaaaaaatacactttaggagaaaagtgcatttatcgggtaatatgaaagaggaaatgaggtctgtgtgagggcatgggtatatgccatcactatgcaacattttaatcttcagtttttataggagtttcctctgagcactcatcaaaggtaatgggattagattttttttcttcctttgtcaaatgttttcctcaccctgaatactgtcacacacgtcgcaggtggatgagatttgtccactgaggaggaattgcacttttcgaccctcctaggatgtgacttgaatacctggcttgttccatgttgggcttgccacctgctcctgctctgaggtagccgctgacctaaaggcatcgcaagggtggtgaggtgaagagggagcaagtgttctcagccacacatttttccatctcccctcagaatccacctctcagaggtagcctaagtggccctcctaccggatgcgttgttttatcacgactgcagctttcttttcttagattctgccaatgcttttaatgggctggtcccctgcgaagagcagggattttgtgttttcttttgaagagcgtggtagatttctgagcaccctgtggcagtctgtaaaagtgataaatacaaatgatgaacaatgaagcaggctcttgagttctggggctggctacaggagaactcagaacgagggaaaaaaataaatcaatttctaacacaaaggcaagatttagcctctcattagatccaactgctacatgtaaagaagtttgttaagaaaatggcacagggattttgtgaggtggagccaagcctgcgaaataggctttcaagatgtgttttctatcttccttccaattttgggtgctatgatgtaacaggattttgaaatccaagcatatgttattttctttcttcttttccttttatgtttaaacctccattatgatgaattagctttccttcctcaataatttagagtttattttctataaaaaggaagcatttagaaatgtgatattaggcatatggccccctttcagatccttccagttctatttgtatatggttttagactcagctgtaaatatattaatttatgcagcaatggatattataaatcctacactttatatagatgtaggctctttcttttcataaacaaaacttgaaacaatactaaatttttaaaaagatagacataattgataatttcactttgagaaagcaaagtaacccagattgtaaatgttatggacaaaggctgggcgcagtggctcatgcctgtaattctagcacttcgggaggccgaggttggtagattgcctgagctcgggagtttgagaccagcctgggcaacatggtgaaaccccgtctctactaaaaatacaaaaaaaattagctgggcgtggtggtgtgtgcctgtaaagccagctatttggggggctaaggcacgagaattgcttgaacctgggagacggaggttgcagtgagccaagatcaagccactgcactccagcctgggcgacagagtgagattctgtcaaaaaaaaaaaaaaaaaaaaaaaaaaaaaaaagtcagggacaaggataaatgcaaattgtacacatttctctctcttgattttatgatagtttggaaaagaaccattttttaaaaaccagtatattactaatggatggcatctaatgtcttagtaattaaaaaaaatatagattgggatggagccacagaattcaacaatggggagaagagagaaatagaaggcagagacaattttagaataatagtcaactgtctgtggaaaaaggggagcttcagttagtgaatgaaagaattgagttttcctgatgttttcatctaagattaccctcataccacatgcacagggcttgatcataaagtatttgaagttagtaaaaatgtaactagtccagttgagctaaggaaatatcaaaatgtcaattgttctttcccaagtttagtcaagctaatcagattctttcagttgttaagaaatattctgttgtatggtttatgtgtaaatatgactagaaattctcagcagtggtaaagcatcgtaactgggcatggttgctacacatatttgtatctctgatagtgcctggcattgtcccttgcatacacaaaaagttcaaaactacatgcttaaaagtgaaggatttcactctcccctgaaagcactctatttgatagagagcagcactcttttgtgcttacagcaatgagtaaactcttagagccaggttgtgaactgcttgttgtggatatatgctgtagacatttaatcacttgataactcattagtgatatatttaattcatctaagatgatttatgtttcaaatgtgaacatgatgctttaccattacttttactatttaataaaaagataattgttgcatccatttataaattttgcattaaacatgacacatttatcttttcaaagaaaataattgttaatcttagaaaattttcctcaaatgtgcaatacaccaggcaaaaaccaaactctggttttactgtacttgaaaataaattagcatgcatttcacatggtattttgttattctcctttcatagcctgctttggttaaaaaaaaatcatgtcataaaagagatggcaaattagatctgggagtgaagaaaacttgttcctaaattttatcttagatattgaactactaaatagatgataatgaaattaatgtctatttcatgcatgaagcagctctattacgtgcttttataatttcttgcttttgagaggttaaggtggaagggcttattttctttagacactgatcctgggattcatgaacttcattattctctttatcttatgataactatgcccacagggtacaattaatgaattaattcatcaatccactcattcacatttatcgaatgcttcctgtgtgccaagcactgtgcgagtagaaaccacaagaatcaataaaatcaatagacttatatttgtctctagggggtctactgtctattgggggacaggtagaattattggaggggagggagcaacaagccctcaaacttggtgtcagcaaagtgtgaaaatcactagaaaatccacacgtaggcattggtagcatgggagctagtttaaggaggttatacttgtcttgggacttgagtgatgggaaagactttggcaactgggcaaagagaagagaggagggcagtacagaagtgggaacagaaacatgagcacataaacaggcactatatatactcatgggaagcagcaagcttcacttcggacctagggcctctcagggtactgctagaaacagattctgttgaaggtattcagcttgtgctaatagtctgtacttgttttaaagacccaggaggtctttttcagaatgtattttcttgaacagcctctttctatcaccaacatggcactgagaacaatagaaaacagctccttttgtttctgggacacacctcctcttttctaagattcatgcctggttgcccagggaaattcctcaaaccagcctttattctgagctgatcactctcttctgaacaggacattccgccatctgctcagacaccctggctgtcagccccaccctgaatcaccaggcatcacctcccttctcaaggagacctcacttctctttatgtctaaagccccacaaatggctttactccttcaaaaccctctctttctagacttcctctagcgccagcgttgcaattcctctgaccacgtatttaggcacacatataatatttagagggcctctctactccacatttaaccctgtaatatcatcttttttatattaacatcttattcctctttatcagctcatttggagccatgtttcatttcccaaaatatcaccactatattcttttggctgttgcatcaaattaccataaacccagtggcttaaaaaatctcatatttaatctcttacagttgtggaggccagaagtccaaaatagtttcactgagctgaaaccaagatagcagagctgggcgtcctctggaggctcgaggggagaatccatttccctgccttttccccttgtcccatggtccctttctccatcttcacaaccaagagcaaagcatcttcaaatctctctccgcttccacggccacatagtctccctctgcttccttcttaaaagaacacttgtgattacatttagagcccacccagataatccaagacaatctcccaccttaagatccttaatgtaatcacatctgcaaagtcatcttttccacataaggtaacatcctcagtttcctgagattagagtgtggccccatctggagcctctattccactaactacgaccacccacactaacaccattgttaatcgagtacttactctgtgccaggcattattttatgataggcaccatcattatctccattttacagatgaagcagttgaggcacagaaagctttagtaatttagtaaagtcatatagacagagaagtggtagaaagagcattcaaatctaggtctgttcaactggaaagctgtcactcattcacggaacaccctgttgcctctcacattttccagctgactgtgtgcgtctgtgttctggtttgaattaaaggaacctaaaaactctcatggtcaacacaaaatggaaaatttcccagaaactgcacatgtctcttctctagctgtacttgtagatatttcttccacaaagagcatagctaattaactggttaagtggtaacaagtagcagtttgcttccccagtgaaataccagtggaagcccccctaagtagtctgacatcaggctacggttgaagaacatgaagggccaactgagttcaggcaaagtgctatggaaacagtaatcacagagcaggtccaggaaaataatgcctgtttaaaaggacaatggaaatgaaacagaaatgtaaggcccagctactttctctgtagagaaagtgagaaaggctgaaaactcctgtagacataaggcttgaagaagaaagcttgagaataaagaatacagcacaaagggaagtactttcagtttaatttaagggaaaaatacactcagggctgactattggagatcagaaggcaaatgaacactggcaggcagtgagaaattaaggatttaaaaaatgatccttatacatttttaagaataaactttttcttttattctaaggaggcagtaaatcacgtggaaaatagaaagaactggtccctggagtcaaacagactgagggtcccattccttaatatcagcatcatacatgacaacttgagcctcagttctttcatttacaaaatgggaacaacaacacgaagattaaggaaattatatgaaccaccttagcacagtactttgcaggaatgagtagcataaaaaatcattgcatctggtttctgcaacctcagcaagacaaaaggtaatacagcttgttaaagagtccagctagctactagtgcattcagagagaattcactctgtgccaggcatggtgctggatcacgggccacaactatgaataagagaccagctatgttctttcatgaaacgatctagtggaagagtcaaacaagaaaacaggcaatcctacctaagatagaagaagcatgataaggaaatgatgggtgctatgagagcatattgggagaggatacctcacttaaacttggccagtcagagaaggcttccaggaggaaacattatcttagatgagactggaaagttgggaagaggttaagtagggaagagaggagtttggcaggggtggggggtgaggggtggagggggttgtaggcaggcagaagagacaaaggaggaagcagctcatgcaaaggtcctgggcaagagaacatggcactgctaagaaagagaaaagcagaccagtatggctgaaatgcagagtggacagagggagtgttaggaaatgagattgtgaaggaaaaaggtccccagctacatcatactctctaagtcatgtttaaaagtttggactttatcccaagggtaaagaggaaccagtgaaggatttttaagcagaagatttaatgattttatctgtattttagaaagatcatttgggctataatgtgcaggatgaactggatttaggagaaactagaggcaggaagaccactaggagatatttacaatagtctagctgagaaatgatggaggtttaactgggatcgtggcaaaaggaatggcgagaagtggacagaaataagatttggtgtttttttttttttccactcattcattcattcaactaacttttatgagtctgccttagaggagagacacgagggtgagatagagagaggtatcaagattggccccatgtttcagcgttaaaaaaaagcatagatagtggtgccatttacaggggtaggaaacatggggtagcaggctcttgggaagatactgagtgcagtttttgacatgataggtttttgtgtcatgcctttatttttgtaacctcgatatctttgtgtaccccaacctgtgagaatagatgaggtcatattaacagtaataaccaagtccagtgatactttagttctctctcatctttgttcctcgcccagttaattctgattgtccacaaggatgagcttcacgtgtatttgggaacaaatctgtttgctgccttctgtcaggcctttttgcaatggtgccaagaacttcttatgactgtgggccatctgtactgatgctgctgcctcagtcaccactgtcctcagctggtacctgctctgtggcctttgatgtgtgtgtgtatatagggaaggtgggggtgcttctttctctagatattctctattaattaactaacacagagctaatatgtgagtttgtaaataacacatgccttgcatttggcattgctaaaaataccttcaagggctaacaactttgcatcttatctcccagcatgcatgggttgaccactacagacaaaagatcatgaagctgatgctggccaaagagccttgcacattttcaccctcaagttggttttatgtagcaattgcggataaaaagctctgctggtataaaaatcttcttattgtacaaatggcaggaaatagaagacaacattgcggtggttacaaaaatttgtttcctagtttgtttctgccagctttaaattgaacatagatcaatctataggttctgaattagtaatattggggagacatgaaatgagaaaaatagcagaattaaataagcataacagtgcacggggcagcccagcatgctctggagcgatgaggggtgagagagaaaggaagaaaagaagaaaacaaaatgaacacctttcaaatccaaaacaatgcaccacgtttgagcctccaatatagttttacaaagacagaatagccatgaaatcaaacatttaagtataaataggtaacatatgtctgtcttattgttgttaaaaattaactgtgatagactgaaattccattccacattcctacttcttgatgacttagtaaattacaggcatttcaagagaaatgcctaaaaattttaggtgaaccatcgacgatattttgggtggaagtaagttatatgtggtagctaaatacttgtgctcaagctctcagcatcctgtttatacttctaggaaagacatatgaaatgtgaacaatttcaaggaatgaaataaatgttcttctttatctataaaagtctgattgtggtgtttaaaggcttccatgaaacaaaaacacctgtgcccacagctcgtctcccgtgcataaaaacagaatacaaagatgagacagtaggaataggaggaacattttctatttctccaatatttcccacatgctttggctgtttttgaatagaccttctgaaatatcttttgaggtcacctactttgtgaacctaaagtctctgatttttcaggtgacatggcagcaagcccgaatgtctgaaaacataaatcttagttataatttccatttttgtcattttgctagaaaagaaaaatatgataatttcttccccagcttgctaagcctttgctagtttcaggaatttctgctaccatctgatgaaaatcaaaatccccgtattaaacaccaaaaagctatatcacaaaaaagtgaagccatcctagtaagtgcctcatcacttcttgtttttgagatagagtaaccaaggtagcaatagaagtctcagagagagctgatggtttctaattccataaacttagtggacaagtacattttccacatgaaccaaaatcattgccgccatggtgaatcaaaaaagtaataacaaaaattcacattaccagcacgctgttattttaaaaatccaattttacaaaataaaactcacctaaactgaagctgtggaataattttagcaattgaaaattactaccttctctagaataacatgtacttagaaatgaaatgattcagaaatcaacatgatgtacgtattctgcttttctttgcagcttagagcaaattcaacatcaatttacactatatcatagtaaatatattcaacaatcagtgcttaagtaatttagcctgtctttgctgcatctaaatattctgctgtttaactaaattcactccatactatagatgataaaaatattaatatacacatttcattcttattaaaaagctggatttctcccttagccctgcaagtaccataagcaaccaaatcagaggaaaagggtatgttggggctactctttataaaattgttcatccccagttcacagacatcatgaaacatgaaattaactccagtatgttaaaagaaagatgatagattagcacagaaatcaagcacaaagaaacgatttattttcctttccatagcccagaattgctattagcttaccttattagctggaatgccaaacagaatgtctttatggaaaattaagttcattattcatctcagctttgatttggtatagtgcagctgagagcatttagcttctctctatgatttgccgattctaagtggttgagtgaggcagtaaacacaggacttgggggtggggggagagtggttggtcatggctcacaactcaagatttgcaactttacattttcattcatataaagatacttaatgaaataaaaccctatagctgaagaataacacttaagtgaatacttagtgcagatttttcagcctgtgcaattttgcatagcagttgtacttacagagtctggcatgctcactgtcccagcaaaatcatattgctatctttcattatctcagtaaattctgggctattgatcactttgcagcccatatagggggtaacgtatattctgtcaaatggaagtccccatcagggaacgatccttgcagcttgctaaaagaagcatgcctgattgtctgactagtgatggaaagacagatgccttttacaatgttgaagtgtgcacatgcacaaattggatagaacattcagtcagctaacaaacagagagattttaaggagtaaaataacaatagatttccatccttgagatatcaaattctcttttagagaaaaattaagtaatacttctcaacaattcattcattttcttcaaaagaattaaacgtgttgtagaaacctcttggcaaacacttttcattttttaaaaaattgacttccatagagaaacatcccagaaaatcttattgaaagtgtggtgtgtgtgtgtgtgtgtgtgtgtgtgtgtgtgtgtgtctcatttcgggatggggcaaaggaactgttgcagcgtcctcttccaagtatttcactttataagttttaagtgggcagcatttactaaaatccagctttactgagtgcaatctgcaaccacatcagcaagatcacttttaggttatcaatagacaaggacaatacaatttcagtagagcaaagacttacacctttcctttcttcgtcaccatacaaaaccaaaccctaaaactttcctctactgaattaataaaagcacaggtgcatttaataagaaatgataaggaaaattataattaaatgattggtttgtttcaaagtgttaagtatagtgtcaccatatgacccagcaatcacgcttttaggcatataccaggagaaatgaaagcaaatgtccacacaaacacttgtacacaaatgttcacagcaccattattcacaatagtcaaaaagtggaaacaacccttgtatccactaactgatgaaaggattaaaagtgtagtatatccatacaataaaacattatttggaatgaaaagaaatgaaatattgatacctgctataacatggataaatcttaaaaatagtatgataattgaaagaggccagtctcaaaagatcacatattacaatattctatttatatgaaatgtccagaaaaggcagaatctatagggacagaaaagtagactagtggttgccctggacctggggtagggggaccaggaagtgattgctaacaggtacaggattccttattggagtgaagaaaatatttttatcttagatcttggtgatggttgcacaattgtgaacacattaaacccattaaattgtctactttaaatgggtaaataatatcacaataaaatttattttaacatgatgcattacattgatttgtgaatgttaaattaactttacatccctaagataacatttgcttgctcatgatatatgatcttttaaatatattgatgtattcaatttgttaaagggcttgcatgtctattttataaggaagctaggtcagtaaatttcttttcttgtaatatctttttcttgttttggtatcaggatagcattggcctaagaaaataaatcctgtttctgaaaaaaagagatgttataaaattattaatttgccaaaagaacgttgtcatatgtttataattatatgaatgagttttatataacacattctacacaaggcagatagggagaggttggggaagagaaaggatgaccccaaatgtgggatgctcttgaagactagaaggctgcagacgtatctcaagaaccacctgtgccggtgttttatcatggctaattttcagcaagaaaacaaatctccaaatctgcaagagtaagagcaccaggaaaaagaggaggactaggaagaagaggaagaagagaataaagatgaaggggaggaataaaagaaggaggaagaggaagacagaggagaataagatgagggggagagctgtgtttgatcaagagcatgaaagggcaggcaattcaggggaaggtaggatcaccaaacgtaattatagcaacatcctaccaaatgatccagacgagaataaaggaagcctagaaagaaaccaaaagaattgcacaatgagggttttgaagtattccaatgaaagaaacctgttttaaacatgagagatgggttcacaatcaagaaagaacacaggtaagtgataagtgcctacacaaagtgccccaaaagggctaaagcccagaatgaaatgaggtttgtgaattttaaaaagagacaagggccaggcacggtgtctcacttctgtaatcccaacattttgggaagctgagatgtttgagacctccctgggcaacagagtgggaccctgtctctacagaaaataaaaaaattaaccaggtaaaattagcatgcaagtagtcccagctgattaggaagctgaggtgggaggatcctttgagctcaggtgtttgaagctgcagtgagtcatgatcgtgccattgcactccagcctggatgatggagcaaggccccgtctcaaaaaaaaaaaaaaaaaaaaaaaaaaaaaaagccaaggacagtaaacacaaaaaagactttttaaaagagatggcttagaatgaatagaatgaggaaaatcccaaggcttgttccagatggtacaatgtgaacagatgataatgaaagaggaggaagaggaggaggagcagtagggaggagggaggagaaggacaaatatcaaactctcacacttttatttttctactattttctctatcagaggacatgatcttcaaattttaaaagggagaagacgcatggtaaagagaaatttgaactccagcaaaacctcttctatgcagatgactcatgcatttatatttttgttccagaactcccatgtgagagtcaggtacctgccaacttcacttagatacttcaaagtgctgcatacatagcaccttcaaaaccaaactctcccgcccccatctccaccccagcagtaaaagtactgggctcctgtagagttctgtacttcagtgaatggaacaactgtcttctacgcaggtcagaaacctgggtactctttttggacacttccctctcctgccatatcaccaagagatattgatttggaatctccggaaaccacccacttaccccaatatcactgtcaccatcctagtcccagtaaccattttcttgcacctggatattacatttgtcttctaaccgattctcctcttccactgtccttctccttccactccatccaaaaggatgttttcagagggcaaagtagatattagctttctttgctcctccccccaacactagcaaggatataaagattcaaatgttaaacgtgacctctggggccctgtgacatggtcctgcatctttccagacttatctagcactatcttggtgatccagccgtgctggattcatttctcacccttttgtttctttctgcctttgcaaacgctcttccctctactggaggcatgattcccttggctcattgtctgattaagtctagattttcttcagacctcatcccagtcttacttcatagggcatgctttgctgaacatctcaagtcaatatgcgattatctaatctcttctgtaggtattgagccaagtgatcatttgggatcaactttacttatgagcagaaggctcaaaaggtgcatgggtcactacactcttagtatcttcaaagagactcacctaaggttgagtctctttgttaaattcactgtggagagaactgactctctgctagccacccttctaataggatgagtatgaggggtgcattgcatggagggaggcaggaaataaacactttgagatcaaggacactacagaagatctcaggtactagatgcataggggagtgctaagaaataccaattccgcatgccctagactccatagggccctagtccagtggaaagttgaattctgctatcatttctcccaatgaagaaagggacagccctgattgcagacatttcactgccagagaaccagggcagagctcccagaatagttcaacagcagcccttaccatggtagtaaactgacattcatttgtgtgattgatttgagaatgtttatctcaccactgaacaatgggagcgcaagagcagcaatcatatatgtttctgatcatcttgttatcctttgcctctactcggggcctagtgatagtaggcatttaataaatatttttgaatgaatgaatgacagagctcttaaattgctaggctgtgctgagagggtaatgacagcattaactgcgattagcaaaacacttgaaaccaagtgttttatatagagtgttagtactagtggtcttgtttataaatctgacctttctatatctttctctggccaataacactgtgatgccattaaggcatgaagattcaatattagtcaaacacatacattctgcttagaaaattagcatgtgggatgttgaggccaggtgcagtggctcacgtctgtaatcccagcactttgggaggctgaggtgggcggatcacttcaagtcaggagttcaagagcagcctggccaacgtggtgaaactaacaagacaaaaattaaaatacaaaaatctctactaaaaatacaaaaattagccaggcattgtggtggctgcttgtaatcccagctactcgggaggctgaggcaggagaatcacttgaacctagtgaggcagaggttgcagtgagctgagattgtgtcactgcactctagtctgggtgacagagcaagactccatctcaaaaaaaaaattagcatgtgggatgtcgatttaaaatattataagatccattagatgaatgatttaattttcccaatgaagacatttttctttttaaaaagaggacacacctaaaaatattaagctcgaatttttgtgcttgacaaattataacacaaagaacttttggtagggcccccaaaatcaacctgggcattcttaaagattgttaaaagaaacggtggtggcaaaacactgaagatagacaagacttttgaagctttaaagaaatatgttctgtatatagtagcatgataggcttgactttatacctcagcatcatcctagaacaggctgttaaatggaaggtccgtgagtgcttaaagaagcaacccacatttacaaagaagtagtatgctaagctgactgtgctttatttttattttttatttttgaagattaacttggttgataggtaaacacacacactgagatttcttataaaaaatcatctttatagaaaaaaaacaggagaaaaagatttctaaatggtaacaggactggttttcacaggagctgaattttctcacttctcctggaatctattccaaacaacaaaacaacaatacaacaaaatgaaaagaaacacccacaaattacattttcagcaaaaccagcagaaaatccacagactccaaagtcagagtcaggcagaaagccaaggagaaaagtcttaatactgtggtaggtaagtgggaggtatgaaggggttctagatatagcagaactcagaaatctctgttgaatatccactccccaaaagtaagggccttaatccaagaggaaagtgctgcagaaaagactgaaatttacgcagcaggtggagggtaaatggcaaatctcattagggccaggaaaattctaaaagtgttactgaaagtgacggcatcatttgtgttcccatgtgacaggcagcctgtgaagtgatccatgaagtaattgaggaagaacagaactaggtttggttctgagtcagatgatgtgtgactatatagatggatcatattatgaagaaacaattgtagcagcagcaaaggaagcctttgatgcttggaaaactactgcccatcattccctctacaggaacattcttttgatttcctaggaaaattcaactcattcaaataggagtaatatacaagtaatacacatacagatatgataagaaatatggcctatgacatgaatttacctatataacaaacctgcacaatatcctgaacctaaaataaaagtttaaaagtaaaaaaataaaagaaacatgaagaagaccagtcaggaatttcttgtaaataatgaaaactcaactgaaatatatgttgtcacaaaaaagattaaaagcataacccaacattgttattaattaaaccaataattaatgaagcagttatagctataaaagaagatcacaaagcagagttgtaagaactcagggaagaaatgagaagaaaacaggaggttactggtacactgctggaggatgtcaaatgggaactggcggaattgaaggaaaggaaggtaaaggaagggacataaaagataaaaagtgaaaatgcaagtaaattatacagaggcaaaaaagataaagaaggattagagagaaaaggacatgtatcgaatatggcaaaggagagccatcatatgcatagctgtgatctcagaagaagaaagccaaaacaatggaatagaataattactttaaaatataattcaataaaacttttctaaaataaaaaagccttaaatctacttatgaaaaagatatccattgtatcagtgcaaagtcgtctagaatgatcaacccaaagacacatcccagaaaaatttttgaaaagaatccttaaggcagtcaaggaaaaagataaaaatcagttaaggaagagaaaatgaagttgacatcagatttatccacagaaatatctaacctcagcaaagagtggagcaggatccataagataccaagttagaaggcaggagtcaaagattttctctctaataacgctccccttcagtatcaagactcaaggaaaaaggcagctttgagcctgccaggatttgggtaacactgtttcctcatgttttctaggggaagatcctaaaggaggtgctatagactaacatgaatcaacagagaaatgtcggcaaaagaacctgtggccagtgtttaaatgatccaacatgacaggaagttcctgttggctacatatatataccctttaagaatttttttctattcccaatttgttataataatttttttgttagatcattaatggctgttgaatatttggaaataccttttctgcatatattgagacaatcctatgtgctttttatcctttaatctttaagcactgagagttatgtgaatatcttttccaaagttaacctttctttttgttaataaataattgtcatctggccatgttattttacattatttttaattatttaattgtatttttaagtttattaagaatttttatgtcagattcatgaaagaaattgcatttaaatttttctttcttaaatggcccttgtctggtttaagtctatattaaatcctgaaactagttgggcatttattttttgttgttgttgttgttctaatttctagaagaatttttatacgacagggattacctcttcttgcaggttttataaaaattaatagggtctggtctttttctgagtaaattttaaactaaaattttaaattttaatatgtcagtttcttaagttgttatggatatattcaaggtttctgtttttactgagttttgaatgctttatttttccaggaaactgaacacttacattttcaaggtacaggttgagtattccttatctgaaatgcttggaaccagaaaggttttgaatttcagattttttcggattttagaacacggtcatgggccaaacgacattttggtcaataatgattggatgtaagacagtagccccataagattataataccatatttgtatcttttctatgtttaggcacacaaatacttatcattgtgttataattgcctacagtattcagcacagtaacaggcggtaagattctgtgatctaggagcaataggctatatcatagctgaggggtgtaggaggctctactatctaggatgtgtcagtaaactctatgatgttcacacaacaaccaagttaccttacagtgcgtttctctgaaggtattcccgtcattaagtgatgcctggttgtgtttccatcttactggttcagcaaccccaatccaaaaatctgaaattcaaaatgctccaatgagcatttcctttgagtgtcatgttggctctcaaaatgttttggattttggagcatttaggatttgagattttcaaattaggcacactcaacctgcactcgtatgaagtttgtttctgtttttgctcatatgatagatttaatatctactgcatatatatccacggcccttttttcatttctgttagtgtttatattgtgctttctttttttccctccttggtgactttactcagaggtttattaatattatcagtctttccaaagaacaacaacaacacaaacttgctaacagtgattatgtctgggggatttctattatcttctttatgttcttaggtattttacaaaatgtacccaataaatgcatattaagtttatgaacccctccccctaataacacctgtaacaaagtaatatgcttttaaataaaattttaaaatgtagactggataggagattcataactggttgaatgacttttcctaaatggtatctaaataatttcatgaaaaagaacaggacagtctctagcgagaagcagagtctttctttctagccctattctgaacttttaaaaattgccaacttcaacaatgagatattggatacaattatgagtattaaaatatcatacatacattggtgggggaaatatttaaaatattggatctcagatttagcattccccaattttgttattgttttgaaaacattctttttggtaattcaaatgacacttttagatgagcgatttagaaacaagttgttctttcctcaagattctactgccattttctggaaaattatagtaataaacgaataactgtaagatgactactaacgtaagtggagctccctagagttaggtagtgcacaagctgcacatcagtaaccagtggcccttgcctagaatacactcatatctatataataatatttaatacagatacatgtaattgtaatactctacattgtgttaaaccacctgagtgtgcagtacagtgtggggaaacctatcagtatgatttcgtgtgaaaaaatggtcctagaaattttacctgagtgtgaggcagcctgacatgattaccagacaagctggtactttgatagaagttcatggccaaagagttccactgaatgctgtgaagtctggacccaaatgaaataataatattcacgctatgacaccataagctaagagggatgcttttcttgggatgagatacaatttgtcagatgagatgctcaaagtcctgttcttaaagaattgctgaaggcaatattcacaatagcaaagtcatggaatcaacctaaatgcccatgaacgacagactggataaagaaaatgcagtacatatacaccacggaatactacgcagccataaaaaagaatgaacttatatcctttgcagcaacatggatggaactagaggccattattctaagtgaactaacacaggaacagaaagccaaatactgcatattctcacttaagccaaacattaagtacatatggacacaaacaagggaacaacagactctggggcctacttgagggtggagggagggaggaaggtgaagatcaaaaagctgcctatcgggtgttacgcttattacctgagtgacaaaataatctgtacaccaaatccccttggcaggcaatttgcctatgtaataaacctgcacatgtaccccttacctaaaataaaagtaaaaaaaaagctgaaggaattagttctatcgatggtggaaaaatgaagacttaagtggcaaataatggtttgcattaaacatttgaaggaatgccatgtggaggagtaattaggtatatttcctgttgttttacaatcaacaaaagggaggtagattttaaaaaattaattaattaattaatttatttattttgagacggagtctcactctgtcatccaggctggagtgtaatggcatggtctcggctcactgcaacctccacctccccggtacaagcaattctcccacctcagcctgccaagtagctgggactacagacgcgtgccaccacaccaggctaatttttgtatttttagtagagacggggttcactatgttggccaggctggtctggaactcctgacctcgtgatccgcctgcctcggcctctcaaagtgctgggattacaggcgtgagccaccacgcctggccaaaaaatttattcttattttatggctccaagacaaattcaaagagaagtggatttggattcacaatacagaagaatcgtctacaaagcatgtcaagaatggaaagtgccattggggtgggaatccaggccacttttctagagatcactggtaatatgtgcaaggagtcaatctatgtgtaatatttagtgttttgcatgactgttggcctggctcatctacttccaggaatttttcctgaataaacaactagatgattattgaagagtttgtaacagtaagggatttgaataggttactaagtaaatacaaagaaaagaaaaagaaatgtgaaagaaacattaacgagagcaaagagagctgggaaagagaatgaactcaacggaacagaaactacaattataagcactggggtaaaaaagagtgtgagacattattagaaaatggccagtcaaaataaggttgaatgcaagacactgaggcaatggcccaatttttttgttaattagatgagagaattgtgattgctaaaattaaacttagattgaggaactctggtgaagtgaggtcaacagaaatagctaataggtgggaaattaccttagtcacttgaaacagaagaaacctattactaatgggtattaaattatttataatataaagaaatacaggccagacgcggtggctcatgcctgtaatcccagcactttgggaggccgaagcgggcagatcacgaggtcaggagatcgagaccatcctggctaacacagtgaaaccccgtctctactaaaaatacaaaaaattagccgggtgtggtggcaggcagctgtagtcccagctactcgggaggctgaggcaggataatggcgtgaacctgggaggcagatcttgcagtgagccgagattccgccaccgcactccagcctgggcgacagagcaagactccgtccccctccaaaaaaaaaaagaaacacagctgattatttagtgtcatgctacatccatagaggacttcagtatatagtatgaagaaagtgcttgctctatgtattaaattatttataatataaagaaatacagctgattatttagtataatgctacatccatagaggacttcagtatgtagtatgaagaagatgcttgctctgtaagtgtgcactctaggctagatattgacccagacatttgtgatgtctccatctgaaaataacaaaaagagccgaaaacctctgtagattattatttaaaattagaatatttaaattattttaagatgctaagaattacttgcattactttcttcaaattgaaggatgtgcataatatttgggaattctaaccaggaaaagagttttagcctttcattgaaaatgacatttatggtattattcaaaatggtaaaaagctgtttaaaaattcaaatgacaatgaatagaaatagaaatgaatattctagccatggtgtatttacatactataataacaatacatattttcattaaatgatagagtattattgaaaataataaacatttatcaaaatgacacaaaatgatttttaccctaccagtttaaggaaactcttggcatgtgcagtagttacttcccaattgccaagttcacgatcaagctttccattccttgtctgactggaccactccttggtagttgactttgttaaactttccctgtttcttgaaatcctcttcgtctccctttactcccacacttttctggcctatttttatgacctttcttagtgcttttcctatgattcctgctgtgtagcccaggaagttggcttgtgatgtctcatcttctgactttacacatgccccagtgtgacctcattcactctcaaactcctctcagcctcctatgtgataactccccagtgcctttctccagttctgatgtcttccagaactgcacaatcataaatccagctgccttcattcctccctcttcctcatccaccccactcaattcttgaccaacttgatactctcaagatacagtagaaaggtgtgtttacttctctccatctttattgcttcaatcctattccaaacacaatcatttcttatctggtttactataataacttcccaaatagtatctgaataaatgaacatttgcctacgggatatcttcaactgaataggcttcaggcatataagattcagcaggccgagaacaaaaccaacttctccatctaaatgtattctttctcctacattaattatctcagttggaagtattgacaggcacccaatttttcaaactataaatttttcatcatttttacttttctctttccagacacctcagtagttcaatcactaagtccaggtgattctatacttaaaacatgttttttcctatttaaaaaactttaaccatcagttcccctctcctcccaggttggtgagagctctttgagggcaagagtcatgtcctttcaactttgtattcccagcctttaacagagcccttaatctgaaatatacttagtgctcacaagtgtctgaattaaaaattatatcatatacaacaaaagggaaacatatatatatatacgtgtatatatacatatatatacacgtatatatatatgcacacacacacacacacatatatatatataaaacacctgattgcaaatgtgcaagatgtatgcatttacatgtatagatactggaaggggatttcaaatgacatgaataattggtgttttactataaagttaagagactgataaaaatttcaaataagaagcagcaaatatgttactcataggcaaaggggaatctagatctaataaactaaaaaattgtctggcatgagattcttctgctctaaaaagcttactaaatgagctttcacatgataaacattagagggcataccatctcacaagaaaggaacactccttttagatgacactaagagttaacactttaaatgtaagaagaaaagtggtggatgaagctattgaatgcttatgtttcaagaagagtgaacaatagaactttcatgcttcagagctttttccatacatgaggttataagtatattttaagtgagatgttagagcaggtgacaatttttaacagggactaaaaaattaattgcaactcaaaaattaacaatatttaagagtgaatgactgtatactgcagagtatgtaagtaagtacaccatctacaagtgctctgatttcaaatagtgatttgaatggacatgctgcctaactattttagaagagtattcttttaaaataatctaaaaaacacagaaatggatggtattttcatttcatcaccatatacgtgaaatatccagggaccagtgcatatatacaatgatctcatttagctgataggcaatagatatataatttcacacatctttcacaccaagtttaaaaaaatggtattaagtttaagaaatagcttatgttttagatagtagattctgtagtaggcagattacggactccccaaagacgcccatgtcttaatccatggaacctgtgaatgttaccttatatagcagaagggacttcacagatgtgagtaatttactggtcttgagatggggagattgtcgtgcattatcaagtgggcccaatataatcacaaataagtagaaggaaagtcagagcgagagttgtggccacagacacagatcagggtgatgcaattgctggctttggagatgaaggaagaggccaggagtcaaggaatgtaggtggcttctagaagcttgaaaaggcaagaaaagggtgtcttctctagaaacctccagaaggaacatagccctactgatgttttgattgtagctcattgagacccattgtggacttgtaacctgcagaactgtacgataataaatttgcgttgtgggccaggcacggtggctcacgcctgtaatcccagcactttgggaggccgaggtgggcagatcatgaggtcaggagatcgagaccatcctggctaacatggtgaaacccgtctctactaaaaatgcaaaaaattagccaggcgtggtggtgggcatctgtagtcccagctactcgggaggctgaggcaggagaatggcgtgaacctgggaggtggagcttgcagtgagccgagattgcgccactgcactccagcctgggcgacagagcgagactctgtctcaaaaaataaataaataaataaatttgcattgtattaaggcactaaattgggggcattttgttattgcagccataggaagttaatacagatgctgaagggtttcatgtgctcaaaaccctgataagtgaaactgtaatctctaacagtaacttttgcaatgtctcttaaatctgctctcttgcttcagttcacactgctaacactgtgttttttcaggcataataataataggatttattgaggcatcatataatgtcccatttccaagcattggtctgcaccttccacatgtattaacacaattaattcttttgacaaccctgtatgataggtatttttattatctccacattacagaggaggagaccatggcagatagacatgaaatatctcactcaatgttgtataactgctaaaacacaggatttgaacacagctttctggtagcaaagctatatttactcttcccagaatgaacttcatggcccttgaactgcatggctgtcaatgaaggtgaacgcctcactaatttaccatctatgttgactgttgaattattgtggcagacagaattttggctcccatgatctccacctcctggtgtcatgcccttgaatttgtgacgtttcatggaaaaagggactttgcagatggaattaagtgattttcaggtacttgtcaggcatgggggatatagggctgaactattgagagattaacaaataatgagaaaatgctaagagaaatctctcccgttatactcccatagaaatactttcaaggcttcagagatatgatatttcaaatgaggaaacgtccttatcctccatccttccttacttacaatccaggtttaaattctttctgtaaacttccctattctttgttcagatacctttatgcttctccctttgcccatgtatttagttatttaatgttccactggactataaactttttcagagtaggaactgttttagaagtctttgaattcccatttcctatcaacttcgacgcttatatagagaagatcttcattgtttgttacttgaatcgattattcaggaaaaactcctttacaaaaaatcctatgacagggattacattgttataggagctccaaattccaatagaggatctgttcacttcagctaatattcatccacaataataattctttaaaaactttatattcctcaaattattctacaggctttcctaataaactgtcatcataaggaagaaggaaagccatcaattttatgcttttaaggaaaaagcatataattttttaaatgtcataatttaaacttgttagtgaccccttatttcttctgggcacatgataaaggctaagaacttttcttctaagcaagatgaacatctcacccactcccctgacttttatataatttcaggagtttgctgattgtgtagagtccaatcttgcacatcctacagggcacacagcctcagatagagaacacctgaattaggtggatgagatgccctgcccttctgcgcttgactttctgcccagtgcccccaccctgccctctaccccatccaaaggtctttttgagataggattatttcagaagtcagtcaaatgtgcaatctcagcagttctgcttctgtgctgccccagcctgactagtgacaaccctgctgatgttccaatcctaaacattatcttcctctgacagtccacattagggaatcctgcctcaataagcttttccaatgggcctgccaccaatggcattgttctgatttgttgggctgaagtgatctctctctttccaggcctcaaagatggcgaaagagtgcctggtttcagagagcaatacgaaaaatgcagctttggaagtctggtgagtaaacaaatgaagccagacgttgacacttgtacatcaatcatgttcatttttcaatgtgcattggaaaggtttgagactcacttgtctcagcaaacagggttcaattaaaccagtaccctggataggccataatggacactccaagggcctttctggaaagccctttccctttggccaaaggcataagcaatgtggggtagacaggagtcttttgggtaacacgtaaactgaacctgtcagaggatgaggggccctgtctgaacggcaccagccaagggactggctgtagcagatatgatgatgcattgccaactgccatatccatctgcacccagatattgctcctagaggtgtcaaaacattgtaatttacaagtaaatgtgaggagaagaaaagttttgcagacatgtttcttaaatgaggaagagaatcacagatgaggattactgtccaaaagagagcttcagcaactaccgcccaaaactcagcgtgagaatggagatatcacgtaaggtgctgcctacttggctgatggtgagggaggtacaaaacgcagaggagccgacaggcacgtggaggggacagcgccaggtgggtgggaagatccagggagataatgcacatgacgtgcccagcacaatggccagcaggtcatgagtgactaataaaaggtggctaagaatcccaccaaaaccccaggcccatgttagtcctcatgtttctaaggggaagtgagttgtacttattgaaagctaggtatgttacataattgactcctcaaaacaactctacgaggtaagtatttttgcaaatgaagaaaaagaagttttaatggtggaatgatttatttaatgccacactgtgagggcatggaggacaggcattcaagcagggcggccctcgccctcactgggcctccctgccccgctttgggcacacagaaaactaccaggcaatttggacacctctaatcactgggacatcaccacagggtattacctttttatggcaaagccccaatctactagaagtcaagagagtaaaaaacaattagagcaatgctgtccaatacaactttctgtgatgacggaaatgttgattgagggattaataaacaacaggaaacatggttactgaccactagaaacgtagctacggtgactgagaaactggatttttatttttttcaaactttaattcattgaaatttacagatccacatgtggctagtggctaccacgtgggacagcagagaactagactacctgatttaaaaggaaccctagggctcatttgccctcatttcaccaaatagggaaatgtcctttgctttatgcctcatgtgttcatccagtttctcatagcacatttttaataacaagaaactcttccttttacttgggatctgatgcctttgttagaaaaatcatcccaatctaatagctacatcctcaggtgttataatctggagataaagttaagttttggtaataaacccgttcattattccctggggttatctcctaactagctagctctgctcttctcacacctggaagcatttaggtctctgagggtggccccagaggcatctaaattctctgggtgcacagtgttgctactgctatccacagcgtccatgccattccatcttgctgactggtactgatgctgagtgcatggatgcgatgtgaatctgagggtattttcctcacaacagtgcagtgctgcttgctaggtttcttccccagggcccgctcagccccaccacctctgcagccagctgcctggtggctgggctcgggagcctgcaacctcccaggcccctctaggaagcagctccctgctcttttcctatcctcataccattggttcccctgagaaatgctgcccagaggttaaattcctttggcctggcctccaggctagaccatatcttccatctttgggcaacttgggtaccttagaaaataaaatcctgtattatcttgtcaactaggaataaattctgttctccacttgcttatttctaccagctgagtggtcagctacccatctggtcttttccctcctgcttttatctggccactgcccccagagttcagtctgggtcaaacaagtgctaaagaaatcttggttgaataaaagactcagggagaatgacagtattataaaatcatttaacagaatttttcattatatgcttgtggacagaaaatgtgaggggaatacatgttacaacaggtagaatcaagatgggttgaagcgaagaaatgcaacgcttagttctattcatctattcatctaataacaccttcaaaaacatacaagagatcaaattggcatggtttaattttagggaattatttcacttctcagttccttagaagtccctgttaagtgaataattaatatttcattcttatgcatggtgatatgttataaaacattgaaccaaaaggaagtggaggcttttaaacatgccatattaggactaacccttattttaaattaacttcatctgggcttaaacaaagaggggagagaattaagcaagagtttgctatagaacactgaactatctgcagtgtgatacatgtacatgaggaaatacccaaaaccagctaagaagaaggattatgaagactacattgactttgacttctaagttcatcactgagaatggcacctttattctgatagacttccgaagtcttactattctgcattgttgtctgttataaggatttaatataaactctactgatattctctaacagcaccgtttatgcactggatacctgcagccacctctaaggtggcacatgtaactgttccaccttggatagtatatgactcactaattcaattttactttgatgggtaattacgcaacattctaagggtagatctttagagaaacatatcttttccttcaaacctggactagtaatttaacaaatagtaaaatgggtaaatctcccaaacacttagttaacactctgggatatatgaggctcatgtaccaagcagaattctggttcacagtaggctgagagataaccatctggtctcccaaaaagtaaggacagacaaaatataaaatcacactgacttatctctgtaagtctggattttgggtttgggtttaatttaattgggtttgaagactcctagtttacttcctaatcatttcagaagcagacattccaaaattaaattaagcaaagaatattaaatgggcagacagtgcatatttgtccgtaagaaccttacagtgttattaacaatgttataactacaattaggctggcagtctcatggggtcagtagtattgtttcttgttgaaacagacaagcaaataaacacaaggagccttgagtaaaggttctttcataggttgagatatacatttccactgacatgaaataatgtcctattacaacctttttatatatctcactttgcaaatcaacctcatatattacttgttttcaaacatgactactttccaaactagatttagttttacacctaatcatagaagtagaacctgttttttaaaccataattattcatttttaattgttattaaaagaaattctcatttaaaaatccttcaagagaagaccaaaggaaatatttgcaaagcagaggcatcatgttatggtggaaagcaaacagattgtggaatcagacaggccagagtttaaatctcagttttgtcacttactaggagaataatcttgagcaaatttaataccctccttttcatataaaacaggggtcagaacggctaccccagaaacttccagaaataaagacaatgtaagaagaacaatgtatggtaaacacaagtccatagaaccttcttagtaagttaaagttcttcttactctccttcttgttccctttaccccatcttcatcttattcttagtcatggtcacataaaagtggatccagcatgggatggagatgaaaagatgttcagtatggtgctgtggaaagagcactagcctgggagtcaaggggcctgtgtgttcctaaaaaagtcaattcctctttttttgggtcacagctggagaaaaggtatgaaggtaacataagaatttgtctatcagagcttaaagcccaaaagtgattttgtagtctgagtcaatcaggaactcctggagtcccaggatcaattgctgtctttttaatgaagggcagggcaccagggctgcagtctggactgctgctgctgctgctaatacaacttaccacactggggacggataactttccaagctcagaatacagatcccaattttttggggggaacttatcagagttttccgattgatctcatttattaagagtgggcttattaagaacagatacagaagtttccctcctggatcattaaactctttcttagacagcttagattgattaatagggaaggaatgggcagtagttttcaaattatagacagcccaggtacagggtggggtggggtggcttggggagagaatttagatttgaaacctcctgttcttgcgtccatgtgagtagtgctgttttaaattgttttacatgttttgctttatttgaacacagactttggtggttaaaaagtacaaaatgcactgggctaagtgatactttgagttgttccagacacctgcttctattgatggtgtgtgttcttggaaaattaataaagaaaggcataatgagatgctctttctagaaactttagcaatagacagggcgtaggccacagcaaattagatccagccaccagagtggaaagggcaggggctgggactggaaggaaatgtcttgaatatccatcaagtgtggaattagtgttattttttattttatttatatatattttttgagacaaagtcttgctgtgtcacccaggatggagtgcagtggtgctaccttggatcactgtaacctctgcttcgcgggttcaagcaattctcctgcctcagcttcccaaggacctgggaactacaggcacatgccaccacacccggctaatttttttgtatctttagtagagacggggtttcactatgttggccatgctggtcttgaactcctgacctcgtgatccgcccgccttggcctcccaaagtgctgggattacaggtgtgaaccactgcgcccagccagaatcagtgttattaacactgtgagtcacagtgtgggtaacatcaagataacttgaaaataagaggagctcaggaagacttttgagtgccactgcttttccccgcctctctccacaactgagggccatggaaatgccacttagcctctccagatctcagttgtctcattgtaaactgacaatcttggactaggattcccttccaaattatgtaataaaatagctgcacaaaaggaaagggaaaagaagtgagagaagggagtactggggaggggaaagtattgctgagctcagctctcttgctaaagagggttcacggggtggggaaggaaggaggaggggatgaaattaaccactggtatgggtttctaaggcttgtgtcagtaagatcagtgaacgaagaaattaaggtcctgcctagcatgggcacagtgttccaggagtgtcatgccccactctgggggctctgtgatgtggaccatgggtggggcctcgtaggcaaaagagaagggctgttgggaggagaaatggggatggggaaaatcatttcaaatttcccatgatggaaaggctacaggaattggttatctagatttacaaatagaatctaataaataaaacttgtttttttttattttttgtttttatagcagtgtgaaagtcaaagtacatgtttttaaagaagcatgaaagttcagatgagacacacttgatggcttgttcagttcatgagatcttctggcatgaaataaaatgtttctttttccatgcagtgattgcgtaactcaaatatggcaaagctacctacacgataattttcggcctgtggatttgatttttcataagcctcaccacacacccctcacagaaagctcttgtttctagtggattcgtttcacctcctttgtgaaagccttagagagaaggcagtaagcagggaaaatcagctatttataggcgtttttgactaaaagtgtctgctcagcgtgccatggaatacttccaagaggtgggagaacaggaaacgatctaaaatcgactagaaggctggaggagtgttatgggggaatgattttgcaggggagtcattttcagaaagctcaggtttcatttgcaaacaaatgaactgacaccccttgagttacagataagcctttgaaacttttgctagttaaggagagaagacaaagacataaaatttctaaggattacaggtagggttcctttaaaggactttaaaaggaaaagtcctgtagaaaggcctctctccctacttatttactgcctaaggggatgctagccagatggacgtccacagaggagcttagactggcaggtggcattcagagtgtaaactgcaggtcctgggatggcctacagagtcttatagtgtccataggatgatctctatcatcactaatttccacttttataaccaaaaatggcaagcctatttggtcaagttttcataattaagagatataatttcattaaatgtattaaacccttcctgtgaattctgaatggttttgttttcattgttttgatgacattggagaagcaggcgaggtagaatttagactgcccaaagtcacagggctcacagaagaagtttgaacttccgatggttctgtggagaagaggtcatgagagagatctggcttcagtgtttacttgctcttttcaatttctacaacattagaagaatgatatacctggcttagcgactttgggcacgagcaaagaagagtgatggccaaggacatttggtcatcttctatcaatggtggaaaagcaccacggaggaaacactccacagagaacctggttctcctaagccaattaaagaggtgatgatggtggatagagttcccttgtagacacctcctatgactgttattactaattaagcttgtcctgttgacttaccagagctgtctggaataaggcagcaggagcttgacagacttaacgtatgaaaacaaaagcaagtgtgtattgcgttttttttttttttccctgtatgaatacactaaagcttgaagaagccagaattatattccatcagccaatatcaagccatgggaaaacctgatccactgaggctgagctatcaaaagattaatccaggctggtgcagtggctcacaactgtaatctcagcacttcgggaggccgaggtgggaagatcccttgaggccaaaagtttaacaccatcctaggcaacatagcgaaaccccgtctctacataaaaaattagtctggcacggtgacctgagtctgtagtcccagctacgctgaagggtgaggtgggagggtcgcttgagcccaggaggtcaaggctacagtaagccatgatcacaccactggactccagcctgggtgacaaagggaaacactgtctttcaaaaaagaaaagaaaaaaagattgactgtgatactctcgacttcagacgaaagctttctgcgtttagtcggcacacaagacagtgaaattttacacccacactgtgattaagacctactgtcatcccatattggaaagggcttttctttaccacagaatcagacatgctaatcccaatgccagcttaataaaaactagatgaagtgaaatacaaaggaaaaagtggtatggtacatgaaacatgggaaagagctaaagcttgttaatgtttgaggatctacaaacttggaatattttcacactgtatttttcatttatttctcaaatttgaagttaaatttgtttctaagacctgaagcaaacacagtcatatcatcatgcccattttacagatgtagaaatagaagtgctaagtagagcccaaagtcatgtagcaagccagcatcaataaagcttgcagtcagagcgcctgaatcccatattttcatctattaggctctactgcccccttcagtaaatacaatgagaaattaagccttacagttccctagaactgggttacttaaaatgcagttctgggattgatcactgtcagaatcatcccatatctatgaaatcggaatctcttgggtggatgccagagatcctcattttatagacactctcaaggtgattcttgtgcacataaaattaaggaagctttacctctaaatattcaatgatagagcaagtggccatacatatatatgattctctacaggcatacatgtgatattattgtgcccatatgtacccgtattgattccactttacaatatttcatgtagcatttccaattttagagataaatcctttccaatcacttacttttacatgtagggggcaataactaagagattagcttgtagcttttagcgtatgtatcctgcacactattcctctcagatttgctgcagttgctcccatttaatatatttggtcccatggtcccattgttccaatacgtaattcctacctgtcacaccatacatattttatacataaatacatctatctatctatctatctatctatctatctatctatctatctatcaaataaagtttggcctttgcaaatatggtaacagctatgttaatttttatcctggagaagtaagatgagggatgctgatttcaaaggagtggaagatgctggaaggatgcatgctgtcttcaaaatctaaccagggctctgagcaaattccctaaagatcacatatcctaatgtgttctgctctatgcatcctcctttgctacgtggtttaccatgatccagggaaaactcatccattaaaggaggaacacaccaatttcttttctttggaagttaaaataaataattgcaggcattatttagttaatctttgcctcttctgagactgttgagtcacaaacttgcttcaactctaactttcagataatgtcgcttctccctttgcttccctgtgccttggccccattgccttaaaaggatgttatgagaatggataatagaatatgtacaacataatgggaagagaacagcactggtagccaggcagtgagcctgcgagtgccaggttccactggcaagatgactgatttcatcgaggtatttccttaggatttttctcttttcaaaaaactaaattggactaaataatttcaaagccttcttttacaaggagattattagatgaaaaatagataggaagatacaatgtccgcattgcagggagattagtgtgaatgggaagctacaccagatgaccttctgatcaggaggttctactattctaaaattgtcattttaaggggaaaaaaacccaactctgcctggtcctttaattatgtatcttatgattttagagtctcggagaattaaatcagggaggagttagacaatcttgcaagcgtatattaaattgtggttaaaaaaattaaggagagcaaaagtcatttattttacaattgttggattctcccttattaaggggactaaaacctctttattcttacaccagagaagcaggacatccctaactagtctacacgaatggtccaaggtgaagttcaatataatcactggaaaagcacagtaatgaattttccaacgtctatgaaaaatctgtttctccacttcatagtcatacctcttccatggactttgtgaaatggcactcttaaaatggatctgagttcatgaatcagagatcaaaaacagcatgtgtataaatgcatattttagaagtattgttgcagggatacctatgcagatagaaggtgtatatataaacctgcacacatgcacctggcatgcagtaaccgcaggctcacataattctgcttcatagacagttctgtgatatcacaagcctgatttttgtgggaagtttcctaattctgtgaaacaattagtagaaactccagttgacagagaacagtgacctaatatacacaaaaggacccacatatccagaaaattcattgtataaatatatcttagaaatggaaaaaaagcaggcatattgctagactttagcaaatgaaacaaaaagtttttaatgagagtcctaaatattcctacatttaaaagatcagggaatcagaagaggtctttctttaatcacgtgagtgctctccaagacaaaaaaaaaaaaaaaaaaaaattaaaaacaagaatttggtcaaaagtaacagtaagagtaaatgttatgcctttctttacacaatattttctcctttatctctgtgtaacagtaattaattgattctttatatcattaccttttagtttataaacatagaggactgggttgaatataagtaaatcagtcactgaaaaaaaattaatgcaattacctattgtggttttaatttaagaatttggaaaaacacttaaatatgaatttaccaaaataatgtgaaaaaaaaattctccctgtgtgataacccactaagacagattgttgtctttgaacctaaacccaaagtggtggaaaacataatctaattacaaattaaagtcagcctggcaatactgcatatattttttagcagttcctaaaaaacctgacacaaaagagcaatgtgttctaccattcacaaatcactgtgtaaaattgtgtaatgccatgatctcatgtgggctagagactgtgggtgaatagttctcttaaagaatggtgaatgattaccttgatttactgtctttaatttgcaatcaagcaaactgtcttctgaggagaatggaaaaaggggaaacgaaatctactggccactgagagatccaaggctagtttttctctttcactctttgctaactaatgctatgcctttaattagtagattggaattctgtgagatcagaaagtgtgtgttacaggcagaaacctctgactgtggctaaccaagcactttggtgttgccgaaaatgtctttagaaaacagtgaaactgaaggccaagaataataaagtttctttaataacttccaagaaggctttcctatatatttttgatcttccctttactaccactgagtctttctggactgctgctttctcacaatgttttgtcaatttttttttccctttattaattggacctgacaatagtgagaataaaagagaatcagagagagagaattaacagaattctgctgctgatcactgattccacatccaaagttagcaccaggcaggagcaatctcatctttttatgaatgaagaggggcatctctaccaagatcagtgaaaaacagggagaagattgtgcaaacccaataggaaatccattcaggaaccttgacattcacttgctggattattagggcaatttaaattaaaaataaagaaaatcatcaatgaatgtggtggatgggatttcagaaaaaggcagcaaagaaacatcccagtagccaaagtcattagcagaactgttcagcactttcataaattgcatgtaaagtagttttaactgaattgggagacttaaaattgttctaacacaagagggaggaaaactcagccagggaaagaaaactcccactgggcaaagatggaaataatcttgaaccaattattgaaaaaaataattttacctgtatttaaaagatcctggattcatgcttatgaatgcttcctcagtgatcttgtgtggtaccttatttaagcagacccccacccccaaaaagagcaatcatcataaatgttaattttgcaaagcaacagtaactattcagaatcctggtcctggaaaacaaccgatcatatttcaatcaccagccatataatatcctctaagagcacctagcagatctaaggagatcatgtgtcaattaaagattttataaagcccttgtggagacacagatttgtagatatctgatgtctccatctgcttttttactatctgtgcacacattaatttgtcagctcttccagtctttctagccattatttagaggagaaataaaatcacaaatactaccccttcctttccctaccacaaaaaccatccaaatcaacaccacactattaccaaatacaaagtaataaaagagttatacccaaacctggtcagtccttccatttcttgaaacttgcacacaaactgaagaaacccactcagccttaaaaaggtcgatcattttgctttcctaaaatttcatctctgggagtgctttccttctcggtctgtcttgctctctctctcgctccctctgtctctctctctccacttctaccgcggagagagcgttttgtttcccttttcctgtttctacggctgaatgaatgcaaaatacactgtttgaagggatttttcttttaggttaacagttggaaatctaaaatcttgctcttctgaatggctttatatgtcagtcactcaacatacaacatttacataaagaggcataaacagaaccaagaattctgctttttaaaagcaaaaacaaaacaacaacaaaaaccaccttttattctatctctgaacctcttcctattttatttatttaactattaagcacttaccctgagatgtgccataaatgctttattccaaatgtataagagccaaccacatctcaactgagaattaaacagttttaatgtcttcaaatccatgttcctgctcccaaccctaatacagacagtcactggcagcggtacaatagttctaaacagcagacatctgattcttgacatttaaaaataacaatattggaaaaaaaaggagtccctttttttattaactgcagacagcttgtgagtgagcacttatcactcataatacaattgaccgtattaactgggacttgcaacgatttcaagctacagtatttgattcctaagtcaatgtcaggcagaggctaaatacttatagacttctcattttctatagaatcatggcaatggcctaaattaagcgaattctaagtgataattccgcaaagagagaagcagagctttgctagtatttagactttattattggtgattactaatttcatctttgttagtcttgaatcaaattagggacataatcagttgtttcattgttagtctaatttcatatccatgccctcttaacttctcacatgcatatgaggtcaaatgcacacatacatttaccacaaaataaatcaagtaataaaataaaaaatacgcactcatttccattactgaagcatattacggagttgggtagatttgggatcaagtgctagctcccccacttactgtttatgtgttcctgggcaaatgatttaagcatttgtgcctgttttgttgtctataaaactaaagtaaataatactctacaaagttgttttgagtacttaatgagacatacacagtttctggcacataatagatatttgatatacactgcttccttcctctgctttgtatttggaggaggtagagattgggcatagtaaatgaatacagactttgaaagcagacaaatcagttttgacccaacgtgttgccacatactagctgtgtgtccttgggcaggttacttaacctaatttacgaaatcttagcttcttcaactgtgaaatatctctagaattttaaagagcaaattagacaacatctgaaaaacatacagtaggcatctctgaaatgagagtcctgggacttccaattcttgaaaatagttctaattagtactctgacacatgtaatttacgagtttgaaaatgcatactgagatcatacatcttttggaccaagcgcctcattttctagcagaggaaggaggtccagagagctgaaagcatgtttccaggtcatgttactagttagcagcaaataaggactagaacgctccgggaactagaagaatagtgctttgcctactaagtctctaatattgaagttaaatccatttgtaaatccagcttcaatattagttggcaattaaggcaatagagctgaaaaaaaaaaaaaaagaactccaaagaaaccctctttccctctctgttttcccaaatttacttctaagaatgagcctatagatgaaattattcccttggagctagctggcacgggctaaccctatcttcctcagcagagcttgcacggggtggcagatcctcttttcatttcctagaagcaagaagggagccagaagcccagttctcaggaggtattttctattctcctctgaccccatatgaatatatggctctttcttccctttctttacagcatctcttcagcctcagcacaggggttgggaggtctacactgttttacatttaattctcttactaacatactacctcccaacattgaaatatagattttttcccctagtttgaaagtcttgcataaatagaagcttaatacattcaatatctattaataaggattaacttggagtttagtttaaaaggttgaactagcttggttaattatttcccaatgtaggacagaatatgttaaactgttttcaacctttcaataatttcagaattgaaaacaaaggtgctttggtgtcaaagacagatgagctattactctggggaagaagggaagtaaagggattaatatgagtgtgtctgtgatccattgtaatgaatgttttagttctgtatgacgggtgatgtatacatgggtgttttattttttttctttatacctttctgtaagcctcaaacgtttcattacaaaaatgacttaaagaaggcaaatagtttgaaaatagaatttccaaatctttatagtaggagatccaataatgctactactaaatcccatacttaagcctttaagatttcattctcattttactgaaaaactttaataataatatgcttattttaaagatttttattttcttcttgctcaccatttttgatgcccttgatttcaggtctgtgctagggcatattagaaagagcttggttttggcatcaaacatacttgagcctaaatctcagttgtacaacctccagattgtggggctttaaatgacttgatatttctaagtgtcagtttcttctcttataaaaatagaatattattacattcagtaatcttgggattatcacaaagattaaatgaaataagaaatgggaacacatttgctatagcatctggtatatagtagattttcaattaatatcactttccttatctttccacttttcaccactacctgagatcgcaactccaaaaaggtataaaaaagaaagaaaaatgaacctaaggaaggaagaatgtaggcatataggcagatataacgaaaacatttcattactaacaaaggcttatgctagatccatacacagcatcctttactctgatacttctcatctaatctcatcattacttacttaagtacaggtgtttttgtttttgtttttgtttcctttcagtttgttttgtttttgccactggtcatagaaccttcgcagacaaaatgtgtggtactctagggcttttatctctttactccttactttttgtaagacagatatccttatcgaaatactttactttcagtggtgggtgaagctttatgttcttaaagagtttctagagctttcggttgcaactttcattaatggccatttctctaagttaagagactgggttctagtcccacctctgccacatgctaacggtttaacccactaagtatttacctttctttgtgtctactttttcatatgctaagtggattaaatgattctttgagctctgaaattgttatagttcttgataacttattaacatgtagcaaccttacaggaaattaggcaacaccagcttcagtgggaagtactgaccacataattgtgtgtcgtgtatgaaaactgtccatgtgctggtggcttcttctgaactccaagaacaggctctggcactgcccttgtccagggattgccagcttggggtcttctcagggattgatggaggcattcccaagggagccagacttgtcaggaggagttcaaagggagcaaaaaagatgaactcctcaaaggaagaatttttctttgcatttcttcttaaggtgggagtgtaaaatgggagtgggtatgttatacttttatagctcagtaatttttttttttttttaagatgaggctaccaggagagaacagagaagaaaagacactctgaaaaaggaaaagatgagagttcttatggaaaaatgtgccttgggaaaaattacaatactacagcaaggaggtagggaagaaaaacatctctctcctatatttttatccaggtaacatctggtttcagtgaactggaggaaaacacaaggagacagtggcaggggaagagcagcctaccgtggctctgtaagtgtgtgggatttacatgctgacactaattgtattttacttctctaatccttcctccttttcctcctcctctctgttgtcctgggtgtctgcagctgtgcttgtcaggtccccaaactggctagctccccacctcctcagggcacagggcgtcttcctgatttgctgtgccctcgatgtggaagctcaggtcggggtgtagttactgatggttatgatgatgaccatcgcagtattctaacatagcttcaggcaggatttcacaatgaaaaccaccccacaaaaccctgaatagatctaatgaaactctttccaaaattcaaacgatcgtcacgtatttttgaattaaagaaaggtggacttcttttaaaattctctgtagacttccctttcctctctttcccatcctatgatccctcagacaaaagaggaagcccataataactggttgcctttccataggcgtgcttttcaaagcacttggatatctagtgtcttaagataacccggtgaggtcggtagcatttgtttcttttcattttccctacaggagcaattcggcacagagatgccgaataatttgcacaggttcctatcttaatagacaattcagagtagtgccaagactagaaccaggagaaatgcccacacaagcatgccaggtactacttctaagcctccatcattgacagaaatggtacctgcaggtactggcaggagcgttcttgctgacacgactcggacttcaccatggcctggtccatgttcaccgaggccttctggtaaacctcccgggcccggctcacggtgagcgtggaggaccaggcgctcttcttcagcagcggggtgtccaggctgaccggcaggttggcgcaggtggagcacttgacgtcgttgttgctccgggaggccttcaccgcctgctcgctgatggtgttgtaggcctccaggaagtactgtgaggccgagcggtcggggcacctgcccatggtcatcacgcccgagggggcgtggtagatgcacatgtcaccatccaggttgtcgtccgagctccaccagcccggggaggtgctgggccgggccttgggctccgcgcgccgctccttgctcttgctgcgtttgccatagcgcgccgcctgcgcctcgtcagggctggccttgcccccgttgacgctgcccttggacggcccctccagggagtgcgacttggtgaagagcttctggaccgagtgcaccaggtggcggatgcggccggggctgtcgctgcggtgctccacggccgtgcgcttgtactgcagggtgtgatagccatcgcggctgagtggcagctgccgctcgaactggtccagcaggttggcggggatgcggttcgccttggtggccagggtgcggggcaccagggcacactcgtccttcagctcttgctgcgaggtgtagtgcctgcgggggaaggtgctgctggccagcgggtcgctgaaggggcccacgcactcagcctggaaggagttccgctgggtgtagtatgggtggtctgcggggtggtgctccactgggctcagcaggtagggcttgcggtcggagtggtgcgacagcgagtcacaggccgagtcgcaggtgaccccgtggtgatggctgcggctgcctgatagccctttcatggcggaccggaagcagccgccagggtcatggacacccggaagtcaggctccagacccgtcttgggcagggatctgggggaatgaagaaaagggcaaagtcgttaacatttctcttggaaattaggtattgcactttacagggtcttgctctgttgcccaggctagagtgcacaggcgccatctctgcttcctgcagcctccacatcctgggctcaagccatccttccacaccagcctcccgagtagctaggactacaggcaggccccaccacgcttggctaattttttgtagagaggaggtctcactatattgcccaggcttggtctcgaactcctgggctcaagctgtcctcccactttggcctcccttaagtgctgggattacaggcgtgagcaaccctgcaggcctggtattgatctcttgagggtgccatctgcgaccgtgtttttttggcagaacttaatcagtgtcccctaaaacagcttgaacgcattattggaagagctctgtcacctctgtggggcaggaaagctgactccaaagcctgtagggagagaaggtggaggtaaagctagaaaactagaaaaaggaggccgggcgcggtggctcacgcctgtaatcccagcactttggggggccaaggagggcggatcacctgaggtcaggagtttgagaccagcctggccaacatggtgaaaccctgtctctactaaaaatacaaaaattagctgggcgtggtggtgggtgcctgtaatcccagctattcgggaggctgaggcaggagaattgcttgaacctgggaggcggagcttgcagtgagcagagatggcaccactgcactccagcctgggggacagagccagactccatctcagaaaaaaaaaaaaaaaaaaaaaaagaaaaagaaaactaggaaaagaaaactatatttaaaaaaaaaccaaattgtttttaaattatttgaaacaataactctccttccctctatgaccccaataactggatgtatcgttctcttgcttcttgggtcttattcttttttttctttttcttttctttttcttttttttgtgagatggagtttttgctctgttgcccaggctgcagtgcaatggcacgatctcggctcactgcaacctctctctcccgggttcaagtgattcccctgccccagccttcagagtagctgggattacaggtgcctgccaccatggctggctaatttttgtatttatgaggtttcaccatgttggtcaggctagtctctacatgttaattgttaaagatagaactggagaggggctcagttcctctaggaaacctctgctggctctcctagcagagagaattagttcctctcttgtgtttccaccacatctgaaactcactccccagaacctacagagttgcttgcttcaggatctctcttccggcttatgttccttgcctcccagtctattagtctcattatgtaccccgacctagtgtcgatccagccatgtaagcacacagtaatagcactccataagtgtgaatgaaaatgtgagttaaaaaacaagatgagccgggcgcggtggctcactcctgtaatcccagcactttgggaggccgaggcaggtggatcacgaggtcaggagatcgagaccatcctggctaacacggtgaaaccccgtctcttctaaaaatacaaaaaattagccaggcatggtggcaggcgcctgtagtcccagctactcgggaggctgaggcaggagaatggcataaacccgggaggcggagcttgcagtgagccgagatcgtgccactgcactccagcctgggcaacagagcaagactccgtctgtctcagaacaaacaaacaaacactaagatgaataatagaagccaatggcacctcgtatctttaggatatctctgtcttctgttgcatgttttcctttttgaattctgtaggaacaacttcaccacacaaacaatccccccaggttactcagagtgggaaaaagtaaagatatggcaaataaatcataaatgtagagaaaatctgcccaggtatttctgtcaattgagggtcaagagctttctctaaacaaacagagaacaagttaagcttgactaggctaatttgaggatcatatatctcttcttcctagtttaaggtttctggttgagtatttacgcacaagaccaggcgtggtggctgacgcctgtaatcccagcactttgggaggccaaggttggagaatcgcttgaacccaggagtttgagacaagctgggaaacatagtgggacccagtctttaaaaaaaaaaaaattagctgggagtggtggtgcatgcctgtagtcccagctactcaagtggggagaggattgcttgagcccaggaggttgaggttgcaatgagttgtgaatgcaccgctatacttcagcctgggtgacagaatgagaccctgtctcaaaaaaaaaaaaaaaaagttaatagccgatggcaaaatgaccaaaggatggcccttgaaaagttcttgaggacatgagtgaaggaccccagacctaatagctcagcctcagggaaaagtcactcattcatatcccatgtagggtatctcagtccatttccaagctcggatcttccggagttttagtaactaacagaggctgctattccatcagggcagagtattttctctggactccaaaacagtgttagagtcagtgcctgaccaagttccttctgacagcctgattttctttcaagacttcctacaatacaaaaattgccatataaagagtcatcttggaaagccaacatgactctctaaaatatcactaatgtcatttcagatattcctagagagatagatatgtggtttaattaagaaacaaaacatatagtgctgggtgcggtggctcacgcctgtaatcctagcactttggggggccgaggcaggcgaatcacctgaagtcaggagttcaagaccagtctagccaacatggtgaaacctcgtctctactaaaaatacaaaaattagctgggcatggtggcgggagcctgtaatatcagctacttgggaggctgaggcaggagaattgcttgaatccaggaggcggaggttgcggcaagccgagatcgtgccactgcactccaacctgggtgacagagcaagattccatctcaaaacaaacaaacaaacaaacaaaaacaaacaaacatataaaacacccacactggacctcatgaaaaaagatttttgagaggccaggtcttgtctattccatgagacatactgcatctgggagcgctcatgacaatgttggcaatctctatccatgctttgtgaagctcctttcttcctcctgtctcccagtttctggattgaccattcaggaataatgatgaaaggttttaatcagtacagtcactcaaaatttgttagtctactaaattgtgacgtccttaagggtagggactatgtttcacccacctagtatttggcaaagtgctatcctagtggatagtgggaattaagttagtagaatatttactcaattacttaatgcattaatgcaaaatttcccaaagtggttcatagtgtgattcaagtagcatctgtttaatgaaaacatgactgtgtggcaaaggccaggctgggcaaggccaaggaaagatgcccaatagttggggggaccattccatcagggtgaccattccaaagaccagtcttcagagcaaggcaggaagcagactggtgaacactccttctgacctatatacctttgacttctaactctgcaactcactgggcaatatcgtaccttctgccgttctacctgtctggaagtaaagtctggggagtttgcctaacctgctgactacaggatgcttagacagagggcaatccgcctggaagagagagagaaactgactcttgaagggacaaaaaaggaattcaggacttatgatacctgtggataaggaagaaccgataggtaaaaaacgtgtccactggtgacagactaatgaaacagaaaaccttgggattgctttgtatgaagttatggtcctaaaagtaggctgtggcaaggaagaatgtaagagggttaagtatgtgtttttagcaaaactgtggcacaaactaacttagatgcaaaaatccattgcataagaaagtctctctctacaaatcaggttccactgaggacatttttgcctttcaaatacagacttataaaaagcaaaaacaagattctattaggattatagacacatactaacttttatgatcacatatagtagaatctcaatatataaaatgatgtggaataatgtttcgaactttccttctcaagcagtttgaatcttgggtagatattttctgctaaataaaatgtgaaactggcaagagctgaaaacatgaattatacatgtttactccaaaatatacaagattattttaatcaggtattcagtatttaattatctttaatatgtgagcaacattccatgcaagatgacgttacctgaggacaagcagagcaaacgaagagctgtttaaggccactaatgatgatttaagttaaatgatgtaaccaatgataatttctgtaaattaatcatacacagtgtgttttttactaaaatttaactgggctattttcagcacaggacaagcacctctattttcttggagggtaacaaattgcatccagaataaataagctaacattcctccttccttacttgtatttgtaaaagagatattgagatcttgatcttttttctctatgatgtgggaaaagaaggtcataaaaaatggcaataaacatttctaaatgctaaatctatctttctggtcaaggccaaataaacaacttaataccatggccctttctgtaacaaatcttacactctcttctatcgtcttgtcattttaaaatgaaaataggtcaatttgtgattataaaagaaaacacattctgtgacttcttggtgagcaagggcaaatgatctaaaatcctaaggccattggcaatgggtagacaattgctggtggcacctactatggaggtcctgctcttccttctctcattcttcattttcctcttgccttactcttaaactccctttccagcacatttatctctgtcacttcttttttcccccctctcctaattaatgtttataagttgtatccatgggtaccacttgctgccacctgtggtgtgaccaagagcatcattagaaagcttccttgcctgctgctgcaaagacgaccaaatgcctacagtgaatccctagtggtcagagggcttatgatatattgtgagagccatgtcataagccttttggccactagggattcaatgtatgcacttcatgacctagccacaaaaaaacatgaaaagagataaataacaattctcattcttctatgcattcttgaaaaaagaggatgctagcctctcaattagattttaagtaatgataacaattgctggaaatagagagggaaattgcctttcaggccttgttctttgagcaaggatggggactgtggtcagcatgtcttcatgagggtttctgtgactaccagtgattagctctaatttcttcttgttcgctgtgacttcaacattctgttttattgtccttctaagttcaattttaccattgtaccatgtctcctgatttttttgcttggataatttgttgactctgtttgcagccatgagacaagctcagagtgtgagatgcacagtttttccagagttccaacacctggagcagaattatcactgtccagatgatgaccaaaacaagaataatccagcactgtaaaggaaattttcaaggtaggtaatttattagacccaaggaaaacacaaacacaccacatattagaagatgctgacaaaggggaaatagtcttgcaaagctggcaagtccttattccattttgatttttgtgcatgtctttatttagagctgcttttcttgatttttctttacatgcagaaataagagcatactgaaggccctcctctgtcttaccccatgaggatggacaggcaggcaattgcgacttactttagaaagaaagtggtggaccctgcccaggagaacaggggcactgtgttcttgtttgaggagacatcaggaagaggaaatctccatgaatcttttcagggtcaagctgtcctaaaaatttcttttttgaatttttgtgggtacctagtcatgtatatatttctggggtacatgagatattttgatacaggcatataatgtttaataatcacatcaaggtaaatggaatatccatcacgtcaaatatttatcctttttgttacaaacaatgcaattatactcttatagttatttttaaaagtgcgattagattattattgactatagtcaccctattgtgctatcaaatactagatcttatcattcattcggacttgcatctattttttttgtacccattaatcatcctcactctcccaccttagcaacacctctcaactacccttcccagcctctaaatgatcatccttctaactctctatctctcaagtcaactttttggcatccctccacctgccagaagcttgtccatgccaggttataacataccactaaagagaaagaaaagattttcttgttgaaaagtacaagcagccctgaacaatgactacattttccattctccctagatgtgcctgggtgactatgctggccaatggaacataacttgaaacggcatgtgtgatttctggaaaacatctctaaagtgaggggcatacgcttctttaccccttctctggctggaacgcagctgtgggggctgggtgaatagtgatctttcccatgaggtggaagttacagtttgaggattagagaaacaaaagataaaggttctgacctacagcggagtgccatatccgccctggatgtgcacctctgcattttgtttagtcgagagaaaaatagacctttatcttgtttccttatcttatcaagtaaaggaagggcctgcgctggccccataggaagccagagtcccttgctattgaaccacgtgacaactttagccaagggctctgcagagggagtctgtgtggagagaggagacaaaatagctcgcggttattttgctttctgtaattttgtgtactgaaccttgcacctgcacctgttcctaagtgagacaggtagtcagggcaaaatcatgagacccttggtgaagctatgtcaggatgcagcactgtatttgcaggtggtggtaatccattagaggaatttaaacaagacagtggcatggtcacacttgtgctaaagatttctctagctgtagttagagaatacatgtgggagtggggaggggcaaaaagatctcaaagaagcaatgatttcttgcaagagcagtttatgagagaagactggaagaaaagaaggagtataccaagagaggaggacaatgtcctggccagctacggcagtgtctcctgattcagacctccttgctcacacatgcatgctccaaccacagtctgaacacatacatgacatttttttttagacagaacaaaattaattttcccgtttacttataataaatcccaattctacagagattgagaatgatgaatgcccaacaggctgatgattttaaattattactttttaaaataagaaaatggttcttactactaaaaaatgaaaccatggcacttttgcgtaaaagtaaacagaaaacggccgggggcagtggctcatgcctgtgatcccagcactttgggaggccgaggtgggcggatcatgaggtcaggtgatcgagaccatcctggctaacatggtcaaaccccgtctctactaaaaatacaaaaaattagccaggcgtggtggcgggcgcctgtagtcccagctacttgggaggctgaggcaggagaatggcgtgaacccgggaggcggagcttgcagtgagccgagatcgcgccactgcactgcagcctggacaacagagtgagactccatctcaaaaaaaaaaaaaaaaaaaaaaaaaaagaagtaaacagaaaacttaacagaggtgagaatgtgagttaacattgtccaaatgcccactgtttggatattttctgaccttttgaaattgtacctgaagatgataactcaatgtcatgttctttcacttttccaggcttccttacttgaagattttcatgcgttgtgtgcttaaaattatacaagtactattagaacacctttgaataagcacattctgaaatataccaattatattactcaaagtacaatgctgagccattttatagatgcagaatgtattttggcttttcattaacattaattgctgtcctaatcatctgcagtttgatttcgtctgtgaatacctctgtcaatcagtctgctcctacaaataaatgccttcggaggcatttccttttcaaaagatatggtattgttaaaaaaaaaaaaaccaacgactcaactgaaatcttctccaatttggtcacagtaggcagcacaattacaatcacctgcatctccatacaaagcttttaaaaagtggtttcataacagtttttgagaataaaaaggtggaaggtagtgttctttgaaaaatgattaataggtcattattgatattggtggttgagcaaaatgtcataggatttaggagtgatttttatgtgaagataatccaggcagtaaacgataaaatctcctaatcttattttggactgacagagttcaaatatgcctgtgctgactctatgggacctcggagatatgcttcctatggaattgttcttatctggattttcaggagagggttggttatctcggctaaatggacagatgaattcccttgggagccagctaggagaatgtggttaccttaaccagccatggacagtgcccttcaggaggtgctgcagcagggggacagcctgtcttatgcgggtacaattgatgggggtagaatattcacagagaagagaaaaacccatcagcgtttactccaaaaaaagttgggaaaaacttgcaaactactgatgaatctaggagaaagaagaaatgatgacagaataaacctgtttaatggtacctaaagacagccgtgatggaagatggaaaaacacaaaaacaatgacaatcaaaacaatatgacaatacaacttgaaaaggagcagtggaaatagcctctgatgaaaccaagttatttttgtctagattgctcatgactagctgagtagtcttgtgaacatgttctggcatattctatacaacttgtttcacagccagattttatatatacatacatgcatatatatatatatatttacctgaatcaaattttctcttataaagtctctttctttaaaagctgttgctcttcttaccaagtttgctgtacaaatctactttccttagtgctgagaccccaaaagtgcagacattaagcccttttgtggtagctgttcagctgacacctgcttttgggaatttcttccctactcacagcatctcctggtgaccctgtggccaggactgttgaaggtgatcaccacattttctgagcttatggaagactggactcaggggcatccatgcagagccttcactgagctaatgagatgctcactttgggaaatctaggtggggatgttcctagaatcactggactctggtaagcttcaaggtcaagtaaaggaagggcccatgtcggccccactggaagccagagttgatgctattgaactgtggggcagcgttagccatgggccctacagagggagtgtgtgtggagggaagagaggagccagtccagagtccatggaaccccagcgaaagaaacagacagaagctgcctaatggccttgtaggtctagtcaggcctggctccctgcccagagggtgagactctgtggtcatctgcagcagaaccaaggcaggcccacaaaagcttactcatccaagtaaaggggaccctcctgcccagtgggtaactgcaagcatacagaacctccaccactgtggtctacatccaagtggggccaatgtgagtcagtctctgaagtggccccaacagaattggctaagttatcctcatacagctttatacccatttaagtatttattggcttggatacattatgcatgctaattcagattatacattcactttttgaaaactatcatcagtgcctgcatgagagaggggtggtcagataccatgtaagaagtgagaaggacaatctctgcaatcggctgtttttgaaaccttacagagtatttttccttcagtgagtttggcctgccctgacctctgcaatagttgctgttaatgggaattagatttgtaattcctcaaacactgccccttccttctgcttctgtcttcccatcatttttaaagtgccttattctgactcttcacacatctagcaatctgacccttttaacttttttcattttggaactggtttttattgtcttttagaattctacccccagtcttaaattttaaacaaacaaatccacatccagtcaactttctgaaatattttttgctgtgatagagaaggaagtatgatggcattcattgtttctggattaaagtatttttgtttgtattacattttatttttttagggacagggtcttgctgtatcacccaaggtggagtgcattggcataatcatggctcactgcagacttgaactcctgggcgcaagcaatcctctcatctcagcctcccaaagtgctggaattacagatgtgcaccactgcgccagcttatttctggattaagttttggcagataagagtgttggcctgtaagttatcagccaaatagtctttgactgtactgagcatgaagtcaaatcaaatcaatacatatgactttaattcaacaactatttattgaatagctattattacatgcagtgcactgggcactgtagcaagaattgaagattcttaacattacaccttcaacttcctgtctcataagttttcttgttctcttgctcccacttttcctgccctctgatggttctcatgacagtttattccatacactgtttcctcagctctgccctcttctcccattccatccatccctagtggtcttcacttcctcccttgccagcctaggagagacagcaggtcaaactttttttgttagccccctcaggtcccttgctctatgatccttctacctcactcactgtggacaatatacatcaaggactgatgctactgtccttctgtctttccacacagaggctgctgagtgtcgctggggatgggactggtgccatggcaaattcccggtgtccactcttggctctactcccaaagctgattaggaatagtatcatgggtctcctggttctgttccagctgccctaagccctcaagtctactccttatttctcatctagacttggttgggaaaacaaagtagtaaccaataaatatcaagtgaataaaaatggaatggtctctgcctctaggaatcataactatataccaggcacgtgttgtccactttaaatgcatgatctcattttaatctcaaacaacccaatatggtacggactagtctctggataagaaaacagacttttaaagaggaaataacttgtctgagataatatatttagtaatttttaaatttttttttagagagaagatctcactctgatgcccaggattatagctcactgtaacctggaactcgtgggcttaaggaatcctcctgcacagctaggactacaggaatgtgccaccatgcctggacaatttttttcatttttttgtagagatggggggtctcactatgctgcccaggctggtctcgagctcctggcctcaagcagttctcctatttcaacctcccaaggtgctgggatcacctgcatgagccaccgtatccagccattgttactaaattttgaacacagcatgttcttaatcactaggccataatgactgttcttatcacctctaaaacacacacacacacacacacacacacacacacacacacacacacacacacacagtctttcatactgctaagagtattatttgtaatatgatctttgttacctgattatgccattctttcactttaaattcttctcagaccctctacactttttcaatataatctaagcctttgaatgtgactcaaggtgggaggctccctgacccggcgtccatctgccagacagccctgtctccccaccccataccccacacagctcagctccagtgacactgggctccttgtattcttccccacatgccacattccccattgactctgtgtttcatgctctctaaaatactcacttccattctctatacaaattcttatcccttcttgaagagtaggtacaaatatagcctccttcttaaaatattccctgactaaaggaatcatggagatgataggcttcatctaatttacgatctagttgagaaaataaatcacataaacgtgaacaatcagcaaacaatacaagtcagaatctaatcaagtgctagattgtatggtacatgtcgcatatataatgcaccaagtgaaagcctttggaaaaaagaagtctggaagatgcaagagttaaggagtgtgaaaacatctcaatttaggaggtgtagctggctcagagcagcacattcttcaaagacaaggtttttaggacagtgtgcaattcctgttccatattttgttcaaatctaaccactttctcctctggctttttatatatataaagaattataaatatatataaatatatatatttatatatataattttttataggtttaggggatacaagtgcagttttgttacattgtgtagaagtaaaggctgggcttttagtgtagccatcccccaaaaagtgtacattgtacctattaagtaatttctcatccctcaccaccctcccatgcttctgagtctccaatgtctattattccattctttatgtccacgtgtacacattatttatctcctaagggagaacatgtggtatttaactttctttttctgagttatttcacttaagataatggcctccagatccatctatgttgctgcaaaagacatggcttcactcatttttatggctaagcagtatgccatggtgtatatataccacatttaaaaatgcaatcattggccgggtgtggtggctcatgcctgtaattccagcgctttgggaggctgaggcgggtggatcacctgaggtcaggagttcgagaccagcctggccaacatggtgaaatcccctttctactaaaaaaatacaaaaattagctgggcctggtgatgggtgcttgtaattccagctactcaggaggctgaggtaggagaatcgcttgaacctgggaggtggaggttgcagtgagccgagattgcaccactgcactccagcctgggcgacaagagcaaaactcaatctcaaaataataataataataataataataataataataataataagaacaattcaatcatctattggtgaacacaggttgactccatgactttgcaattctgaatagtgctgcaataaacatgagtgcaggtatctttttctttaggtagacacccagtagtgggattgctggatcaaatggtagttctacttttagtactttgagaactctccatatgtttttcatagaggttatactaatttacattcccaccaaaagtgtatagacattttctcatttctccatatccttgccaacgtctgttattttttgattttttaatgatagccattttgactggtgtaagatggtatctccttgtggttttaatttgcatttttctgatgattagtgatgttgagcattctttcatatgtttattggctacttatatgtcttcttttgaaaaatatctgttcatgtcctttgctcactctttaatggggttatttggtttctgaaattgttgagttgcttgagttccttgtatattctggttattagtcctttgtcagttgcataatttgcaaatatttcctcccattctgtaagtggtctgagtatttcttttgctgtacagaagctttttaatttaattgaaatcccatttgtttattttttgtttttgttgcatttatgtctttgaggtcttagtcatgaattctttgcctaggccaacatccagaagtttttcttagattttcttctagaatttttattctctcaggtctaacatgtaagcctttaagccatcttgagttaatttttgtatacagtgagaaataggggtctagttttcattctgcacatgactatccaattttcttagcaccatttatggaatagggtatcctttccccagtgtatgtttttgtttactttgtcaaagatcagttgtttctgggttttgttttttgttccattgatctatttttatgctagtatcttgctattttggttactatagccttgtagtataatttgaagtcgggtaatatgatgcctgtagctttgttctttttgcttagtattgctttggcagtttaggctcttttttgattctgtatgaattttcggattaaaaatatggaatgcttcatgaatttgcatgtcatccttgtgcaggggccatgctaatcttctctgtgtcattcccagtttagcatatgtgttgctgaagtgagtactcctcttactttttcaaggccttccatttctacctctgatatgatctttgatgatactattcagatgttggccagattgtctgagagctacagagttgacctccttgtttgtccctttcaactgctcttagatgttaagccactagcttatgtaagggaactatacgaaataggcatttatacttgctatggtttttactgtcgagatgttgcctgtctcagcaaagagtgcagtgccatgtggtaaattcctctcaggtgtcagtattaacaaaactgtgtgcttaacagctgcctttaatcgtgcaggtgctattactcttgtaagatgagtatgtttccacttcgagcagtgcgtgctccaccagcttgaataccaggaaggttatcaggaaaagctatggcaaaatcatgatggttttagtacttttccatttttatcctactatcattgtatttcccttggatgtttattacacacacacacacacacacacacacacacacacacacacatcatcatcatcatcatcatcatctcataaaccactttaatctctcgtggaaacaaattgtagtagaggtagcaaatctacatccagatacctctgtattatgtaaaatatgtcaatatgctttttccctcacttgatatcatccattgactgtgacaatggttctcaaactcgagtttgcatcagaatcagctggatgtcccaacgcatagatgcattcgataaatgttagccaaataaatacatgaatgggaattttcctgctcggtaaacaagatattttcatgggaaaagtgtgacaatttataagtaaaatgactatttttgtactgggaataacgcattgttggtgccagcaccgtacagagcagagccactgtgctgatggggaagtattggaccagcagttaatgaagactgctaaagcctgctttgctgtttcatccgcagcacacaggccgcatctgtcctggggctcatttgtccttcttcaacctcctccacagttagaggctcctgaactacaatggcaacgattgaagaaactgttgttgaaaagtccacgccaaattctcggtatgtcactgaagacaaggacattttgggtagaaccaggctgctaatccactcttgccaggagggaagattttttctctttctgtagtgagcaacaacgccactcggtaagctacagaattatctaactagtatttttgaatctagaaaaaatacaagctttgctttattaatgggcttattacatgtatgtgctgaaaacttgatatatgctccttctcatgcttgcaagtgtgacatggtttcttcccttttcacagatgaagaaactgaggttcatggaagttaaataacttgcccacagggcacaactagtaggcagctaagctaggacttcaactgaggtctgtaagacttaaagcacatgctattcctgctcctcaatagctttcctgctaagcaccaagagacgctaggctgccaggaacatcacagcagagaccaccgtcaatcaatgcatctccaccgtcttttagacattcttttgaagaaagatttagctgctaaaagaaaagatgaatatacaaaaaggataatactaccatatttcatcatattgtctcgttttaatacaagaagactcatccagcttaaacatttgatgtttaagaagctaaccagcaagctgccctctgggaatgcataccatcaggtatggatcagtggccctgagatcatgttcataactcagcagctttgtacaagctgtcaagactcagaacatggtaccccaaagtatggcaccttggtgtgctgagtactgtggactgaaggacatcggaaatgtctcagaagctatgtctctttgaccttctcccagcctcctgtctcctacctgtctttctcccttgaagtgagtcatggcaaccataattcctctttcccaaggtgtgtcacagaaactagaacccctctcctccaagggaagccgtgaaacctagaaaggtcactctctgccttcccccttctcccttgaagaccctcattccagaggggccctgccccatattcaggagggttacacaaagaggttaagaagaatttgaacattcaggccttgctgggttccctgctcagtctatcagcattagatcacaccctttagtccatcacatttctacaccgctgtccattcttcatcaaaccgaagaataaaaaaagttttccctgggtctttggatcttcatttctgaggagtcccatgttacataaaactttgattaccttcattatgcttttctcttgttaacctgtcttttgttataggagtgaccgttatgataggtgaggaaagatatcacacatttctgcccctacaaagccaaaaatgttggccgaggaatgctgctaagctcaaggccgtagctactcacaagcttttctctccactaccaagacctgtagatacaatgtgaataattttaaccttgatatagaagggagccaatgcagaaaataacttctcagttatccacaaaagctagtaaaagagctaacattcatgtattttttttcccaacaaatatttattcaacatctactaaatgacaggtacagttctaggaacaggggtccagtaatgaacacaattccaaaagtccatggcttcatgacaattatattcttgtgttgggagacagacaataaacaaatatattgtgtataaaatgttgatgatggtatcatgtcttaggtgatgacatattaactgccttctgtaagcaatcttttataaactctttgctgacttggaggcactgaaagttttacaaaaacattggcttatttatcaaagaggaagtatagtaaaatttgcactcattacaggttgagtaccccttatccaaaatgcctgggacccagaagtgtttcgaatttctgatttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccgcccgccttggcctcccaaagtgctgggattacaggcgtgagccactgcgcccggccgaatttctgatttttttcatgttttggaacatttgcaatttactttatttactggttgagcatcccaaatctgaaatgccaaaatccaaaatgctccaatgagaattttctttgagtttcatgttggtgctcaaaaagctttggattctacagcatttttgattttggatttttgtatttgagatgcttgaccagcaatatgttccagaaaatattagaaaaatggatatgtctctgtggtaaaccctgtcctaggcatcttatatgtattatcccacttaattatcacagcagccctatgaagcaggtactcttattatcttcatttcccagaggaggaaaatgaggtatgggaaagttaaataatttacttgtagttaatccaggaagtcagactccagagctcacagtttaggcaccactacactgtcaatgacaaatgttaccttttgtcactcaacacagtgatgggatgttaccaaggttgcagcatatggctgcataaattgcatacagcacagctggggatgggggtggcaagctgaccttgtgtggtgcagcaaatctgttgctttgctatcactgatgtgcagttaggcaatgtcctttaacttgaatataccttaacataagcataataagaagacaccagagaaaaatcacgctttccaacatgaactagaaataaagttattcatctattattattattattctccaataagacaataattgaaaccatggaagccatatatattccagagacatgtacataggctgactacatacatcatctacactttagataggccatttaaagtaaagtaaagtaaagtaaaggattctagcaatttggaggaaatgatgaacttctccatacaaaatgctcacacctctcagcttaacctgcagctttcaatttccgtatggccacttctcaccatctgcttatgttggcacagggtgggaggcaattcacttcattcagggaggcatcctacactacacttatgagcaaagacctgcaagtcaagtgaaagaaataaggagggggaaatgagcccacaatgaacacttcactgggtggcatcctatgggcagtctgcattgacaggtgtttgtctagcaacctccgcccatggcagcttttcctctgactgctgaaggggtttgcttcctttacccaaatctgtgtcaggaaaaaactccactgaagtatggttataagtttcatctcccagacaaataaacaagcagcctatattccagcagaccagatctgagtatgatcaactggcgctggcaagagtgcctgtggccagaatgagtggtacctgtgtaagtcagagaagtggctttgggcaacagcaagaatgttaaaaggatgttgcttgcaggaaaatcattaacttcatatttgaggaaaccttttggatgtttacttagggaatgagattcaaaattcgggctgctattgctttcttattctccttacactctgtatccaggtttggtccaatttcagaaaatgtccttcccattgctttgaatttctgtctagtttccttctaccatagcatctttaaccagaaggaagccatcttctcttactatcccactttccgccagtgtgagcttagaaatgtattgttctttttctccctctccctctgtttttctcctctggggaagcttggtaggaaaaatcagcgctataaattgcaagttttcctgctaagatccttggcgtatagctggctgctacttcacctttttaaaaacatgatcaacatcctgtgtcctgttagaattaggtaacttaaactttttatcaaggttgatttttgtttagaccctgggaatggctctgcatcatggcatatatgcaaaaacaaaaaacaaaaaacaaaaccaaaaacaaacaaacaaaaaatcctgaagaaataaattgtggagacaaatgtttataagtacaaatatgaactctgcaaaaaggattggaatccagtggcaggtagataagctgtaagactggacccataagtaatggaggactgtaccgaagaaatgtactctgtaccccaaagcttataaaataattgaacaggggatgtggaaagggaatctgatattggcaacacagcgtgtctctcctgtgagttactggaagtttgaggtaactgatgacaattctgtctgccctgataccgacattgttgtttctcatcagctccctcctcaggacccccaactatctctccactttccagcacagatgtctgtatttctgggcaccaggtcctttggaaataacactttagcaccttttaaacatttgcttcactactgagtagttatttgcacattattctgtcttccctcctaacgagaattctttaacagtcagacttgtttgctcagcaactaccccaatgccaggcacagagtgagcgctcagtaaaccctgaatgaataaaacaaaaggagtggaagaaagcctatcagcttgtgggctcatttttgtatctcataaataaatggatactccaagacttgtaaaagaggaacattatgcccttgggatgcaggaggaatcacacatgattgtgttagattagattgggttggttagaggaaaaaaagaatttggcctcagaaagctattttcttcaatgtgggagtttgatgtaacagaatcccgcctttggatattccttatttggtttcgggtactgataacaaaaaggacaaggagaaagatatttagaaatggtttaaaagatattctgtccaagccacctcgcctctcccatctccccctcgacctcgttattttccgtcctccaggatgatctttctaacttccaaatctgatcatgtcccttccctgcacaaaacggtctctattcccttcaaaatgacgactaggacccttgcgcagcttgacagcccctcgtgatcttgctgtgaacgccctccaccctcatccctactcccttctgctgctccctcaaacctgggctgcaaccaccaaacgacttgaagttttccttacccaccctggctccctgttctttacgactttgaggatggtgcttacgtcctccacttaagcaatgcccttccctgcctacacagctcctactcatccttcaaaatttaactgctcctctgcccaccatctctcattcacttttcacactgagctctgtccaaatctagtaaggctctgcaattgtctcctacactcatttccttccttctcatcctctcttctcccactgtggggtgaccacggttacccgtaaggacaatacactttctgctttacaccccgtccactgcttgtcaataacaagctttataatctcccaatactataaaagctgaaccacatgaaggaaccctggagctggttccctagggatgttggccaccatgctgctggctgtgagacatgtgattgctcacctatgtcagcacatagatatggtgagggagaaggatctgacacctgacccacagtcccctacatcctcatgggtggcaatattttaccacctacatggggtattttcactttactttaacatttctgcttagtctaagaaatctccccctccttaattgtgtttttcagaaaaccaaatgggttattacattagttctgagcaatgagagggaagcaatccatacatatggagtggcaattaaattaaaccctagaattaggatataattcccaagtgaaaatgagctgaaggagaagtctaataggaatgcctcaacctctcagttggccaacagacccctaaggtgtccgtggtactctgagatttttcttctcacactttgcaacattcatttgtgggcttgtctttccgctccaccaagctctcagagaataaagtgaagtgcatgtctgccttcccacttcccagcacagtagctgcctagagcacagaacctcaataccagcattgaatttcacagtgagaaagttatttccatttccattctcttttaatccttttagttcaggcagagcagaaaaaattgattgtgtattttgaacaccccttaacatttgtttttcctccctcttaagcaggcttcagtgggcacagtatctacctggaaatgagtaacttgctttgttttccttgttctttttttaaggttaattttatcccaaatggcaaggcaaatggaagtaatatcgagttgcttttaacaaatgtattcaaataaaactaagtctatttgtggaaaactattaagttaaaatacaacatcagtagaaatggacctggccaaaatcatgatgatgctatataaaggatgagtgtttagaaaacactggcatacagtaggtgctcaataaatgctcatttgatggataaatgaatctctcttccatcttctctcttctttcaatttctataagtttcacaatagatctggcttggcctcaaatttgtattactgtacttgtctcatattctgagctatagtactgtatctgctttctgctcggcccccaccgtgcattagcatgacctactcataaatgtgccatgtttcttttagtttagctttaaagactaaaactaaaagacattttagttttagtcagacattcaaagtcctccagaagctggctccaatctatctttccatgtgtatcagcccaagttctcatatataaactatgcatatatttgtgatttctagactggacactagggagagtcttcctggccttgagccttcctctcagtgggaagccctcagaatcctacagaccttttaagactcattcaaatcctgcctccatgaaaccttcgctgagagtgatcagctctcttaattccagctgagagtgatctgcctctcttctgagacccagaagcactttgcctgtgaggaaacattcaccatgtgtacactgtgtttaagatattcctttagcgccctgtactctcttttcaattgcacgctcttggaaggcaagaaccagttctcatacatctttctatctctaatcttgttactgactgaattaaataaatgaatggagatatttggggatgtactgagggaaggaaatatggaaaaatcaatgacctgcttacagatgctacctgagctgaagaaatgaacagcaaacccagtagaaagtgaagctcactgggaacatgaacgtggtaattgactcaattagatcacagaaacctacctccttttaataaaggatatgcaatcgtatttttaaaaatatttttcaaaaaccattatttgtaattaagtccaaatccctccattttagaagcaggaaaattgagataacattacaagcataatgtatggacacccatggatttacgtatgactagcacagtattcatgctgcaaatatgcatggggaaaatggtcctagggttcttttgcagcagatcttttaaacctcagatgaatcacactataaaattctcttaaccctagacacaaccacaaacaataagagccatatttacagcatgtatttcactccactgggtctaatatttgttggatgttttataggaagaatggagaaatctaagatgtctgtgagtttgttaggttgaccattcctttcagggggaagtgatagtaccatgaaaaacattttagaagatcctcctacaatagctgactctaacatttaatttgttgttttgtttcataccagatgcctcattggaaaaatagcaatattgaaatggcaaaggcagcaatgttagtaacattagtgtttctagaactattctgcaaaaaacaaagagacactatcctggggctgaatactggcctgagtgagtctcttttgcatgatctcctagagagatgggttactttcgtaaggaaacatcattaatcaagcctaaaactctgggcttaaggaaaaattttccttcctgaccctagtctagtgagaatttccttctgttccttttacaccatcaacagaattgagaagatgcactctcaggagcatttacattaagtggggataaatcccctaagtaaccaatggctgtgaatgatagcatgttagactgatctcctttttcaggagattacccagaacaagggccaaatagggcatgtagcactgctccacagcccaccaagggccaagcagtgcaagatcaggtctagacgagttttgatggctctgtggtcaatagtggcgatgtggtaggtggcactaaggaagtctgcaaacactatggcaatgctggcttggcttcagaatgacataaccctttagggaaatagaattttagaagttgggtttattcttatgggagtccttaagcctggggttaagccaagacaaaatgtaacccgtgggtttcacctagtcccgtcccagagcctaagtctatggagttgaactgtaacagcattgatcatcggcattcttggacttaccatttggtgggtttttagtgatgattaaagaatctattcaaaccaggagaaaatgctcctgatttcctatagtttaaccacttaatgaatcagtgtttgagggacacacagccctcataattaaagcaaggctgttaagattaaatattttatttttataaaggaatataattgatacaaatgttaattgataatgtttgaaaatgcttttcactccttaagaaaccttaagatcactccgtctttcaagacttactttggatcttgctcacttacatcttgtacataaaatataaaagtaataaaagcatgtaccccactcatttggcatagtagatacattttctggactactgaatatgcatggctttgtagggtttctaaatagaaaccttggccctattattcattattattattattattattttaatatctattccattttctctatctagttcttaccctgacattagaaaaataaaccaggatagttgaaatgtacctgaataggccgggcatggtggctcatgcctgtaatcccagcactttgggaggctgagttgggcggatcacgaggtcaggagattgagaccttcctggctaacacagtgaaaccccatctctactaaaaatacaaaaaattagcttggcatggtggcagatgcctgtagtcccagctactcgggaggctgaggcaggagaatggcgtgaacccgggagttggagcttgcagtgaaccgagatcacgccactgcactccagcctgggcaacagagtgagactccatctcaaaaaaaaaaaaaaaaaaaaaaaaaagaaaagaaatgtacctgaataaagggaagaaccaaaaaaagtataaagagaattgggaagtcacccttatcaataccatttccgtacaaaaatttgtttataattaccaacttgaggggtattcattacttggtaacaaggaaacatctaaagaaggctatggtaactctccctctttcttccttagttcaaggttttgccttttaaaagttattcccattgcccctctggaaatttcgaatcaattgtttgttaaaagttttaatgagacaatgcgataggccccagctaagcagtgaatttcgaactagaaaaggaccataaaaatagccatgtcagaagatccccaaagtgtgttatgtggatctctagtcctgagagatattctgtgagaagaggtttggcacaatgtgtttgggggaagctggttatcataatcctcacttagaggtacagcatgccttactctacaaaagggttcgaagttttgcaaagaaagcttttgaatggttttaccacagcattttgcaaaacagtctggtccttgaacccttttgaagagtacctctagccattgcttgaaatgactgctatgactgttctgcaaaacatacctgaggaattgcagaccaatcccaagtccctccttttatagattaggaaacggagtgtgattcactctcctttcacctaatccgtagtttactcccaagaatcttgggtaagtgtggataacaggcttttgaaattgatgtaaacttagtccatctttatagtagaaaagaactgaactacatctcggaagtttagctgatttatccaaggttactaattaaccagggtctagaaaccagaatgtcttcacttctgctttgtcctttgcccatcagaaaaatgctgttgtcatgctatgggaatgcttttcagaaattattatagcttgcattttgctttatcttatcttgagtctgttatttttttctctcagtatagttgaagtcctttcacaaaattccacctaatccactcaccagcttaagggacactctttattccccctgaaaacacagtcaggctgcctgaagtacaggaactctcacaccaataagctattctagagcttttctagacgtttcctcaaatctatttatgttagtgtaatttgaaattataattacgtaatttaaatgttacaaaaagtgctgaaatatgagtgcagaaaacaagagtcatttttctaaaaataaaatggtaagctgtgtaaaggttggatagacatgagctgttaaggttgctgccaaagtagctgtgggtgagaccaatgtaaataattggaaaaatggtgaaaatttagaaagattctggactcaaattactttgcatgtctacatttaaataaactgacattggaatttatagataacacaccatgagtgtggtttacgcaagaaagagaacttggaactccaatcaatagattcctttaaaaacgacaaccaccttgtttcttcaagaaaacattagcgaatgaatatacgtttgtattttaaaaaaacaacaataccgtaatagtaatacaaataaaatgcaattcagtatagcaacaatttatgttgtattaagtattaaaagtaatctagagatgatttaaagtatatgggaggatatgcatatgcaattatatgtaaatattataatactatacgattttatattggggacatgagcatccatggatgttagcgtcagtgggggcagggcgggggtcctgggaccaatacccccccaaatcgggtgactgcagtttacttcctgatacagtattaggaaaaccaaagcactacagtaatatattctactctatttgatctttcctagcctatatcctcttctgtttcacttaaaaatgctggccatgaacactaaattatttcttgaacctcagtttataaaacaacgtataaataatgactggtgctaccagaaggttcatatctcatcctaccaactcctagggtcaatacctggtgtggcaatagaaatacccagataaaatatgtaaggaaactatcccagatctcttgcctaaattccaagctggggaagacagcaagcctgtaatagaaacctccagtgtaggcttgattcaggctggagctgatgtggaggatgagtgacctcagagagcccctcacttcttggctagaggaggaaggaagaggtgaagattccccagcagttgtaaacatgcaggaagaggcatgtgggtgggcatggaggacacaggtacacccacttcaagatcaaaggctgtggaagagaccacaggtgtcatcaacagttgatcatatagaagactcgaaggccaggctacctctcagcaggtgccaacgaccaggagggatgagccacagatcagaggccagcgaggccaggctgtgaggacgtaacccattcaggatgctcagtgagcctcccagcaggatggaagaatattcagtttcatcaaatatttatctaaaagagacaggcttcatggcagcacaattctgagttctatgtgttgactgtaattggagccttaagagctaggtctaacttagttgtagaaaccaataaaaagttatgcccctgcacatataatctgtgactgtaaattttcaacctgctatacctgcactgaaaaaatttttggcataggaaagcaatgtgcagttcctgctgttatttttaacagtcattcagtgccaatgttctaggcattgtactgaacagagtaggacagaattccctgttcacttggctcatgggcaaaatgagaaaaacacaatatacaaagagacagtgtaatgggggagagggatatatgcatgattatgaatgtggcatatttaagaggtataaataatctcatgatatattacttagaggtagttgccatataggattaaaagtatgcactcatagtttaatagattaaatatctcaaaaatagtgcataactatagaattttgctcttaaatttggcgagctgtgattcaagatcctcatcagtactcttgaaaaattactgatttctggcccccattcctaaaagcctggggtttggcctggtcatttgtattttcagaatgttctcttgatgattctgatgtgcagttcaggttggtggccactgtcataggaggccatgtgtgtttttaatagatacactatttatgcttgcttataagtttatctgccactcttaagaagagtgaaataaaccatttaggctaactcacaaatatactttttctccataagaaaacatccttaaacatgataagattagcaggtaacatccaattttgcactgattataatacatttttagtaaactacgtgaaaagtaataaacctacaaaaatgtgtttgaagtatcatgccaggggtaacatgttcctaaaatctagactaataaatatgaagaggcaaaggcttgcatatttcagtctgtaaaatgcttacagcacagtaataggacccctcattcatcttcttctctactgttctggtcacaaggtatagtttgtgtttggaaaatcctagcctgggttgctgaaatcagtagaaacaaagcatactctataaaaatatggtggtgatatttagaatcacaagttagaaatgaacttttctctacattggaaaatctaaggaacagtgataattttataccaaaaattacctgagtgtttgttgccatgacagcctttagtgataggaggcaaaaggtggtaaaagtagtttctgtcctaaacagttgaaaccaattgctgaagatctttcctaagtgagactttctaccataggtaagaaagattgcttagggtcatggcctacaggtttttaagcacctaagttcccttattcaagactcaagatcccaaaaacaaagtggttaaagttaaggtttcagtctttgacaataaagttaacctgcacttttgtatcacattaatgccactggtcatattgtgaaccattaactgcaatttgtaagtctcaagctgtgttccaaaagggaccgactgtctagtactaacacccaagaacactggatactaatttgttgatattattgattagggttcttttcttgcttttgatttttttattaattagtgatgataattacttttatttcactgagatagtggttaaaataaaaactctttctctctttctctttctcttgattcttcaaataaatagtgcaacagtcaatagacggaaaattctttgaacagcagggatcatatacatgctctatttttggtgtctttccagtgtattgcacaccactggttggttgttgttgactgcccatcttaaaagacactttcaatgaacttcacctttctatttacctagaattctggaaaactccatattagattattacctacataattttctcttgcctagataatatgtttaagcaattttgagtttttgagaaaaaatacactccccacaacctatttttaagtcaatttaagttcaggaatcacacagaaaaaactgcagctttcttgatctagtgtcatttcttatgggttcaatgagaagttcctgagagtgtccttccgagaagcataggaacaggaagtcatcatttgccatttttttcatgattaaaaacttttacaagttaatagttggactacgaaaatgaatacctgctgtcggctatctagtatccctggctaatattaaggaataatgaaaatatcctctttccaatgagcatgtggattatcacattattattcaaatgctaaagagagtcacaaaagcagtgatttggagttttatcttactaaactgaggatagctgtctccctacatctccattttccaagtagtgagaaggtaatacatttgatggcaatttctgtattactactattatccactgcagaatgagaggaaattaagagagagaaatttgatgatttaagacaaagcatggagagtgatgtctggatttaaggaaacaaatgaacaagtagtctgagaccaaaattttcatccattaaagcctgctgcttcctataggccaaattcaaattcaatagccatttagctaggacaaaacagaaacatttgggtaggtgacctcaggtgaagtgaagtttttccatcttcttagtgaactccagaacaatgaaaactgaaaatggctgcttggcaaaagggcaaaattggcgattcggaatcattgccatctgctagtgcctgcctttgcggtgtccgggggaagttgattatggagctgtatttgtagcaagcttcaatggagtgactcacctcctttcttggacaaaaataaagggttgggaagggatacctcattttctaaatatataaaaatattgcagaaaattagaataggaatctttctgatgacatcaacagtgtctaaaaaaaatgagccaccaacagagaaggctgggtggaggtgggacaagatttctataaaacctgtaaggatcattgcttgctgggaattagaaggagtcatagttctaatcctggttttggcccacgaactgctggaggataagacatttaaacactctagagtttaatttctccagctgcgagttgagaaagccttagatgagtacaaacagagcaaattcctgttagaaagttttagatggtaaatgcctatcaggtaaacttgtgttctccctgaggacaaaagcgttgactgggcacctacttcgagccatgtttagggtgcagtttttgtgcagttctttaggatgaagtctggatcttatacatatttgattactttttgcacagtagttggcttatcaactgtaatcaataaaatttgttgaatgaattgattttgcataaattatctcaaatgaattaaataaaccctttttctgagggtaagggaagggaatagaggtattagtcatgcaaataaatcaagattggatctttatttaaagaaagtttcttcttttcccctcataattggaactttcattttatatgattatcaggagaaatgtattccctagactctgtcagtagatggattagaacatttggaataactaggaagttgtttgctcattttcaagttgttcagtgactagaatatatctcattgtggggtgtgtggtgacatggtatgctctagctaattgaatcacccagcaagggcattacataaattttcaatcctacagaaaagcaatccaagtcagttttctaatgagctgattgatggctcttttgtgaactatttagcaggaactgaaatgaacaagacttgattccttttactgaatcatagcacttctccttcctctcttattgcagctgggctgccaaagatgtgaattgatacatctacttagctgctataggctcagcatgtgccagaggttgaatatttacttaatgtcaaattagcatacagcagtgaaaagtcactcaatggcagttggttatcaaagtgggtccctgggcccacagcagcagcatcacttgggagcttgttagaatgcaaattctcagattcaagtcctgtcgaatcaaaaattgtgttttagtaagcgcttcaggctgatatgtgctgaagttttgaaactgctgatgtatggtatttaatgccccaagaaacaacaaaggatttattcttcttgactcatttatattttggaaataaagtttgttacatattaatctgttctttatggatatctaaactttaataaaccaaaataagatttcttgtgctcccaacaactctaatgctttacctcatatgttttgttgttttaggtgagacaatgtcaattcacatcaataactgttgtcagagcacctactgtgttaagttctgtgggggaaatgcaaatgaaggaaactcgctcttttcttttagggtctcacaatctagtcggggagactgacctaatatgaggcctagtgtgcgaggtttattctcccaggtactattacttattatgagcctattatgagatgggaactagtctaggcactggagatagctcagggaacaaaccaaatacaaagcccttccctcagggagcttacagtctagtggaagaaacagaaaataaacagaacgaacatgttagaagaataaacatatatttaaatatataaatacataaaataaatatctggcaggtcacaagtgctctggagaaatgccaaaccagggaggtgataggggcgtgcctctgatggaaacatatggaactgtgggaggctggtgtgtccacaagcgtcctgacttgctgaggcctcagctctgtggctgggtaggtgaatttgaccaagtcaaattttctttccatgtctttgtttccttggttctaaaagagtctgaggtggggctaatattgtgatttgaaaaagtcctttggtgactgtgtagggttgggtgtggtgggaagccaagctgggggaactctgtgtttcctgctccatccagaaccataagctatttatagatcagccctttggtgtaagtttttgtttgaaaaaatgttttccacagctgaagaaaaaaaataaaccactgaactagatgatctcaggtttgtaccagttgtggttctatagtctttacttcttccttaggattccttagtgggaagagatactttgttttttgttttgttttgtttttgagacagggtctcactctgttacccaggctggagtcaatgcagcctcgaccttctgggttctagtgatcctcctgcctcagcctcctgagtagctgggactgcaggtatgcaccatcacacctggctaatttttaaatttttttgttttgagggggtctcactttgttcaagtggtcttgaactcctgggatcaagcaatgctcccaccttggcctctaaaagtgttataggattacagacgtgaaccaccatgctcagccagaaagagatattctgaattatttgcaggaagctgttatggaactacaggtaaaatggtaaatatttctattaaacatagcctctgtttatcactctacatggaatataaaaaatttctgaattttccttaagaagcatatatttactttttctactttctatgctaatacaagatcagagagaacaattacttttctatggctggattgaaatatagattcttttggacttaaaatttcagaatagatcaaatctcagctgacggaagcaaaatatctgatagttttaggttctcattaatattgctccttaaaactaagtttcactctttagttatctttctatgtatgaatatactatggctgaaaatgatgtcttctccctaatctactacggcatgtcttgctagcttagaaacattgcatggatgttacaaggaacattacatgaaacattacaaggttgatatatatttttccaaacagaaaccaaaagaataatactgaactaaatgacaaatgggaaacctgttactaatttgaactggaaactgattacattttactttcacagctactcaccaatgctgccttaatgaaaagctcttccaattgtcactatggctttctttttccccaccataggtaattttattttattttatttatgggtggggggaatatttaatatctattctcttagcaaatttcaagtacagtggagcataggttaactatagtcatcatgctgtacagtaggttgcagaacttatttatcctgtctaactgaaactttgtatactttctgaactccccatccttccctttcccccaggctctggtaattaccattttactctctgcttctacgagctccagtcttttggagtccacatctaagtgaggtcgtgcagtatttgcctttctgtgctgggctttctttattagcataatgttttccagatgcatccatgttgttgcaagtgccaggatttctttctttttaagactgaatagtgttcaatttttaatacataaaccacattttctttatccattcattgttgatggacacttagattgattccatcttgtgaataaccctgcagtgaacacggggtgcagctctcccttcaactactgatttcatttcctttgaatatatatcttggaagttggatatatcctttggaagttggattactggattcgatggtagttttgtttttaattttttgaggaactcctatatgattttccatagcagctgtactattttatgttcccaccaatagtgtacaagggttcccttttctctacacccttgccagtatttgctatctttcattcttttgataatagccatgttattattattttttgagacagggtctctgtcacccaggctggagtgcaatggtgcagttttggctcacagcaacctccacctcctggactcaagcgatcctcctgccttccaaggagctggaactacaggtgcatgccatgacacctggctaatttttgtgtttttgtagagacagggtttcgccatgttgcccaggctggttttgggcccctgggctcaagccatctgcctgtctcagcctcctaaactgctgggattataaacatgagccaccacattcagctgttaatagccattgtaacaggtgtgaggtggtatctcattgtggttttagtttgcatttccctgatgactagtgatgttgatcattttttatatgcctgtttgccatttgtatgtcttcttttgaggcatgtctattcaggtcctttgcccatttttaaactgggtgatttgtttccttgctctggaaactatggcttcttttaataagaattttactagttttatcataagctgagtttaataagctcagctgtgacaattatgtataaaaataagagaatgccaaaagcacactagctgagctttagtcaaagtccctgtgaagtgaacctcatgcagacttaaaatagtgggtgacttggtaaagtggcagttcactgcagtgcagctcatggaaggaggggcccagttatgacttagcaaggtaattgaggagattaaaaaggaacaaagatggaagctgctaattgcaacttaaaaagggcatttagaacctaattccaaacataagatatgattgatctgttcctgggaattcttttgtgcacttggagggttttaagatcaattaaatctttgcatcttaaaaataatgatcacaaggaagaagaaaagttaaaacaaggaaaacagcatactggcatagaacaagctatttctgaaatatcagttacatttggatgcaaaatttcaagttttcctttttgggagaatgtcatctctctgaaaacttattttgaaaccttatttattttttttttcttttcctgtagtcttcctctgtggtcatctgaagacatcttactgcttttaggaaagaatagtaagtcctgacaagtcttagaccttagatagatggtagttctatttttaattttttgtggaatttctataaagtaaaagtcaatgaaaacagagaaaattccctactctactatagcaagatgcccatcagcagaaaaggacagtgtagaagcagattgacactgaattatggtcacccttgctcaagtaaacaaattaatatccccaaggacatccataaggcttccctctcaacatctgagggctggatttgctctctgctgtccaccacagactatattcaactgctggaaccttgtctggtgctgaatagcccaaggacagggacgctgcttcagagacacccacggtcacagttgcaccagccaaatctgtttttgtgcccgtgtcttctcggagaacagagcagcatatggacggcttgggctccctgccatctgtcaagagtgggcaggacagcacgtgcaatcccaatctgcaccaatgcttggtagataacactttccacagggaaaggtctgctggcctcagataagaacagctttcaaatggggactatgaaaaactgtacaacagtcacaactcggttccactcctctcagatctacctaaagctctcatagtcataacctatatgactttgagggaagaaaatcctgacccattgctcagttggtatggagcttgaacattcactcacatgctataatatcatgatcatcagtatcattataaacaacagcatttactgaactgctaccctggaactcttccctttagcttctaagaacatgcacaatgtaatatcttcaccaatgagacacagacctcagagtctgtgcttgcaaccattaggcttcaccgcctcctacctaatctaggagctgatgtttgtagaagggtgtggggaatgagctgatcgttgtagcagggatgtgcatggaggagagggtggaaagggtaggaagaaacagcatagagaatgcatcaggatgttccatgttgcacatacactatacagacagttcctgatttatgatggtttggtgtaggatttttttgactttacgatggtgcaaaagcaatacacatttaataaaaactgtaccttgagtacccatacaattattctgtttttcacttttggtacaatactcagcagattacatgagctagtcagcacttcattacaaaataggctttgtgttagatcattttgctcagctgtgggctaatgtaaatggtctgagcacatttaagtaggttaggtgaaggctaagctacggtgtttggtaagttagctgtactaaatgcatttttgaattaatgatattttcaatttacaataggtttattgggaaataaacccgtcataagttgagaagcatctttactaaatttcccagaaagcaaatgcggtgtttgttatagaaggcagggatttgcattaggggctgaggaccctgcagacggcagtcagcagcattccagctctcgcacccatgggttacaaagggaaagcactggacgtgagtctaagagtgatggctaaagtccaaggaggccaatatccatttctcagtcagtttgttgttacctatgtgttctcatttctggaggagtcagctacaatattactgtatatgttatataatatttgacatcattttatagagtaatgatctacactagaatttataaatgtgagggtttgtgaagtcactaggcatgtactgagtaaacaccaaagagctgctctattcaaccatcatttgctatcaagtaaatttcagtataagtaagagaagactggctctgacaattgtgaggcatacgttggatgattttttaatgcagcattatagatatgtaaggctatgtagtaaatactctgctagagcgataatgatcattttaaatttgcttatattgtgaaaattgtgtatatgggagagtcagtacctaggggaaaaggaaaaatttcagaaaaaaaactaaaataagcacgtttttctttatatattgtggatatgaaagggtagtggtggtggtgaagactgtagaaaggagataaagaaaaggaaaccaggttcaaggagccgctgtaccccactccttggctctccctccttcataatcatcagcagttgtactaaaaagaaaggaatcagttttacaagtttccttaaatctgacaatgaactagaggatcttatatagaaggaagtgctaggataacattctgaagaatcaagattgcttgcatatttgcatttctttggttcttgcaatcatctctctattcaagctgagctgtgaaatacaccatacctgttattactgggctagtggaccaaatatgctttgctgttgttattccaatatcgtgtctgttgctatgaaaatgaagccatccagactaagatttcaagtacgtaaactgaacacggtagaagccagcacacagaataattctaattttgaatgagtatatgccaaataagtcatttaacctttgagtctcagtttcttctgtgaaataaaaatactgtgctagacgttttccaggctgtttttaacatataaaagttaggtgagaagagatagaaaccaacaaacaatgaaccaaacacagacatcaaagggggaaaaaaatgccattcagggaagtgaatcacagaactttggattcaggaactagaggtccctggaaaagccattaaatatgtttctggagattttccccctaagttttctctgaaagaatggtttctacctgtgttatgggttgttccagggactggcattctgagcaaagactacccttcctggggatcgtgggcaggaagagaaagtggaaggagggcaaccaagaagttgaatgtgacgatagaccatagatcttagtgatgaggtcttgaactagggtggctggaggcagagactggaaagaagggggcagatggaagaaatattgtgaagctgaagttggaagaaagacaaagctcatgaaagatgttgcaagcactagagatgcgtagcttaggaacctgtacacagggcagcctaccagcacggatctacacaggcttctcaagagatacacacagtctatcggaaaagtgacagaaaaaagaatttggatgctttgtgacatgcacagtccaatgagaattttgtcaaaataacattaataccatgtcaagaagacgcctggatataggtaagttgatcaacaagaaagattggtcaaatggctttgacctttttctggcgcttagtttcataggcattttgggtaattttaatctcctttgtaggcacttgagaaacacttgaaattcacacacttcgaatccttacctttgtttgaaggtacctatgggcaaatttgtaacccttagcaggcaagggaacttgataccatctactgacatttcaaaattttcaagtgcaagggtagcagtcctttagttcactaaaaatgcagaatgcatcacaaacaaagcgtatagattcctggtgagtttaactgggagataaaactgaaagttaggttgaggctagtgaatgactttacattttggatttattggattggtaagagggagctacggatgatttttgcccaaggaggtcccagagccatagtactactttaacaagctaatatggcagtggtggaaaaatccagtggtcaaggtagaattcttgagtcatgctataaacaggaactgcctgaaatgtgctaggtattaaggtgataagttgtaatagctacaagtgattgcatgttatcacaagccaggcactgtgctaagtaaagtgcttcatctatgttatttcacttaatcttgatagcagttctacaatattatcactagcattttatgaaaaagtaaatggaagctcagtaaatgtggtccaaggccacacagcagctagtaagtgacaaagccatggctgaacttcaaatctgtgctctcagcctgtaagctaagaaagggacaaagataagaaagagtgaacacatagcactgtgaaacagaggcgcagttagatacaactgcctgggagactacagtcatctcccagatggattttctgcaggatgttatagacctgagaaatgaaatcttcctttccacatcaaacaccttgaatgtaaaaaagcattttaaaaattcactgggcccggacacagtggctcatgcctgtaatcctagcactttgggaggccgaggcgggcagatcacttgaggtcaggagttcgagaccagcctggccaacacggtgaaaccccgtctctactaaaaatacaaaaattagccaggcgtggtggtgcatgcctgtagtcctagctactcaggaggctgaggcacgagaatcgcttgaacctgggaagcagaggttgcagtgagccgggggttgcagagattgcggcactatacttctgccttcagcgactgagggagactctgtccaaaaaaaaaaaaaaaaaaaaagcactgggtattttcctgatctgttttcgtgatgtgttatataccaggttaccattagacttactaaaattatagtggagcatcttcaggtttcctacctcccctctgctgccaccgggcatgttcagtttatgccccactttttttccagagtatattcagtacgtctatcttcacatttctcaccccttaatttttccccaatagctaggaggtaaatatgtttgcattgcatctcattgcattgcattgccttgcacttggcgttcagttagggcgaaactctctctctcccactccgctccacccaaggatacacttcaaggtacccaggaagcaatgtctactaatgtaaaaggtcttgttgacctgacagcgatcaatacgcacatcttatttccagaaagaattacttcttgttaattgcttcccattttcaatagtttcactaaacattgagagctaaagtctgattcatgttaggaattttatgagtttttatgtttctctggcaaaactgaaatgttcaatgctggtaactgctagaaaggattattaggtaacttttgccttttcaacaacagctctcgccatcaaaaatccaacttgtatgtttataaaactgcagttctgctacatttataatcacaacatggccaaagggattatttatttttccaacatagtaatgtaacttggaatgattctatagctcaatagaagtagacagcatgagcctgggaagcattcttttataaatcacaaatgcaaggaaagaaaattaaaccaggaactctaacctgggtttttgttctagcttggtcattttctacctgggcaatcttgggcaaggcgattcaatattctgaaccccattttctgcaattataaaatgagaagacaactttaaagtcctgtaagagtttatttatttgagaaaaaaaataaatgggtatgtgtgcaaagttgtttcccagagcatgatggtaaaatcaccaccagagaaacttaaatagtgcctgcagtatctacactagttagaaagcatggtgtggtggaaagaacatggaatgtagactcagaagacaggtttgaagtctggctctatccaattctatatataagaactagagaatgtattaactggatgagtttctagtaaaaaaaataaaaaatgcaggaggttaaatggagaccatagctagacaatcaaaagatatttgtcaaagcacattgcaaactggaaagtcatgtgtaaatgtcagaataaattagataaactcaggtaagccatttttagggtcagaagagaacataagcacagaagcacatgttgtaaggatttaaataggtcatagagccaactatttcctcatctagtttctgagctctgctatggaggtaagcaagctcagtatcaaaacagttaatttgcaacaagtaattggaattaactgtgctaatatcagctttaaacttgatgaacgtcaggtggctgtgagacccagcaggagacgaccagcacacagttagatatgaggttctggagttcaggaagagtgctctattgagagatctagatttggaaaattatagcatgagagcaggacagttgccgcctcagacctgaggggatgccaacatttaaagcaagaggcagaagggctcctgcaggagacagggaattgggaaggcagcaggttaaaatgaggcaagtggtcatcagtagcaaatgccacaaataggaaatgtgagatcaagaccaaaaaagaacatttaatttgacaattgggagattgctgagttcctttatctgagcagttttgctgcagttaagggtccaaaaaagcttcgttttagttaaataaataataaattaaaagaaaataagtgaggaaaaacaggtttgacaattatttttaggatcttgacaatgaatgaaaaggagaggtgcccggcattaagccaggcactagggatatgaagtctttacccctggagaagaattcctcagtaatagcattgtcatttgtgcgtgtttaagatgaaatgctcatgtattactctctagggataaaggaaaaataaagctacaatctttggattccattccccattgttaacggtttttcttttgtgtcatgcacaaaataatctacaacttgttttcttcacttaatactacatgatcttggacatattgcaaatcatcaaaaagaggttcaaaataattccttttaatagctgcatattattttaccttctggcttgatcaggatttatttaactggccctttatggaggaatgttttttgtttctagctttgtgctatttgaagtcatctctcagttattttcatatatatccatttccatgaagtaaattactacaaatggagttacttctgggtaaaaggatttaggtagcttcagatttaataaatactgtcaaatttattttcaaaaagcatgcactaggccgagtgtcgtggttcgttcctgtgatcccagcactttgggaggctgagcggggaggatctcttgaggtcaggagtctgagaccagcccagccaacatggtaaaaacctcatctctaccaaaaatataaaaattagctgggcgtggtggcgcacgcctgtggtcccagctactcgggaggctgaagtgagaggatcacttgaacccaggaggcggaggttgcagtgagccaagactgtaccactgcattccagcctgggcgacagagagagaacctgtctcaaaaaaaaaaaaaaaaaaaaaagcactaattttgctcccactaacagtgttcatactgttcattgaatagtgttcattggagaagaacagggtcttctccagtcttaccagtcctgggtataataaactcttaaatatcttttggatgaaatcagtatcttatttgatttttaaaaaatgatgtcttgttttaattttcacattattataaataagactgaacaacttttcacatgtttatttgccgtttttgtatttcttctgtaaactttttgtttataacttctgctctttttcattaaattaaaatttttatttgtaaaaattcattggctttatgggaaattattgctttgtcagtcaagttttacagatatttttccagtttaatgtcttttttaacttgtttgttgtttttatgtagccaaatttataaatattttacttcaaaatctggtttacatcgtgtttataaaagttttcccaactttgagtttaaaaaaacatcactttagtttccattttttaaattccaaagatgattccttaatctttggtgataccaatttctatcgtgtgtcactcttgctatctggaagtataaccaaagtcccttacattcctctgtactaaaacagtaatcctgttgttttggtattaacacatttttgaataaatttttatcatattgctgattcacttttagaaaggagaatcataaaattacatcaaagtcgtggcatctaagttagagacaaaaccagtatcttaaaggagatggtgctggtgttgagtcactatctaatgacgactcaccaagcaatcctgcttactgttcagctcaaatgcactggagaaaacatgattctctaaccacatttgagagttcagccacatgtagagacatggaaccttcacatctttcctctatctgttgtttaaaagtgtcagtgatgtcacagaaataactatttcatggagtgtcactattacagaaatagtgagcctggcagaggctagaaagcaaccgactctctcacgtcatattagctacatcgccatagaatcactgctgccccagtggaaagaagtgaaaagcccatttatcatcttgcatataccctcctcaatcagttgcctggaaaaccatggggaaatataaaaagcttttggttgaacagttcagaaaacaaaaccagttccactacactctcccaggtgtggtgccctaggtccacaccctccacttcctcccccactgccaccctattctctcatgaagctccctagattttctgtttatgttttccttctctttcaagatgccaacattttctccacaaagcagtttactaagtcaatgccattagcatacacaaatctcaagttttgggggaaaaagaaaccctacaaaaaacccttggaggtgaacttgttcatttcctcccctgaaagtgtgaattttttcagccgtatccccataaggtgctacccagcccttttccccacattgatggtgatgacacatacttgaccttctgatgcagccaaatctgtttccaggcagtactaattataatatagttactttttccaaggaactgaaattggaatcttgcaatttctactctttagttttacttctgccagtgggtgtcaaaggtattgtgttttgggtttttgtttgtttgttttgcccaccttttgcttgtactttatggtgacatctaacatctgttcttgagttgtagatggaagttcaaaatacatcatccatgagtaaagtgacccagtagcattactttataaaagtcagtttttgttgcatttttttttggagacagagtcttgctccattgcccgggctggagtgcagtggcgtgatcttggcttaccgcaacctccgccgcctgagttcaagcgattctcctgcctcagcctcctgagtagctaggactacaggcgtgccacaccacgcctagctaatttttgtatttttagtagagatggggtttcaccatgttggccgggctggtctcaaactcctgacatcaggtgagccgcccacctcagcctcccaaagtgctgggattataggtgtgagccactgcgcccagcagctgcatttttatctaataacagatttgtgggatttttttttttttttaatttcaagatcccaaagaacatgtcatctgcaaataggacagttgtattttgcattaccctctaccatggcccctgatagtagtctacccatgctaagaagttcctacttacctccacttagactactgatttttaaccctccccagtcaccttcaggctcagccttggggtgccctggcccttcctgttatcactctggtgtgctctgggattgtcataacctcatattttcaggaaaatgaaaatgtgtataaaaaaattaggaaaataacctcctttgatatgaaagtttatccagaaaatcacacaggtcaatagagctaatatgtttaaagaccttcatacttccgggcacacagatctcagtaagacatagtctgttttcaaagccacaggtgcagagaagaaaaaaaacccaataaagctcaagttgttctcattcattaactacattcaggaaagaactcaaaacaacccaaataatttaagtaacttttgaacagtgtttgactatcctcaggctaatggccaaagaaagccagaaagaagagaaaaaccaaactgaaacccaagccaaacaaaacacaaaaatcccattttatcacactgagttttaggaaataggtttgttttcctgttgaggtatgggacagcaattcggaatcatacttatcacactgagttttaggaaataggtttgttttcctgttgaggtatgggacagcaattcggaaacatactttcagtgcattctaggattgcctatgtgttaaaggaggctatgtttctcattgccagagaaggacatgctggagtgaacagtgtggtgtcagattgaaattagaggtcattgtataagccaggtcttcccaactacttcagcattattgacatttgggtcagaaaattctcagttgtggaggctgtcctgtgtcttgtaggatatttagcagtatccctggtttttatcttttatgcacaagatgtgagcagcagtccccttcccagctgtgacagccaaaaacatctccagatagtgccaaatgtccctgggggcaaaactgccccctgtggagactcactagtgtaagcaaatgacatatatatatatatatatatacacacacacacacacacacacacatgcatgtatgtatatatgtgcctatgtatgtagtatttatatgtatataaatatatatgccatttgaccatatgcacatatatacatacatgcagacacatctctctctatacatatgtgtgtatatatatatacacatatatagatagatacatgcagacacatctccagatagatatctacatagagctctctatatatctataggtataaatatatatatacggagagagagatgtgtctgcatgtatgtatatacgtacatattcacatatttcctagatctgtctcttgagacttggcagcaatgacatgttagtagcaatgagcacctatagcacccaggagttgagttgtaacaccattcttgactaaaaagagcctgggcattttggaaaaatggtttcttccagggctggggctggggcaacatgaggtgagcctgtaacatgttatgtcagaaagtaagaaaagctcaaaaaatgatggggacatatcaaaatgacataggagtttgcttgaaggtgctccctgtcaccaaatctggggcagcaaattaaaaaaatttaagcagtacaatgaataataatttaataaaataagattacacagcccatactaaataaataaatgagagaaaaagagagctcttccttactcaatgaatggatctcaacaaatgaatgtagaatagtaatgattccatcattagaagatcacacaggctggtagtaattgattcaggcaacagtaattcaatggatgctaaaactagtgggtgaaagtgggtgagtaacagtatatttacatcttacaacttttggaaagacatcagcttgactgaggaacatgtgattgtcatctcgcctaagtgcttttactgaaagatcgagagaaagacgtctaaattatgatacagtccagagtcaaatgagcaagtataattatttttatcagcatcaatgcttggcaaaataaatacttgttaaaagaatgaataatatattcctgttaaatataatatatggctgttgtgtcaatatcaaaatcataaaggtgccatcatgacatatgagcagagtaactggctgcaattttcttaggctaaataaatttttatcgtatcagcagagaagttttgaatgttaggccttcagctatacatataatttagagttttgatgctgaaaacagaaacctatatctgctagtagagtaaagaagtcatgtttgaattattcctttatattcatagagtctttaaacatgaagtctcactatggtaaactgatggaaataccaacatgtgaatttattattaaggagtaaaagttgtacattttacattatgtcattaagcagcatgaattttttcccaatataatccataggttcccaaggagcatgaatgttttttaaaaatgtcgagtgatttagatttctgttggcttgtacatcaatagttcctccctattgcaacagtttttacaaagctgagatgatctgatatgcataccagtcatgttaaccaaaagaccttgaagacttacctgctggggaatttttgccccctaaatggctcaccccaccatttgtggtttctctatgctttatgtaatttagtagctcacattcctccgctcgccatccacacacactgctatttcttttctctgcttcttatggtattctgtctgcacttgtatctatctgcatttgtatccagagcagcatctaatgctcaagacatttgttgaactcatctgactacaacaacacacttgtagtttttcatatttaacctgctaggtatctggtttatggaacaaaacccattggctcttgagttgttgccatgttgatgctctcaagtcttttcctggaagagcatttgaacatagagacatatttctcacctcagtaattatgctgaaagttcattatgtgccttcaaaatatttctaaagatgcaagaaaggggattggaattaagtggtttaatttattgatggtttttagcacaagtgaagagagaagaaaatatactaataatttaatagtgatgatgataataagaatagctccgtcatatagagaccttattatgtgccaggcatggttccaagtgcttcaaatacattagtccatttaatcttgacaacaccttaaagtaggttcaatcaccccccaatttatagaggcagaaattgagccacagagaagtaaagtaacttattcaaagtaagaaagctggtaagtcatggaacctgggctaaacacaggtggtctggccccagagtacagatcctcatccactatgccgaattcatatgccttacgatttctatgcaaaattttcctttgtcgctgatatggtttggctctgtgtcccttcccaaatctcatgttgaactgtgatctcgagcgttagaggtaggacctggtgggaggtgattggcttatcgaggtggtttctaatgttttagcaccatccccaccagtgctgtctcgtgattgagttctcacgagatctgattgtttcaaaggaaccctttgctctgtcttcctcctgctctggccatgtgaagacatacctgcttcccctccgccttctactatcattgtaagtttcctgaggtctcccagccatggagaactgtgagccagctaaacctctttttctttataaattacacagtctcaggtaggtctttatatcaatgtgagaatagactaatacagtcacctttttctgtaatttcatttttagatagaagaaacttaagagtaaagtaaggttgtttgcctaatctaatcacactctaagccaagagctcacggtctaaagctatcaaggtgtagcacattatccccataaatttgcaaatgaatttgaaaggaaatgaattgacaaagcagattccacaattctgaccactccagaaacagagttaggtcactgtctctgtagcaaagagagaagccccaccatgggttttggttcaaaagtcaaagctatctttgtgattttctaagtgcaaacacagatgccaatacttggaagtgctcttctaaaccaccttttgtctgattataaccttcagcaggcaacaggaagccttactatgcgttactctggggccattgtgcagagtttgtgggtgtgtgtacagaaagggctctatagatttctctctgggggcagatgaagcccataaacatgttctattcctatgatatgtgcattttagcaggagaaacagtaatacaaccaaatttatttctcccagctgaactttaaattctatgctgtggattttggtcatctacccatgagcaaaactgctgttcgtctaaattttttctcaaaaaatagtgtgaggaacattctgtagataaatatttgtacatgctctatttcttttattaggatgaattccctagaaatggaatgactgcaccaaagtctatacaaacatttctgaagcttgcagtcttgtaccatgaactgccagatcactctgcagatacatggtgctagtttgcaaagcttacagtgtcaccaggcagtgtataagtaagtgtctgctgggctaataacaccaggtattatcttaaacagaacaaaaagcaaactttgccaattcaatgtgtggggaaatggtgttttattattttaatgcatacttttttatttctaatgaggataatattttatgtgctgtgtgggccataggaagttcttttgtgaactgtctgctgtgaacacattcttttcctatttttctattgacttatatgaaactcagttttcatgaaaacaaccctaagtacaagttgctgagtagttgccatgggtgtggtactgtgctatgctcactgctatcttcttcgtggcaaatattttcccaggtggtttgtgttttaaaataccctcttgtgaaatcatcactcctatttcttgagggagtttttggagcagtctgttttagaagtctacattagttcatttttagcatttaacatcttgagtgggggcctgtgtaggctgcccctgagattgtgcggatctgagcgtgtcctgcaataggaagggtgccgggtcccagcctgaaggtacatgtactcagtcgctaccctggacgccacggcctgtgactgtgctggggacctcagaattaggttccaggtgctccatgggcattgctctgtgcctgctcttctacggatcccaaagggacagaaccttgagggccgacatgctgagggacactgatgccactttccagtgacactaaaatatgggatcacagtggtccagagagctcttggacacttacccaagaacctcttgaaaactgcacaggattatgattgaggaaaaacagcaacgacccactagccctcaaaatatcgtgaggcagagacatttctcttgtggttttggaaactgtctaccctgttgccatggttacgcaaaagctggtttaaaatggctcctatgttggcatctgggctggggcctaactacccgtctccaccattttctctactgcctaccccttcctctcctccaggaagacggtaagctcccggcatggcttctgggtgtagtcactgtgccaagcttaaggctgggccagtcccacgaactgctcctgcctccaccggctcactctaccaagtctggacttgccacatatatgctgctgcctgggctcccttcagcttctcgccggcatctcactggctgtcattgcctttccttgcttggagaggtaagacttgagctttggcttgggaattggggttgaaataggcaaaagcagtctttccatctgctttggctctggcccattaggctggtggaagctggggaaggagctcttcactcagttctgccctgttcaccgggtctgtgcctggggatgaggaatcacctgcttcctctctgggactgcagcagaagggcagggggtggaaaatggtcagatggtggtttttaaatctggatatgctttggcatggattagggcatttgttaaatctagattcctgggccctgtttccctttgtctcaataggataaggtaggacatgagagtctacatttgtaattaattaattcattaattatgcacaaggtaattcaaatgcagctcgtctggcctttggaaagcagtgaatttggagtaggtcaagtaggtcacttgtcctggccaaaagcatctaaggacatattgctttcaacatcctccttcttgtaaacctgaatggccctttagcgccacctttgcacagagaattttttttaaatgtaaggtaattgtagtaatgattaataccagttaaagaagattactttttgcaagtgtggcctataaatatagcacccagtaaggaatttgggagttcacatttgacttccaaaaccaccttggccttgatggtgactcatctcctcatccagagattgcaaggttgatggatctacagtgctccagctttcacatcctctgctgtgcacccttggtttctcactctcttgttcctgctttcttacctgcacatctcccataatgagggctgctgtggcagacaccagacaccgacaggcctggtctcagaagtagaaaggttgcgtgagggtgtctaaaatatacttaagcatcctaataaggctgcttctaaagtcgcccacatggttaaatccaaagcatgtcaatatccatttgggaagggccctttttaaagggcccctgggcagatgaaggttgtcctggcagcttgaggttggtaggtgagtacacacatatagcccaggccaaagaattcatgacatcccacctcccacagattgcaggagtcaaaaagttcccttgagcaatttttccctctagacagccggccaataacatcaacaaaaagtgcctcatgtgcatcttctaagctcagtggcagatgggaacaacccccacaaggactgtgccagaatgaagctgtgatttcagcctctaagatggaacattgcagaaatacccttgcgggggagcctaggccctgcccaccagcagaagccaaatctacctcctgtgcttcccacgtggccaaagggggtgtggctgacaatggggagaaagtatgaaatgtgacaagggcagcaaggacagggctacatttggaggagtccggcctggtctctgtcaatctatctcatagataaaaaacatgaacaggatcagtgcaaaaacaatcactttcccagccctaaatactcattccatgtccatttgaccacttggtgctaggcactaactggccagaaacataaaacacttacttaaatcaattggtgcacaagtcattagaaaaaaaattcaagaaagaaaaagaatcagattcagcttagataatatgctcctagatgcagcatggaagccaggtaggaaaagctgggccatgcctgattcctactgaaggaccacccaaaggatagactggggactggactcggggaggtgacagaagttaggggttcagcttgctgtccaaacgagttccccacttagagcaacatgaaaatctctacagattccatggggaaacttttgaccttgggagttgcagttggttcaagatagtggatcactgggtgatgcattgcacttgggaattcatgcatttaatcaactaatattctatagacttaggacttctaacttcagaggctgtgctcttcctgagtcaccatcttggccctgttactaggagataaagctaaaataagaggggaattcagatggcttctgcctttctgtagcttatagtgcggtgggaaaatggatgtgaataaaatgatcagcaaatacatgcagtgggctgagaattgatcatcacggttcaggttgcagaaatggaatgttctctattttctcatatgtgaactccatttgttctcaagaccccatttctgctaaggggttcaaagggtctttttcataacctctttggtaatttcacagccaatttagaaatcaagtttgatggattcaaagcttattgattaatgaaaggactcttgtctcttcttgggaggtttcccctccattcttcctctctaggtttgcatctgagagcagaaaaataacacagcagctttctggctgtctattgttcctttcctgaaagcctagccctcctggtggttggccactggccttaatcacccttgcatccagtcccaccttggggagaaactaaagacatggtgtgaatgccccctttctcatactccgttagattttgtatctgtctgtggttcagacagaatgcagggatagaggaagaggttggctaaaaggagagagtctgatacaatgttttccagtagccataaaaaagttggtagattagtcaaaatgatagtgtttaaagagaccctatcttcctccacagtatccccagtctcctatagtcatactgtcaaagggcatcaatgaggtgccgagtctggggtcactcgaggtcattggaggccattaaacattaaatgatggatttgagcctctgccacactcagtaggcagcagccatgcaaggagggcagtctctctgggtaaatcttctaggtaagagtaattttatttagtgaatttgcctaatcactaaaaaatggaacagtatttactaaaaggatgtagtgacaaagtacagccttttcccttaaagccttcttcattcattttaattagtgaccacagccacgacactgtaaaagtagattgcagtgatgtgaatttccctaaaggttctagttctgaaaagaatgctttcaaggcctgtacatgttagacaagccaggcagctccctggaaaggagaaactctccagaggagacttgcaaagatgagttaattcaaactcataatcatcgaccgattcattcctccactcactcaacaaatgtttaaatatctaggggcatctgctatatgttggtatagatggattgatgcagggatgtatggagagagagagggaggcagggagataagaagagtggcagacagagagagagagagagaataatacgtattatagggaaggggtattctatgccttcaaaacacttacagaccttttggtgacataagagtatacatatacacacagtaaaacaatattttcagaattaagagtaatggcagacagcagtatcaaagatcacacacgctgtctatgtcatgatttagaaccaaacagaggccaagggaatggaaatgactgaccaacgaggcatagccagggctggtcctgggtaggccgtgaaggggagataatatgtgtatagacacaaagacagaaagtgttcatggagcagtgactacacaagtctggctggagtgagaggggtcttttcaaaagaagcacgaggcagtgtgatgaaggatcaaaagcacaggttttaggacaaagcagttctgaattcaaacccctgttccatttctcagtgctgtgtagcctggagcagtgacttagccttgttgtgcctcagattttttaaatctttggaactggaacaaaatcatccgcctaatgaagtttctgtaatgatggtagaaaagaatacatactggcctggcataggcaaatgccagttcccttacctcttgtacacaatgctttataacacataacacacttccatagatactagccatttggccttcaccataaccttgtgacatggataaagcaggtataaatatcctcattttatgggtgcttggagatttttactatacaccgctccttaggaaaatagagagaaagaaataaatggaaaaacactctacgattagctcaaacaaagacttgaagattaattaagtgttggaatttaattcaataggtaataggataccattgaatagtctacaccagaaaaatgaaaggttagcagtattttaggaagggtaatctggcagtggtaggcaaattggatggagaaggagttactcaagtatgcctctaaggcaagtattttgggtgttgctgctaatagaagtatcaagttactacgtctcaggatgggctgctgatgcaatttgacatcatttcctgatcaccaagaagacatgtgcagtggtccatctgctattcttgtttgcctcttcctcccttgcaaagtgatgataaagataatgacagtaatacaaatgacataatagctaggggtctatgtatcaacagtgcagtggaactgtgtttacatagtaaaactgaatcttcaaaatgttgaagatggggactgtcatgatcagagaagttgataaccggcctagggtaacagagctagtgttgagaatacaggtttgaaacgagctctcattcgaaagtctaagccttttccactctgccattttcccttcaggatttgggagactgtcttttatcacagcaaaggaaatattttatttatacaaactctgcaagagagtcaaacccccaatgttggcttccttaaggactttattgatggcaccaagaaaagacttaaccagcccacaatacagagtactctcttgaggggcattccagcctctgctggggtcacattgccatcttacagagtcttaacctgtgacaggggtacaggctgaacccccccagagacttatctgccacatcagcctcctactactctttctttgcaagcccaagtctgcacagacaataagagtatttctaagacacaatctcatactgatgtgaatctgctgaaagccatctgttttctctgggtcaagagtgagctctgaagcccagtgatcaaggccttcatcacctggcctgggcctctctcagctccactccttgctctacaatttgcccccaagtgacacataaaattcttctttgccccacagaccatgacatttccagttggtgctgagcctcttcctttcctgtacctttacattttcatttccccaattcctcctaataggggcagcatttgaaaaggatggcttcccccttgttccagaataggtgcttcttcccccaagtgcctccataattccatatgcatttagccattatttcccaacaacactgtattaaagtctccaggacatattcctgtctattagattgtgaataccttgagataaagttctattgattgattcatcacctttgcataatttctggccagtagtaaagatttaaatatgatgtttgaatgaataaatgagtgaaatgttctcaaaaagcattctagaaaggttcctccagtacctcaatatccacaaaatgattcacaatttggaggcatatatggggtaatgtggcaactgttagcttacccaagaacaaagaagcaggaatgatgaaccatcactgagaagctctaatcaggaggttgaaatccaaggagggtgggtggagggagggacacacacctgttctgtgtgggcattggaaactagtcaactctgacatgtaggccatgctccttggctcttatttaaaaccagtttgcagagaactaatggaggagcacgtggaaagtgtaatgcagggaaagaataagctctacatggaggctgaaacatgggcacgccctggagaggccagcttctgaaataatgtacgcaggaagggaggagattgctgtacacctcatgactcgatgtgtgctttcaagctactacattgcatttaatgcaattcctgcttgcataacatgataacaaacgtgtattagtctgttctcaggctgctaataaagacatacctgagaatgggtaatttgtaaaggagagatgtttaattgactcgcagttccactgtgattgtggggaggcctcacaatcatggcagaaggtgaatgagcagcaaagttacgtcttacaaggtggtaggcaagagagagcctgtgcaggggaactcccatttataaagccatcagatctcatgagacttgttcactaccatgagaacagtatgggggaacctgcccccatgattcaattatctccacgtgaccccgcccttgatacaggggaatcattacaattcaaggtgagatttgggtggggatacagccaaaccatatcaaaccagcacacttacagtttagctacccaacatgttcacctctctgagatgcagtgctaaatcagaagtaatcgaatttagcaatgataaatcggatatgaacaaagtagctgagtttatcacaaaatttatgtaataaagcttatgctgtttccttataggaagtcccatcagacacctactcagagccaatttatctttatttcacacgtgattctagaagggggtggacacatataatagcgattaagcgtgagggctttggagcagactgcgttcattccaatctggctatgatgtttgcaaggtgagtcactgtaagcgagctctttagaccctctgcaccccagtttcctcagctgtacagtggaaacatcaataggccatacttacagggctgtcattaggataaaagtactcagcaagtattagttattatgaaatgtggttatctagcatctaatctcacagtgaatttgaaacaacagtgaggaaaatggtgttagtaagtcaagtgtgctgaaaactaaggcaactgaagtttggcagcaacacaggcactagaagccgaaacatacacgttaaaaaagggcaatagtttggggctattggcccagtcattggaaaacattaaaaactccctgtccttttgaagctttcatctgactagggagctgaacatgaaacagaagaatgcatgggggttgcagctcagtggtagagatttgactgcagatgaacacataataccagatacaacaggaggtatgagggaaaataaagaagggcctggggagaagaagtgtaaggggatgagaaaaagcctctctgaggaggagacgttcaagctgagacttagatgtatgagagtgcgacgcatgtagaaatctgggaaagggcattcttggccgagggaagtgcaggtgcaaggtcgcgagcctctgttgtacttgatgggtttttagatcattagaatcctacttctatgagggagacttgtttgtctatttcattcactgctataccccaggtgcccaggagaatgtcagatagatggtatttgctcagttaatattcttgaataaatgaatgcaaggagacaggagtagctggagcattggaagcaaggagaagtgtggtgcaagaggaagttcacaagacagcagggtgcagaccacgtggggcccatgggccatggtggggacttcagagatgctctaagaataatgggaggtggctggaggcatgctggctgctgggtgggaatacacagtagtggacaagactggaaacaaagaaagcaggtggcagaataatccaggctggaggtgattgggcttgaactagaaaagggacagcgaaggtgatgacaagtgccccagttctatgtatacactatgttcatcactgcataacttgatagaggatgaaactggaggaggactagttcaccaacagtaagggaatagacagggaagaggtggcagaagtgtattattgaaaattgtgcagcaatgaacctaatagcaaacagaaacagggataaatattaaaaatgtgggccagtggcttaggtgggtggtggctcatgcctgcaatcccagcactttggccaaggtgggtggatcacttgaggtcaggagttcgagaccagcctggccaacatggtgaaatcctgtctctattaaaaatacgaaagttagccctgtgtggtggtgggcacctgtaaccccagctactcagaaggctgaggcacaaatcacttgaacctggaaggtggaggttgtagtgagctgagattgcaccactgcattccagcctgggtgacagagtgagattctgtctcaaaaaaaaaaaaaaaaaaaaaaaccaacaaaaaaacaccaaaaaaacaaacaaacaaaaaaccccccaaaaaccaaaaaacaaacaaacaaaaaaacaagtggcatagaatatacattttggaaaaatacctatgacaccattctgttcatgtaatttagaaatgaccattaaacctcatgtatcttagtatcttacagggatacatatctacatatctgcatatccaaagataaatttcatgctcttttgagttgatgtttagtggaggctgggagtggaggggtagtgaggagaggaatgtaaggagaaattgagataaaaggaataataataaaaaatatggtggtaatgtgccacatcaaggaatgcatttaaatcttggcttctgaggctcaaacacaaagaaaacaatccctttgaccccaaccattaatgaccaatttctctgtgaggacatgtaatttataaaatcattttacttttgtggtatgtgtggtccctagcttcctaaattgtcctcaacaatcactgcctcctactattcatgcacctgtttagttctttctcatgctgaatagggctgacctgcaaatcaatgggatattacagaaatgacaatgtgtgactgccaaggctgggtcataagagacattttggcttattccttattctcttggatcagttgctctgaaggaagccagcagccatgttgtaaggaaactcaagcagctctgtaaagacgtctacatggtgaggaactaaggcctcctgcaaacagctaccatgcaattgccagccacatgagtgcaccatcttggaaccaaatgctctagccccagtcaagtttacagatgagtcctgcccacatctttactgtaacctcatgagagactctaagctggagcacccaaataaactactcccgaaattcctgagtcacagaatccctgtggggtaacaagtgattattactgttttaagttgtcagtgtcgaggtaatttgttatgcaataatagattaaatggaccctatttaagtcagtgctctgtactctttccttcagaactacttcactaagagttgttgagaagtaaaaggactgtctggcttgggactgattcattgcttctcattacctcctctttcccttctattggaaaaagtgttaaaagccataatttaagtcaaaataagtaaccacctagttcaggtaaaatcaagtcgtataaaactggagcatataaaatcaaatgttggcactgcagataaccgtagaagcatccttaaacagacaaatgagtcctaggattccacagtggttttcattaatgcttccttttctatatcatgtagacctctgaaaaatcattgccttactttgaaaccttttctctttcctctctttacaaccttttaagagagatctataatagtacccatcaaaaactgatagcttaaatgagtgaaataattttgcatttcctcattgttagtaggacttaaaactttcccacagtgacagagagacagcatgtcctgagggattggcatatgaaagatcctgttggtctattgagcagctcggtgggagaagtgaacaccttagtccatcacagtaaagagagccacgaatataaaatgggaatggcgttttcctcccttgttggaaatgatgtctactagtttgccatactactttaaatgtacagtaaggaaaaaactgtcatgattaaattctagtaaatcagaaaaccaagaatgcaaatagaaccggtaactggaggtacaaacacttacctttgattgaattcagaatttgctggtgatctctgcctggccaatggtttgcacttgtcagacagggaacactgcagtagggtttggggctcacgatggaaacagaacccactgagacaaggaggggcctggctgcagttcaggctgcaggatgtgtgaccccttccaggtagccatgaggcctgaactgagatgttcacgagaatgttggaaacaggaaccaaggttgggcaaagttagaaggagtcttaacaactggctgataaatattaatagaataggccagaggttgattcccagaatctgtagaattccagaaaggacaaagaggaaaattataaaatcagaagcctggaggacccttgggattcagagagagaaatatcttctttatccaagataacagtcatcacctcattagcaataacagaacttaatattttttgtaatataaaaacatttttttctggaaaaggtacataacattatattgtaattataagtccttatttttgagacagggtcttgccttgtcactcagggtggagtgcaatggcatgatcacagttcactgcagcctccacctcccaggcgcatgtggtcctcccaactcagcctcccaagtagttgggactgcaggctcatgccagcatgcctggctaattttttaaattttttgtaaagacagggcctcactacattgcccaggctagtcttgaacatctgggctcaagcagatcctctcacctcagcctcccaaagaattataggtctttaatcatctgaggggaaatttgagatgatgatgaaaattagacaaagacaatcaccaggtctttcttaggagagagacaacatgtatagtgaagatcatgggttttggatttaggtagtggtcctgtttcatcccaactttgtgacctgaagtgagctaatgagcctcattttctagaagttagtatttatgaagagccttcactataagccaggcactgtgcctagggatttacatgcatgtttccagtatgttcccacaacagccctctgagtgttgctatcttccaatttatgaatgaggaaacaggctgaaagagaggttcaatcatgtgtctaagttgttgaaactaaaactgctggtgtcggaaggcaggcgtctgactgcacagtcggagctttccacctctgtattacaggacctccagcctcggaggggaaagcttcagaatacgttttccaggtcctggtgacagaggagatgatcttgggaaattgtattcagactagtaagtaagttctaggaaggatcaacaaagcgatggcatctgaatttgtgccaaccaaatttgtcttaggaagggctgcagtaacttggtctcccatccgtccaaatagaatggaaaaaactgaacaggataaagtgcatctgccccttcacagtgagccaagccagcctggagctggagttaagaccagaaacctttaatctgttctgggcttttgctttcctggagggcagaaattcattttgaacagtacctaacacttactaaacagtaaatgtttcttgaattgaaaaatgtttccaaaaattatttgttttgttcaaactatgaagatgcattttttttctgctatggatataccgtctagggtttgggtacgggagtaacgatttgggtagaattttggagctgggacaccaggtggggtggattcagcctgaggatgataatcagaaccagcaacatttttgtttttttttttccacctaagcaatctcttgatgcagctattaaaaataaataggtagtttcatcttcagctttctttacctttcactttcagagaaaattggttaccattttctttgtgctctccattcggttctctatttcacatgtcttttctggttatttagttccctggcatcaatctcctatcttcaacttcacctgctcttattgtcttccctttctgaatctgcacgcctctgtcattttccatggatcaaggaggttaaattgacaaataactgtttttgaaagaagaaagggaaaaaggaacaacaaacttcgcttggatgtttggaagtctgccttcacagatcgccaggctttgctgacttatttataaaagactatttttattttggtatcatcaaagagcttattcatgtcaaggtttttaaggtgataaactgcaaagatggaggattatctactgtgaaagagagggttttttttttttttttttctggcatgaggaaaagaacatcactgctaggaaatggtctgggcctaacaccagattactccttttatgaatttgcaaatcggtagaactggtcagtcattggaaaggggagataactcagagagtatcaagcatacctgagaaaaactggcatgaaaaagaaacccaaattaaaataaaacagcctataattcattttttctttctaaatgagaccatctatttgggtttgtgtcctttccaaattcctaagttgaattcctaacccccagtgtctcggaatgtgactgtactgtatttggagatagggcatttaaagaggcaattaggttcagatgaggtcctatgggtgggccctaatccaacatgactggcttccttagaagaagaggagattaggacacagacacacagggaggaccatgtgaggacagaggaaaaagacagccacctgcaagtcaagaagagaagtctcagaacaactcaaccctgtgaacgccttgatcttggacttccagccttcagaacataaggaaataaatttctgttgtttaagccactcagtatgtggtactttttaatggcagctctaagaaatgattccagtctctcgtgcacatttcatcacttctgtacccataggacgtgtgtgtgtctgtgtgtgtagtgacgagatgagattgaagaaaatgtctttatctttctagctcagtactcctcaaaatgaaagtaaaaaatagtgcaagggctggatgcgctggctcacgcctataatcccagcactttgggaagctgaggcgagtggatcatggagtcaggagttcaagaccagcctggccaagatggtgaaaccccatctctactaaaaatacaaaaattagctgggcatggtggtgcgtgcctgcaatcctagctactcaggaggctaaggcaggagaattgcttgaacagggacctgggaggtggaggttgcagtgagctgagagattgcaccactgcactccagcctgggctatagacagagactctgttaaaaaaaaaaagtgcaaggtgactgtggctactgctcccacagattatttctaacactgactctcagctgcctcagccaactttctgcttagagtatgagctggggctgaggccccataagactgacagataccgcttctaggaaccatgctcatccctgggtaagaattactgctgtaatcagcattgttactgtggaaagtatatttattccttttagaatgttgtgaaggtaagaagaagttgagaatcactactttgttgagagttccttgctgtacttctatcttgggcctttgaggtggatggaaggacatacctaaaaatggagaaactcaccaagccttccgcaaaaaaaacgatgagattggaacctagccatggtatccttggagaaaagtgtgaatgtggctcttttactaacataacagccaagtttggtttccttaaatacacaattgggtggccttttatattaactttgttttcttctcaaaaatctttatggtttcttacatctagggtaagaatctcagagaatctcagcatagccattgaaagccaggttctggggccagataagctgggtctgaatcccacatgctcttaactaacttctctgtgcttccaatttccctctctctaaaatgggaatgatgataatatttccatcatcaggttgatgtgaggatttaaagagttaacacatataaaatccttaggatagtgcctggtatgggagttcattaacattacttatcagaatatctccaactgtgcctaatagtttgctttaggaagaaaacaggaatccctaggcaaagtatgaaacatcttacaagatggaagcaagcttgaagcaacaagtaaacatcactctttgatcgttccatatttggtgttttgggagtatacaataaaacacttataaaatggttacatttggagtagaatgtagggcttagaagtatcattgagtggtacgattggttctaatagttatgtggagataaaatcaggttaaagtgaatgtcaaggtaaatcttcaaagggaaaaaagaaaggccaagaattctttaaaatatttgctcaatatcttttatgtaaaacaaagataacagcatcttcttatgggatttttaagagttaatatgctcccttgggagatatacctaatgctagatgatgagttagtgggtgcagcacaccagcatggcacatgtatacatatgtaactaacctgcacaatgtgcacatgtaccctaaaacttaaagtataataataaaagaaaaaaaagagttaatatgctctttaaagcaatggtttcaaataatggggtttcctttaaatataatgaaaatattaccatatagttatgggaatagatgccactgataattttagaccataattcagaatctgtcgatgaaaattattagataagccaagactggggataataccattggaacctcatgttctagaaattgattcttaaagcttgaattttaataatgcttaataagtggtttttgattttggtagaaagctatcataggtatacttaatatcaacatttgtctgattagagattttatgacataggtactttattcccttattttttttttttaccttgagtcctttggttgcacaaataactttaaaagaataaaaagtgatgaatatctaacatcaaatcctccttactcttcattgctgtctctaaggatggcagggcaactgggtggatttcctctgatccatgaatggtccagtctgacaatgtggtggacagacatgaagtatagggactgtagcttggttcatttgctcaccacgtgtcataataattattagaccaggtcagtccaggggctcaactaatgtgtcaatggtatggttttcataagcaacaaatatcaattaaaaggaaattagcatcttacctttcaagtcaaacattaagaagttaagtcattttccaaggcaaatcaaaatagatttgatcaattatttgtatgctttattacttggttcaattatttacactattatattagtgatgggggttttctgggaatttactaaatataaaacaatcagagaaacaaacaaaaacactctttaaagcaaagtattccctctgtgaaaaaaactatcaagtattaaaattaatttggtctctaactaatgaaaacctttctggaagagtcctatcattttctttgtggcaccaaggttattcataattaaaggttctgacttattgctaataaaagataccaaaaatgatctgagtcactgctaaaattcaccttgaattttgattgaaagaaaaaaactgataaattgcattcatctcatttcatttaaaccttgacgtgatgcttttagaacttactgctttaatttgaagatacatttgtaggattttccactaagttcttgatattttaggggggagacttacatgattattgggataaagctccttgttttattctttgaatgggtgttcaacagtaatgaaggcagctagagaggagagagacgtcttgactttcccaatgctccactccctgcaatccctaaacccaccgttttttcctaggctacacacaaccactgcattccagcctacacacattgggttgggtatagaccagtgttttttacaacctaagatctttttaggggattgttcctaccaagaaacagaaagaactctctttatgtgttcaaagcactgagccgatacttccaagttctttccgtttcttatctctttagttaccttaaccacaaactaggcttgtctgatcatggtgctgacactaggctgttctcagcccttgtctggcttatctcttccaaaatggtagatgtctacctctccctgtcccctcaatctctgcctctacatgctgttttgatacaatccatctttctcttgtttcacatagacactggtcttcattactctgcactctgggcatcaaccactcacttagtcccagttctcagtcagaccaactctgttctaaactaagatacacatacgtatgttaaaggaaatgctcagtgacttctgtaagacgttgaaaatactttacatgctttaccacactttgaggtttaaggggactccccccaccccaatttcactaccatttgtgagctcatttggtcacactccccctgcagaaaagaacttgccctatatcacatttccttactagctaatcttaccggttggagaatataatgttaaaatggaaagtgctactacaacaagccatgatctcagagatccttttatattaatagaagaatccaggagatcagggcctcaaaggcaaacaagttactacctgatttttgagtgagttaagatttgtaatacatcttgtctctgttccaaatagtggtggtgttggtgggtgcatctcaggaaatagaggtagttgtgggtgaaagaagtgaggaggagttgggcctgtagctcaaagcaaaaggtaattgaatgcacatccccaaaatggtaggctcaggaagcaaagtacactcccatacatccaatctgctggggcttcgttaggaacacagaagagaccaactgaagggagataaccaaggccaggcaagacccagctagtgctttggaaggcagaggctgaagatcttttccaggccaaagacatccagttgatggcaacctcatcaatttgccaagagcttgtcctgctcttgtcttgccaagagcttctcttgctgtgaatgatgccagagaaggtaggggccacagtgagtcaagcacactgccagttactcagctcactagatgctggatcccccttcctttttccactattgaaaattcatgcaaagtggcaggtttgtcacctgctgttagggtttcacagaattcttcctctgcatatgcctgtgacgatctccttcctactgcctgcctctctccagcactgcagataagtggatctagcgtgttgtcttgtacagggtaagagccaagcacgcatgcctaggttggtgaaagtctattaggaagaaacaacacattcagtaaggaatagttaaaaatgactttcagcataaaaaggaatgaatcaatggcatttgcagcaacctggatgggactgcagactattattctaagtgatgtaactcaggaatgctctcagtcataagtggaagctaggctatgaagcataagaatgatacaatggacttgggggactcaggggaaagggtgggaagggagtgaggaataaaagaagacaaattgggttcagtgtatactgctcgggtgatgggtgcaccaaaatctcacaaatcaccccaaagaacttactcatgtaaccaaataccacctgttccccaaaaacctgtggaaataaaaaattttaaaaaaataaataaaaatatggactaagaaaaactacatcattataaacctaaacagaaattatcaataattctttcataataaaaaaggaatatgtttcccataaaaaaggctttcaggaagaatattgttatgaagaaaagtttaagaaaaagaggcaccaataacacagggccctggaccttcatacatgatatcattcagcaatactttgctggctctgtgtcatacatctgtctcttggctctgatctctttcttgcccttaccaaagggctcactgcaaactgtatttcccagcctcccttacaattggcttgagttaggttcaaaaaattagatagtaacttgtttgtccttcagtgggaggcttggtgggagcaagagagaagtcagggtgtttcttctgctctgcctcaagtggctccatctctttgtagctccggacctggggcttcagtggtctcaggacccagctgtggctctgggttctgggtaccttttccctgtgacttcacaccacaggtctaggttgtgtaggcttcctgctgctaatctgttttctagcccttcccaccatcttggtaacaattccttctcttaaatcacgtgatgtgggttctgccttcctcacaggaccctggctgttatatccccattattttactataggaaatttcaccagcagagcgcctctttgtcgatgcaggacatcctctctgagttatgtctggactggttgtatatagttgacccaatataatgtgcaattgtatttaacatcacataagcaaaatatttgacacaaacacaagcttatattttgttctaaaaatctgttattttctaagaagatcatttataatatgggtgagatgttagtaatgattacaccaaatagcataaatcacactggaaaaatatatcttattgaagaccacctgtctacaccttttttagtccacatgatattttgtttctttaaggaacacaaattcatttatataaatcccaaaacacagatggtaggtgctaggaaaaacattagaatagatgcagccttttaacaatatctgagatttgaaggcacagtgagaagtgagttctatattactgagattttttcataccaactaaacatctccatgttcaagaacaatctgatctaggctctttgcctattggatttaccacttaaagaataatagcttgagtacccctaaaaatcccacaaaatgagttaattatgacagaaactccaaaaaaagaggcagagccagtatttcattatttgtggagagttgtgcaaccatctttgctggtttcaaagtaaggaatatgttcacacacatatacttcctgctggaatgatgttttctctcctacctggttaacacctctcatccttcaaatcttgagccagttagcacctcttcatggagtcaaatcccctctggaacaacagagtgtgccagtaccaggcctaacctcagaagcacatatcacactgaagtctgtacttctttgctagattattggattagcatctttctttcccatgacagagcaagcctcctgagggcaaggactgtttccaatgttgcttatgactattttccttgtgaatagcacatgctaaatactcagtgcaaaccagtcaaatgagtgaatgaatgaatgaatgaatgatgaacattcattgagaacagaacttctcaagcttcagaagtggtgatggcactggaaccagccctgatatctgctgggagtgctccacagcttttctgaacgctgcttccatttaccctagtctgaggcagactcacctggcaaagattatctgattttttaccagcccttagaagggactgttttttattgtgtattctaattgtagtgttacaataaaactgaaagagaattttgataggtcagcaatttaaagaaaaaatataggtattgatatgaatgaactatacgggctgacagttatctatggtcaaggaatgacaagactggaggagagtccaaacctgagagaacagatgagaaagtgtcccttaaacagcacatgaaggcaaatcatcattcagctcagaagttaccttttctgcacttcctatttaaaaagtcaatgttttggggtcagcagagcctagacaacaatggaagaaaactcatttagttcctacatgtttgccccatggtgtaagactaatgcaattgatctagagctgatttaagcattaacattctaaccagaacaaaattagcaagttaaaacgtgacagtggttttgcagtggttctgcattttcagtactaacctcacattacacacatatacaaacacatacatcaaaatacttctggggaaggaatcttctaatatatttaagttcatatcttctaattcttaaatggttgatgtgtaattatagtgtaaaggtgtctcttgatggataaatagaaaacttttggacaatagctgtcaaagtaatttgaaaatgatgtactggttcttcatttttccttttgtttgatttatttatttattgattggtccagctcttcagctgaatttaatttcaaatgtatccactaaatttttttgtaatttcaagaaactctggtttacagagaagaaaagttgagttggcctattatatggtttggctgtgtctttatctaaatctcatcttgaattgtaatctgaattgtaattcctacgtgttgggagagggacctggtgggaggtgattggaatatgggagcggttcccccatgctgttctccatgatagtgagcaagttcttaagagatctgatggttttataaggagctcttcccccttcacacatttttttctctcttgttgctttgtgaagagagtacctgcttccccttatgccatgatcgtaagtttcctgaggcttctccagccatgcagaactgtgagtcgattaaaccttttttgtttataaattacccagtctcgggtagtatctttatagcagtgtgaaaatggactaatacaacctattaactgagtatcagttttactgaagatttaggttattagaattattaagacattttatggaaaacacaggatggtagaaaaacgtagagaaatttctataatagagagatagttaggaatgttatattacattcttgctagtgattagtcggtttataagatggattctaaaactatgcgtaggagcatttgactgaagttaattaacatgactcagatcatacagtttggggaagaaaaaagcatttcccctcctgagggatgattttttactgcttttatcttttaatgccagatgggaaaatatcaaggaagttcgctttaatctccttagctctttattaggatgtgtcatataatggtactctggctcattgggaccaaccctatactcttggggggaggattcccactgaggacgaaggctgttttaacttcacactattgaccactccccctagtgatttgcattaaccaggtgcctgaatggagataacagggtggcatcggaccacggcaaagggttgatttcccacttgggtgaactggttgatcatggccacaaacctgtagcctcagccccacttagcctagtgttgctattgagccaaggggtgacacagaagagcatgctgagggtaggaacaaaaccatggtaagtggagagaaaagggtaaatgttaatcatttaactgaacatatactcattggtcaagcttcaatgagattatcttgcataaagaaagatgtctattgaatgaaataagtgtatgaaagatgttagagggtactgaacagttgtctttattgctacagaatcagaagcaatggaaaacaattataggcaggagagagtttacaataagtaaataagcacttggaatctctttcacccacccaggacggatggctacatgccaccttcttgatgtccagggccatttttcctcttaactactgaaggattcatctgcttcttttcctaagttcctaccagggctagactctgtgttctgcccttggaagactgaaagccatctctaagtttattagttgtatatcgaatatgcaaaacagaaagcagcctaaatttttcaaaagttaattgtcctgagaaattgctttacctcagatttttgagtaacttattctttagctcctgaaatggtgtgtcccagagttctgctctgtattttccaaagggaaaatatttttaaattcctataagtttagggggtataagcataggtttcttacatgcatatattgtatagtggtggagtctgggccttcagcatacccatcacccaaatagtgaccattgcatgcaataggtaattttcaacactcagtccccctcccaccctgccaccttttatagtctccagtgtttattatttcattcgatatgtgtatgtgtgccctttgtttagcactaatttgtaagtgagaacaagtggtatttaactttgtgtttctgagatatttcacttaggataatggcccccagctccatccatgttgctgtaaaagacatgatttcattcttttttatggctgagtagtattccatcatatatatgtacactacattttctttatccaataatctgttgatggacacttaggttgattccatatctttgctattgtgattagcgctgagataaacatataagtgcaagtatatttttgatataatgatttctttctctttggttatatacccagtagtttttggattgctgaattgaatggttgttctatttttagttctttgacaaatttccatagtgtttttaaatggaaatattttcaccattaaaatagtgatgcttaaaggatgatggtatggcatctgatatttcaatcagtctgaaacatactctaatcttttatggcatctctaaactagtaagatgggaaaaaatggccggagagattccatggcttggataaagttgttccatctgaggccttgtgcttggagctctttatcatcatcaccatcggattgtcctgaggaagggaaatcacttctaacattactgttataaggaatatttcatcacttgcttttaatattaggtaaatattgatatttgggttttctcttaatatataaaagttatagacaattgtttatcattcaaagtaagaaggtatttttattttaataaaggaaatggtcaaatgtggaaaagataaagacttcaagaattaagagatcaagtatttttttaaagttatcttcctaaaaacatattatcttaaaaatatttctcatttcataataaattagaactatgttcatgggattccacttgagggacaaaaataaaaggccccacagggatttcagaagctctgatactaagctgccaaaacaggatttttgatgttaagtggtgtgaacagatcttattttaattgacacatttgaagacgagtaataggatgtgtgaaggatgaaactgaatgtacttcaatgaacattaaacaatatttttactagtaagtaaaataataaaactatttcacacaagaaggtgtcagtcacacttaattattttttaagcaaaaagttatgtgacttatctctccagtgccacagcattgtgttcaaataaagggaaagtctcagaattatctataagaaacaagtgaaggagccttttcagatgatgataaatacaagattaggaacttttcaaagggtctataaatcactaaagggatgagatacttcttcctaagacagtgttacgaggggcagatttacctcacgcctgaaacaaccaaaaacaccagacaaaacatatgatataactgtttgcaaaacactggacatgcggacaatgaagggacagtgatcactgacagatgggaaacaaataagataagcccccaaattgcccctgcttacttcataaagttgcagcgcgcagactctctgaatttagaagacagggaggagagtgcaaggagataaaggcagctggaattctcaggacagagcaccaaagagaagagagctgcctggggatccgcagaggatccaaccggcaaatgcatgtgaagaaattactccaggctgcgggggggaaggaacatcagaaaagattagagaacagtgcttggtgtccttgcagagataggaagagtgcctattcctaccaggctgcctggaaaaactcagagtttatggggcaatgggtagtgtgctcaaagacctcttgttttagtaagtggggaattactagccttatattgggcatgctccggacttgtctaacaaatcataaaagcaagacccaaaaagatcaagctctttccaagggacttaactgtatcagaacaaaacataagaatatttataggaatacaaaaatatccagtacctgacaaggtaaaattcacaatgtctgcccatcaatcaaaaagttaggtagagacaggccgggcgccgtggctcatgcctgtaatcccagcactttgggaggccgaggcgggtagatcacctgaggtcaggagttcgaggctagcctgaccaacatggagaaaccccgcctctactaaaaatacaaaaaaatcagccggatgtggtggtgcatgcctgtaataccagctactcgggaggctgaggcaggagaatcacttgaacccaggaggtagaggttgtggtgagccgagatcgtgccattgcactccaccctgggcaaaaagagtgaaactccgtctcaaaaaaaaaaaaaagttaggtagagacatgaaagatataaaagacacccaattgaacatctagagagaaaactagtatgtgtgcaataataaatacactaggtaacattaatgctagattagacatggcagaagaaaagattagtgaacctgaagacatagaaacagaaactttccaaaataaaacacatagaaaaaagaacaattcctcaaaaatgaacaaaaatacattggtgagctgtgagataatgttaagcagactaatatatgtatacaactgaagtttctgaaagggacataagaagaaataatggttgaaatttgatgaaaactatatatctaccaatctaagaagctcagtgaactccaaacatgtgaaatatgaggaaaattgcacaaaggcacatcacaatcaaactgtataaaggcagcgataaagataaaaatcttaaaggcagccagggaaagaaggtgttcttcatagaggaacacattaaaatggtggtagattgctcacaggagcaatgaaagtgagaagatccgtttttaaatctggaaatctataccgaagaaaatgtctgttaaaaatgaagatgaaaggaagatgtttcaccctgaaagaatccctttaacatttttttttcctttttttttgagacggagtctcgctctgtcgcccaggctggagtgcagtggcgtgatctggctcactgcaagctccgcctcccgggttcacgccattctcctgcctcagcctccccagtagctgggactacagtcacccgccaccatgcccagctaactttttgtatttttagtagagatgggttttcgccgtgttagccaggatggtctcaatctcctgacctcgtgatccacccgccttggcctcccaaagtgctgggattatagaagtgaaccaccacgcccggcctatttttccttttcttttagacagggtctcgctctgtcacccaggctggatggagtgcagtgatgcaatctcagctcactgccacctcagcctcctgggctcaagtgatccttctacctcagcctcctgaatagctgggactataggtgcacacaaccacacctggctaatttttgtatttttttgtagagatggggtcttactatgttgcccaggcttgtctcaaactcctgggctcaagtagtccacttgcctcagcctcccaaagtgccgggattacaggcatgagccaccacactctgccaacatttcttatttactcatctcttttccaggatttgaaactgcaatagacaaaataatggtcccccaagacattcatgttctaatccccaggacctgtgaatatttactttacatggcaacagggactttgcagaggggattaagttaatctcgagatgtggagattatcctggacgatccatgtgggccaatgtaattatcagagttcttataagagaaagagaagaacaagagagtcagagccagagactgatttgaagatgctttgctgctgagtttggagatggaagaaggagccaggagccaaggaatgctggtggcccctggaagcctgtaagggaaaaggcaagggaaaagccctcccctagagcctgtaaaggaacacagccctgtggacaccttaactgacagcccagtgaaacctcttttgaatttctgacctctggaactgtggaatgacaaacttatgttgttttaagccactaagcttgtggtaatttgttatagcagcactaggaaattaatacacttacattcaggggatgacacgttctaactgactgattaaccacatagattttacatgtatcttagatatttttaaaatcgttagacatttgttaatatccacactactaatccctttctatttactataaattaatcttgaaaaaaaattacattttctgcttcaagattattttattactttattatttacttactaaataatttaaaatcattgatgattaaaagctattgtcattgtagcaaatcactcaaattcatagttgatagaaattgaaggaatttctatcttagtcattcatctctcttgcatattaaattatatggagcccagtatgggaatcctaaagtgtgtatttgataaaggtaccttgttcagtggagtcatttttacattcttccctattccatacttttttttttttttttgagatggagtttcactcttgttgcccaggctggagtgcaatggtgtgatctcggctcactgcaacctctgcctcccaggttcaagaaattctcatgcctcagcctcctgaatagctgggattacaggtgtccactaccatgcccagctaatctttgtatttttagtagagacagggtttcactatgttggccaggctggtctcgaactcctgacctcaggtggttcgaagtgggcagatctgcccgcctcggcctctcaaagtgctgggattacaggcataagccatcactctgggccttattacatacttttaaaaacagcaactataatatggaagcaggggttatgtatgcctgtaatcccaaagtgctgggattacaggtgtgagccagtgcacttggccttagtccatacttttaaaaacaactacaataaggaagttatgtatgcatgataaggaggtagaagaagcaggactttggggacagtctcatatgacagctgggacttcaatactattgtgaagagagattgcaaattaggataagcaaaaaaaaaaaaaaaaaaagaggacagtatgaacaagaagtcttctggctaagtcaagtactcaagattggccaagaaaacaaatgaaagattcattaaaggcaatgaagagagttcacagtttgagaaacagaaggccttagagagtttaatcctctttacaaaaaaaaaaaaaaaaaggctttgtggcaggttttctggtatttgagaatctggagttataaacaggatgcttcctgcagcattattcctcttacctggactgcctccaggcattgggaggaacttctcactgacagcttctcaggagctgatgagtagccagtagttaaagccccaggtgagcatcgtcctcccgtttgactttagtctgtggtgccagatttttcccaagcaagtcctgtgctttgacatttgatgcatttctgaagtggactgcctgtaatatctcaaggaaggcttctagttatcttattcttagacctcgaaccttcccctttcaagcatgaaaccaaaaaagcaaagtgtgatgttgggtcactttgctgcttctacccaccaaaagtttgtgtccaacctagttgaaagatttctttcaagcacagatgaaatttcagcaccacattatattctcattcaatgaacacagctcttcttgtcagtattaaattagtagccagtaggctaacttctacatccttataatcgcctcagttttttttttgaaagaggcagaaatatttctgctcaatattttaagactcaattttagcgagaggaatctttaaagagctgtacctgaccttgtctttaggtccttttgtttacctgaaacgtctacactctcttttgcacagtttttcttcaaacctattagactttcttgtggtttagaccagagctcttaatcagaaacacaattggggccgggcgtggtggcgcatgtctgtaatcccagcactttggaaggccgaggtgggcagatcacttgaggtcaggagtccgagaccagcctgaccaacatgatgaaaccatatctcccctaaaaatacaaaaagtagccggacgtggtgtcgcgtgtctgtgatcccagctgcttgggaggctgaggcagaatcgcttgaacccgggaggtggaggttgcggggagctgagttcataccactgcactccagcctgggtgacagagcgagactctgtctcaaaaaaaaagaaagaaagaaagaaagaaagaagcacaatgggagtcacaagcataactgcaaattttccagtagttacactgaagaaagaaaaaagaaaaaaagtggtgaaattaatgttactaatatattttatgtaacccgatgcatctaaatgtattattatttcaacatgtaatcaatatacaattattaatgggttattttacaccgtctctttttacactaaggcttggaatgaagtgtgccttttacacttacatcacatttcaattcagacaagcttcttttcaagagctcaacagctgcacatgaccagtagataatacattggaaagtgaggtctagcgtctctcccttcacagacctcaggaaaatcctcccctgagtattatctccagtatctttaactttccactggattctttttctctgccttgaaacatgcacagcactcccttgaaaactcttcacttgaattgtaaccactttacgtttcatttctcaatttcctatccctgatcagctctttaaataaaacacaaggctttttcattgcatttgctgttgctgactccttgctgcttccccaccttaggtgccttttcctattgtctgctaggtctcttcttgtgtctcctttgctgattcattgcactctgacccctaagagaaggaggtcggggaagccagcggttcccacactttatagagtgcctctcctggagggcttcttacaacttaaattgctttagccaggcatggtggcctgtacctatagtcccagctaatgggggttggggaagagggggttgatgggggaagcccaggagtttgaggctgcggctatgattgtgccactgcactccagcctgggtgacagagcggagacccccatctctaaaaaaataataacataaagaaacaaaaacttgaaacctaaattgctgtgccgtacctccagagtttctgattctagacatccggggtgaaggcgaagaatttgcatttctagtgagttcccaggtgaagccgaggctgttagtctggggaccacactttgagaaccactgtgaggttcagtcctcggcgcctctagccttgctccctgcaggtgcctgctccccagccaggccccctcttgcagttgtgggaagctcgattctgtgcagtgtccaggtggcctgggccttggagttgactggccctcatggtgtcacggctgaccttgtattagtgaatcctggtacatgggaaatgaacttcttctggccagtgattggttctgacaaatgagacctggggttagggggagtccaggaggttttcttactctggaaaagagacacgaggctggcttgttctcttcctgcttctggacactgtggcctgggggcatcacccagaactacgagtcgccctgggccgctgggggagcaggccacagaggccaagccgcacactaacctcagacacagagagggaagacagaagggctccggagccctgaggagttcactgagcaaggaagggagcatcctgaggcctctctcctgcggtatgagtgacagtgggtacacacctcctttgggccatttgtagctaggttttctggtacttactgcaggaaacctccaacacttcaaaagctcccaccttttcctcctccaattgctatgtctggttggcttttttctgaagcctttttgcaatcccacttctttctgtactgaattctctccctcctccccgtctttcttgctctgtcaaagatgagagcaggccagtccctgacattttcaggacttaggacgggaatacaaatgaaaggtcctggccctctgccccacccatttctcttcccacacctggatccacaccataccatgagcaggatacacaagggcaccagcgagtgtgtccaggttttgtccatcactccctcctcccagcaaaacctcactccttggccatccttcatccaaggagggcacacactgatgcctggtcagcagtgggagggcagacctggagaacagctttgcaggccttggaaggggcctcagggccaactgactgggaattctaccatcccaggtacctggagcatggcccacaagtggggcaaggggaagcatgggcttgggggcctgcagactcatcatgctgctgtgaggggcatggacagaggaaagccacagaggggtcttctgacacagggcacaggacagtggcttgggttgctcaggtttcagggaggactggatgcaggatgctaacatgattgaccaggttcttggactctgagtcacatacagtaaaggatcccttcgccgtgtattaacaggtcatgggcaacactttgatctttctttggtacaagacagtagaagatattaccttaggatattgattctcaaaaagatctgggaatttttgcttgagattaaaaaaatatatatgatgcacaatcaggcagttacgtctcagtggtaagaatttttgtttgctaccacttttaatatctgcagtccttcttttttggattcatttgctgaaataaattccctagttattctttcagaaaggacgtcatcgggtaaactttgtccaatcactcatcgtttcttcacattaaatttgagtttgaactggtaacaaactagtattcattttccctgagcacttgggagaattgatccaatgactgctggtgtgtagaatgaattgcgatgaaacatctcatcctacctgctcctcattcccttgtaagtaatctgtgttcacttctccctgcagcctggaacctttatatattcatatatttatttatatgtaaatattctgaacatttaccaagctgtgtacttcagggaaattttcttttaatttggtcagtattttccctcttccattttttgttcttttcttctgaaattcctatttgatagacgtttgaggtttggctctatccatcattcctacatcactcttcccattctttccatccctatgcttgttttcatgatatttttaggaatccttccaggacatttattctttagttgtatgcattttgctttggactgacagcgtgtatctcccaggagttttaaaaagagtggcttggtcttattttattgaatatttgaggacaaaatgattacatttctttggttattatgcttatctgaaaattgtctttgcttttttttctgttgacaaggtctccttggggtgagttagttcttcagtttgttgatttgatgcttcttgtaggtgttggtgttctttcaaagtttggtgattctcagttatctattcatgctcatgttgaaggactggttgaagactgaaaatttcctcaatccaaatgagaagtgctgttttctattcatgtgcatcttgatctcttctgtctgccttctataattgtggggagagcaggatgggggagactgctttgctttgggggtgccagaggggatttttccttaactggaacatagccttcttggcctctcttgttacagtcctcacttcagaatacccacttggaggcttcacctgaagctgggccagttccagctccaaaggctccatttcattgcccccctcaccccccagggttctactctgcttctcataaatataaaccagcagaagagcttttcctttgttgagagcacagttgctgggccttgtgaggctgaaggaaagtgtgcagctgcctggactcaaatgtgcatgaggatgaggtgcccaggctaccctgctcttccaagaccacctcctaattactgacacatttgccccaggtccctttcttgtacagtttgtctctgagcttctctcctgggctgtggtttgtttttatcctttacctttgaagctccattctcttctgtgtactttgggctgttttttttttttttttttttagtgcaattttatacttaattggattacatttgccttctggttctctgcttcatattttcagtgtgattatggattgattctttgtttccattgcaagtaccttgatatatgcccttgtccctcaccaaggctgtaggtgtatcttctatgggatctctagtgtaagccccttcagctcacgtccaacacctaggctatctgctgtgacagccactggccacatgtgaccattgagccctagatttcgaagactttgtacaaagaaaaaggaaggtaaagcccttaagaataatgtaaataccaattaaagtttgaaattttaatattttggatgcattggcttaaacatagcattaaagttcatttcatttctttctttttatttctataatgttgctactggaaaatttaaaatcgtatacgtggcttgggttatatttctattgttctacactgcaggaggcgtcattcctaagataaaattaggaggagtgggttaagatgatgagctggatatgtatacacactccctatttattctcaaatctcagcataaaacacaaaagtgtaagataatttacactctttaaaaaaggggcagtgcagacaggaagaacaccagaggtaaatttctttggcagaatttatgtgatttagggatctatttatcattagtggaaaggcagaaaaaggcccaggaaaaaattcaatgtttccaccttgggaaaatgggccaatagttgtcctgttaatgatgtgaactgggaagctgtagaaggagaaaagagtctgcgtgaatacggcagaggtggtgagaagacaacgagtttggttttgcatttgcagtgtttgagatgttcctggactgtccacatgttcaataaatagatgacagagtgagcaatgctgggaaaagggcataaggctggagatacgagatgggaatcttcgctaggagttgtcgctgcagtggatgaaatccccaggagcaccgctactgaagagtgggctgatgaggaagagccttgaaggaaaagggggtatcagcaagaagaaccttgataaacttctatacacgaaggcctaacatagcaatgatacatggtagccacttagtgtttcaggagttactagaataccaggtgtgctttaaccagcgaagcatgttatcaatcaagggtttttaagaggtggcacaaaaacaggagaaggagaaagtgcaaactgtggacaaagagagtttgccctgggaacaagggagtctcactttggttttgattgggatgaacaaatcttgctcttactcttgcatgcttataaaagattctactaagagacttagccacagtaggaaatgtcaccaaatttacgtgaactccaatttaaaaaagaatacaaagacatttcaaatcctaaccacctggccagagggtgattcctgttgtttttaaggctatagtgatagaatttcaaaggtgaaaagatctctttgtaaacaaagagatctttgtaaacaaatagaggcatggattcactttatttcttttctgtggcctacatttgtaacacaaaacactgaacaacaccacaaagcctagaatcactgtcaaaatgtcaatatgggcacttggactaattcttaagttaaagtgaaggatattctggaggacctgaatgaaagacttgactgagtttctaatgttttgcaaaaaataagtagccagacaaggttgacttaaaaccataatctatggtggtggatccaaaataaatcttaagaacaacataaagacaaaggcttagcagctcaagccatctgtttttggaaattttggcttttgggatttaagaacagatttaaatgtatgaatttgtcactgattggaacaacccattatctagatactggagtaggttgtgatcaaatcataacataatacctaaagaggcatcaatatagtgttgtagaaagaacaatagatttaaagttcctccactcaacaaacatgcttgtgtgtgtgtctactaccctgcaagtactgttctaaataatagagtacaggccaggcacggtgactcacatctgtaatcccagcattttgggaggccgaggtgggctgattacctgaggtcaggagttcgagacaagcctggctaacatggcgaaaccccatctctactaaaaatacaaaaattatccaggcgtgatggcatgcacctgtaatcccagctactcaggaggctgaggcaggagaattgcttgaacccgggaggcggaggttgccgtgagccgagatcctaccactgcactgggcgaccgggtaagactccatgtcaaaaaaaaaaaaaaaaaatagagtacagctattaagaagacaaaatctctgcctgcctgcttggagttaacaatgtagttgtcagatacagacaaatacttaagtaaacaaccatatgaataattttaaataataagtgccctgaaaaaaataaaaatgggacacagaatgatagggtggtagaaaccacattcgctaatgcggttggaggggagcactacagggaacagcagctagaaagggtgaaagctcagaggctggagaagcttgttatgttcaagaaggagaaagggggccagggtggctggagtttcacagggcttggtgggtggggaagtagtaggagatgaggatggagaagtagtgctctatttgccttaagaagtttggatttggttctatttgttggggggaaggctttagcaggttttaaccacggaactgttatgatctaattcaccctaccacaaaatcactccagctgctcagtggagaatgaaccattggaggtaagagtgggaactgaggaatgaattatgaagctattgccatggattaggggatgagaaaatctctggttgcagaagatgagatactaaaaaaaatcggactagaaactgtttgggagccaaaactgatcaaaggggttttggaaagatagcacaaaaaagaaatccaagacaatgcttaagtttttggcttaagcaactgatatatggggatgatatctactgaggcaggaaagacgggacagaagtaggcttgaggtaagtgaggattttgttttggacctgttacattggagatgtttattagatattcaagtggagaggccgagttggcagctggattaacgagtatgaggtgagaggggacgtctgagctagagataacagatttggatgacatcagcatgttgatgttatctgaaaccttgggactaaatgagatcatctaggaatagaggagaaggtcatcaggaaaagagctgcttggggcattcaatgttctgaggtccaagagaggaggaggaggaggagaaagccaggttttctaagagaagtggccagtgaagcagaagggaaaccaggaggtgaggtagtccagaacctggagaagagagtagtttaaaaaggaaggactagtccactggctcaaactgctgagtgactaatcttattttaatatgtctgtgtaaatatggcagtgcctgtctacattggtggagggaatgtgcctaccacattgtagagggcattccataaatactaacttatctttcttcctcaaaacagtcgctgggctccagccaggcactgccaggcactgtggtaggcactgagcgaatcagcaaggaatgagaaatagattatgaactgatgagctcacagtgactttaacctttgcagatatttgtcctggcattgcagagttttatttagaacagtgattctcaagatgtggtactgcgatcaacagactctgcagaacctgggaactcattaaaaatgcaaattctagggcttcaccccagacctactgaatcccagactctggggttgaggcccaggaacctgagttttaacaatccctgcaggtgactgatgccggctgaaatttgagaaccactggtaaggaggagagcaggctgtcctctgcagagctgtcatttaagctccatttaaacattatagtctctaaagagaaagtgtaaaacagatgtaatggtagtattgatcactctctgtttcatttctgaagcccatacttggttattttgtcttaaagagcatttgactctacttttggcttcagactatgtggagctatttttaaaaattcgagtttatgtatttccacaactaagtataactgttaagggcttctgagaaaatcacccaactatgcagattgatccccacacacacatataggataaatgtgtgcctctcagctgcactggacacctaacaccgagaggcaagccatacttcccttcttaggactccttcacattctccttgtggctgttttgaacatttcatttgtccatttgcttatcactaccaataaatcatcttactgcttactcttcacagataaaataagttattggaaaaacttcctgacactaatccagaatatgtaactagctctatcacatctttctgcttttgatcatgtttagatgaaggagacataactgctctaatctgagcataaatttactgggacctcaccctgccccacttctttctcctgtatcttaaatccttcactgacccttagtatctttcctttaatatttaaatatgctaagatactctttcatcttaaaaggcaacgctagatcttaccccaatttcacatcatttttacgcagctattgatctccactttttattttatgcagtaaaatttctagcacttgtctatcttgttccctttctatccctattaatcagtgtgtcattagctcatggcaggcactcaactaagacctgctgaataaaatggctaactatacaccttaaaaaaaacttgaaaacacagaaagttactgaaaaacatattttgtgcaatctctttacccaaacagaccatcacggaagttttaaatagttaacatctttatatttgtattcctggctttcaaaagacagatcacagtttgatgaagttttagagagaacacagtaatatttggaggctgatttcaaaccaatattcaattatttgtgcaaatattatttagaacaagtggaggtaattgaaattcaaagaaaatgcctttcctgaaaactgtgaatcatcatacccaatcaaacttttattggaacagctaataagtaataccatgcaagggaggtttatttttttcttccttgtccctgcccagctatgtggaactaataatcaaaataattagcaacaagaagagaaatataattaagaggacctggtaacaaacaaaactattgatttcttttgaagaaaaatgacacggcattctttctccaactttcttttaaaagacattttgcaggtggcaagagaccagcgagacaacaaaggaaagaagttaactaatgaatgaacagcactggggacataggatgtatattctgaaagagaaatactattttccttaacaatattcaaagaaaattatgattattttgctactatgaaagagtttacaaggaaaaatttgaagattgaagtagttcaactttccaggtcaaactatgcgaacttccatctgccaaattttacagcaattctattaaaaacaatatactagaaatctcactaatgatcatgtagtcaatcaacacaccaataattgtcatctgaaaagaaatacaacttttagtcattccttcttgaagactaagtggcagagaaaaacagtgaggtctcctacggttaccactggtttttgcaaaacgttctgtcacattttactcaattaggcgttgactgagtgtattacaccgctgacccattctagccgtaggaaaagaatattaaagagaaaagggtgcttgttctcgaaacaaaatagatatacacagaaagacagtggtttaagaccttatttgtaaaagagatccagaaaaaagtagaagtacctgtccttgcagaaaaactgtggcccaagttatagcagtttcacgatttcggtctattcttaaaaaaaatcctaccaaagaaattagcacagatgcagctcttcagtattttattttagtagtgactatccacagattatgcaaaatcaaaattaggcccttaataagagtgccagcttccttctgccaactattctatgtctgtcagcttgcagttaaggaggctctagccagcgatgatccttatataattttttaatgtgtttcacgtaaagggcctttcttgaatagaatatgtaaaggaaaagactctaggattaaatacttctgataaagggccttcttaagactatcagtcctgtctgtgtctgtgtgttaagatggaaagcacacgaacagaagtcagcagatttgttgtgttacgatgtgggtgtttaatcagtgcttaatactagtggtaagtttgattaatgtttgtctttgtaggtaaagcaacagaacacagttttccagagcaacatgaagcaaacgtattacaaaaatgaaaatgcaaaatttaagatgagttgactaccattgtactcctgcaatttcccttgtcatcattctcttctttcatataaaaatatgattttattgaattttattttggctaaataatcagagttttagttttaaatctcatagagaataaatgagatgaattctttgcatattttcaaacctcggagttccatgacaatatgacaactagaaacaaaggaaaagaaaataaaacaatttcatcccagtattcttattgaagccattaggatcaattttgtagcactaataataaaaagctctccaaagaaagagagctttggtaatgaacctttgtactttaactcaaatacactgtcaaaagcgattttacaacaaatgtgagtgctacaaattacagcaaatatataatagaaatgtgtgggacatgagagagaaatgttggcctcatcaagaagtacatcttctagaaaatctaaaaaataaagagaaacaaagaagataaacatcttgccccatattagactgcaaaatagtaatacagtttcactcttagtttttaatcaattaattctcaaacaggtactaaatttagaatgaaggatatgttattactaaatcatattagagatatcttgacattaatattaacattaaaaatctggaagcaaaagggtttcttccccctaattgaactgaaatccactttaatatcaactgggattcaagaataaaatataagcccctgccctagttctgaggtccccataggagccctgcatcctgggcctatgaggtctgcttccacccttgtctctgggctaggtatgcatttatttccagaagtgggaaatgctggaatagagatttaaggcctaatcaagcattgagacagctggaaccaccttccagtttcacatctgtccccctctagcaccccacatctattccaggttattgcaaccaaagaacagctccctctgcctgccttctttcggtagctacagcacaacctcaaggtcgcttttctccacccagctttcagtctgtagcattgacctagagaatgaaccagactctggcctctggcaagaactttgcagtaaattgttgaccagtttgtgatggtagtttctattatttcttttcagaggtaggagttcttttcatgctaactgctttccattagtttagaattaagtcctctaaatcagtggcttaacattttttttgactgctaccgatggtaacaaattttacatcctaaccagtatatatacagggaaatacatacataagacatttataaaatgtatgctaacatatatatgacataatatcacatatgtgtgcatgtatacctgaaacatgttttgtaaataagtccaatgtattttgcctattctattcttttgttttttctaaaaaagtattggtatgtgtaattgactggtatgatgcacccccaagtgtttgcagactgcattttatattgttccaagacttaacttttaagactcttttgtccatctatcctttggtaagctaagctgtactaaggataacatagagaaatatcagtgtatccaaaaagaattcctggctgatggttttgaagagtcacagggcaataggtttagaaaatcttgttctctaaatagcaataaaacttaaacctggcaaattcttaagtatctttcattaagcaatccatggagttttattttaataagcataataattttcatgacagccttagtgaatattgagggacaagaaaaactcaaaaccagggttttatgcaactgtaaagtgctggtccagttgagtaagggaggatcctgtgaattaactaagggaagactctttacttgggttctcatcaggagaccatgaatagctttggtcatttaacggtgtccaactaacaagataacaatcctgtaatgtgtaaggtttcagttttcaaggatataactaaagaagtgttttcaattaaaatattacagtttaccttgtttttaaattttttatgagtttataaactatataatacctcttataaaaaatacaacacctcaaggcctatataaaaaaaaattatatcactaggccgggcatggtggctcatgcctgttatcccagcatttctggaggccaaggttggaggatcacttgaagcccggagttcgagaccagcctgggcaacatggcaaaattccgtctctatttaaaaataattttaaaaaattatatctatctatatcagtttatatataactctccctagtcctctggttgattcattctgtcttttctgtcttcagttatttatattcaaacatgtttccttggtgtgtttgaggcagttgagtcacacacacacacactctctctctctctctttctttctttctcatagttttagaattatacagtgtttgggatatagataagtagatctgtgggaacctgattattaagtgactagattcagtccctggcatccgatagtcctaactaatctattttttaagaagcaactattgagcaccactgtccacgtaggaactttgttatgttgagctctcagctttcctgagactcctgtgacaccatcacagcaacatgacacctcagggagggaggtttgggcaaatcacactagctccccctgccctggccagcaacactgagaggcagatgggcggggaggtgcctatccctagcctgaagccaaaagactttcttttctgttccccaatctgtgtttagagacccaaagaataagcccatagggcagaggacttttattctaaaagaggctctattctacattaattaggcttcagactccaaaaggataacaagcgtgagctcaagtaagcaaagcctttttgctgcagggtgttgtgtctaatagctaatttaaaaatatcaacaaatcactgtccaaagaaacttaattctgggactattaaggtattatcatctgcttgtttttattcaagttgagtaatccaatctttattgaatacttacaatgtacaaaataatttcctagattctataaggaacacagaaactaagatggtcctaccttcaggctgctgctatctaattagaaaaaaaccattttcagtaaaagagaatagtcagaatagccatagccaaaaaaaaaaaaaaaaaaagtcaatacatttgcttttaatcaggttgtaagatttatctggagccaatgacaaataataagctactagtcatttccgtcctggaagctgcaattcatctcagtttgtatgagctccgtcacctttgtgctcctgttactcctggtttgggactcaatttcacttcaggaggggagtggtggagtatatggttcctgcttaggctttaggagccagggacttccctatttcacctgtggttcctgtgtgagcatcccctagggaacatgctggaaggattctaactcgactacatttcttctgccagtgttgttggcaggccaactgagagtcttttccaaattgcctgccaatttttttccctcaattttagataattttattctttctgaaacctgacaaactaaatctaggctagaaagttccggggaaggcccagggctcgggatccatgttaaccagctgagggttcacaaggaaaacacaggagaagataatactgtagagtcatgcacagttgaacaatgaggatatgttctgagaacatgtgctgctgttgtccttgtgtgaatgcagagtggacttagatggacctagacggcatagcctaccacactctcaggctatatgctagagcccatcgctcctaggctacagatctgcacagcacgtgactgtcctgaatactgtaggcaattgtaacaccgtgggaagtatttgtgtatctaacctatctaaacatagaaaaggcacagtaaagacactttttattttttttttttttgagaaggagtctcactccctcgccaggctggagtgcagtggcgcaatctcggctcactgcaacctccgcctcctgggttcaagtgagtcccctgcctcagcctcccgagtagctgggatcacaggtgcccaccacgacacctggctaatttttttgtattttagtagagactgggtttcaccatgttggccaggatagtctcaatctcctgatctcgaaaacacattattataatcttatgggaccaccgtcctacaggcaattcatccgtgacctaaatgtagttgtattgcatgtgtgactgtattaagatcttttaattcagggcttttaaatattttcaaaagaacttttaacttcctaagggaagcttcagatttcaatagttcttcacacaaaaagatctcactttctgaggagagaaaaagtccagcttttccatgaatatatcatgggtttgcttcactctcagcatggccactgtttgcttttcttctttactggactaattgccctggtgttcctgctttggttaaaagtgaaacataaagaacttattattaatcaggtaaatgggagtatgacattgaaaacattcaatgtcaaaagacctaacataaaaaggaggttttaggtgattgaaacagggaagaggacagtataagactcacaccgatgagtagtattttacaatttataaataaaaaatataaaagcaatacatagcatggaatattattcagtcttacataggtaggaaatcctgtcatatagtacaacatggataaaccttgaggacataaaaaaaaaataaaaataaaaattaatcagtctcaaaaaggcaaatcctgtatgattctacttatatgaggtaactaaagtagtcaaattcgtagacacagaaagtggaatggtgattgccaggggctgggcaaggggaaataaatggggagttgttatttaatgggtacagagtttcagttttgcaagatgaagatttctggagatctgttgcaccacaatgtgaaggtacttaacactattgaactgtacactcaaagaaagtaaggatggttacttttatgtgttttttaattacaattaaaaataaaaattatatatataaatacatatgcaaaacaaacacttcatacaactcactaacaaaacaaacatccccatcaaaaatgggcaaggaaattgaatggacctttctccaaacaggatatgcaagtggcccatcaatacatgaaaagatgttcaacatcactaatcattagggcaacgcaaatcaaaaccacagtgagataccgcttcacacctgttaggatggttattattgaaagaaacagaaagtgagtgttggcaaagatgtggagaaattggaacccttgaacgcactcactgtggaaaatggcttggtggttgttaaaaaaattaaacacagaattaccgtatgatccagcaatcccactatgggtatatactgcaaaaaatagaaactagggactcaaacagatattggtacacccatgctcatggcagcattatttacagtagccaaaaagtgaagcaacccaagtgccctaagaagaatgaatggatacaaaatgtgatgtacatatagaatagaatattatttagccttaaaaagccaggaaattctgacacatcctacgacatggatgaacctcaaagacattgtgcaaagtgaaataagccagtcacaaaaacacaaatattgtataatttaatttacatgaggtacctagagaaatcaaattcatagagtcagaaagtagaatagtggttaccatggcctgggggagagggaatgggaagtcagtgtttaaggggtgcagagtttccacttgggaagacgaacaggttctggagatggatggtggtgacggttgtacaacaatgtgaaatacttaatgccactaaactgtacacttaaaaagtggttaaggccgagggcagtggctcatgcctgtaatcccagcactttgagaggctgaggtggttggatcacctaaggtcgggagtttgagaccagcctgaccaacatggagaaacccgtctctactaaaaatacaataataataataataataataataataacgataattagccaggtgtggtggtgcatgcctgtaatcccagctctttgggaggctgaggaaggagaatcgcttgaacccgggaggcagaggttgcactgcactccagcctgggcaacaagagcaaaactctgtctcaaaaaaaagtggttaaaagggtgaattttatgttatacatattaccataataacaaatgcattaaggaaaatatagagaatagaaaaaatgaaataaacatcacccataattctcagcaccctagcttaccactgctatgttttcttctggtgttctctgttccctgcatatttttatatagtattaattttcttcatgttactgggcagtctttgtaatttttaaatctatacctatgtcaagagaaaattactctgttcatttctttttgatttggaaaataatttgaggttaaattatttgtacttataactttgtatttatgactttttacattattttcttaggagaatgtcctgtaatgaaatcatggagttaaaggcatgaatctatttttagcatttaatatacaagacaaattgattttcaaaaactctgtattaaattataacgttatcagcaagttataaaggtactattctcatcatgccctcatcaaagattaggtcatatcattttttaaatctgttaatttaatagaaaaaatatatctcatgatttagatttgcatttctcttagattacaggtaaggttaaattgttaacaggtttcaatacgattctttagtagctatacaatctctttaaaaaattgtcttgacagaatttctgctgatttgttaatagctttgattgattcttctcattttatttatttatttttattcatttttaagacagagtctcactctgtcgcccaggctagagtgcagtggtgccatctcggctcactgcaacctctgcctcccaggctcaagcaattctgcctcaggctcccaagtagctgggaccacaggcatgtgccaccactcccagctaatttttgtatttttagtagagacggggttttcccatgttgcccaggctggtatcgaactcctgagctccagtgatctgcctgccttggcctctcaaagtgctgggattacaggtgtgagtcactttgcccggccttattatttttaaactgtactaaaatgctgaaatgtcagttaatgaattatgtttattctgtgttttttttttttttttttttgctgagtacaggggactttattgatgtacacaatgaggtagggctcccctaggtctcaccctcttcagggggtctgcatggaaactgtgaggaggggagagtctcagtgttgtggaggactgagtgcggcagggactccccctctctcttcctcttgtgctctcgctggggctggtgtccagctagctgctgcctttggaggccatgtggaccataaggtctactaccctgttgctgtagccaaattcattctcataccaggaaataagcttgacaaagtggttgttgagggcaatgcccaccccagctttgaaggtggaagagtgggtgatgctgttaaagtcagaggcgacaacctggtgctcagtgtagcccaggatgccctcaagggtcccctctgatgcctgcttcaccaccttcctgatgtcatcatatctggcaggtcaggtccatgaccaacacgttggtggtggagacaaggaaggccatgccagtaagctttctattcagctccaggatgactttgcctacagccttggtagcaccagtagatgcagggatgatgttctggagagccccgtggctgtcatgccagtttcttggaggggccatccacagttttctgggtggcagtaatggcgtggaccatggccatgagtccttccacgattccaaagttgtcatggatgaccttggctggtggggggcaaagcccttggtggcacaggaggcgttgccgatgatcttgaggctgttttcatacttctcatcgttcatgcccatcagcagagggggcagaggtgatgacccttttggtaccccctgcaagtgagcctcagccttctccatggtcatgaagacaccagtggactccacaacgtactcagtgccagcatcatctcatttaattttcgtgggatctcgccttggatgatgagtgatgcagtttccattgatgacaagcttcccattctcagtcttgacagtgctgtggaattagccatgggtggaatcatactgggacatgcagaccatgtcgttgaggtcaatgaacgggtaaccgatggtgacaatatccactttaccagagtgaaaagcagttccggtgaccaggtgcccaacacgaccaagttcgtttactctggccttcaccttcaccatggtgtctcagggacatggctggttctgcataagaatatgtagctgtctgtcaaatgggaggagcagagagcctgattcttacttttatggtttcttctattgttccaaagctcttcccactctagaactttcgaaggcgattcaattttccccctagtttttttatgggttgacgttgcacacttaacttcttccacttggaatttactatgttgtataggacagatcttgatggacagaggcagaggagggggaacagtattagtgaggttttagaggaagaattaaatgaagagtacgtggaaagtgtacgtaggtaaatccacctctctggtgaaatgaccacattgagtaataaagacatacctatctgtccatcaacagataaatgaataaataaaatgtggtatatataaacaatggaacactacaaagccataaaaagaagaaaatgctgtcatttgcacaacatggatgaacttggatgacattatgctaaatgaaataagccacgcacagaaaaaccactatggtcatgcaccacataataatgtttcggtcaaccacagactgcattgcatgtacagtggcagtcccataagactatagagccctatttttaccattttttttctatgtttagatgcacaaatatttaccgtggtgttacacctgcctacagtcttcagcacagtaccatgtgtacaggtttgcagcctagtagcaatgtgctataccatatagtctagttgtggggtaggctgtaccatctagggttgcactctataatgttcactcagtgttttcgcctaatgatgcatttctcagaatgtactcccatgattgacacatgactgtactgtattaactcacgtggatttttgaaaagcgtatctcttagaaagaaaaagtagaaatttggttatctgaggtgaggctagagaggagacgaagagatagggaaagaaaagatgttggtaaaagtgtacaaagtttcagttggactattacactgcaactgttatcctgcatggtaaccacagttaagcataatgtttatttcaatattgctaaaatacatttttaatgttcttaccacaaaaaatgataaattgggagatgacaggtatgttaattagcttgactgaatccttctatgatgtatacatagatcaaaacatcacactgtaccccacaaatacacacaattattatttgtcaattaaaagtaaaaatatagctgggcgcggtggctcacgcctgtaatcccagcactttgggaagccgaggcaggtggatcacttgaggtcaggagttcgagaccagcctggccaacatggtgaaactccatctctactaaaaatacaaaaattagccaggcgtggtggcaggcacctgtaatcccagctacttgggaggttgagacaggagaattgcttttacgtgggaggtggttgttacagtaagccaagatagtgccattgcgctccagcctgagtgacaaagcgagacttcatctcaaaaaataaataaataaataaacaaaaaaagtaaaaagtaaaaaacaaaaaagataatgggagatagagatggtgaggaaggagaagaggagaggctgcaggggtctgatctcaggcatcgcggcctatctggaggcagaacctacggcctcaagtgagtcttggctgggtggaggcggcaggacctgggaggagcagcccagttccaaactggagcatagaggaagacggctctgccacaggagagacaccagactttgcagctgcacttgatgagcaggagcagaaagtgcttacggcattataataatttgtgtccaaaatgaagtgggatattcatctttacccatagtaattttgttcaatgtgatttaaatgtgtttgcaaaaggaagggcatctcctaattcctagctgaataccagagctttgcttagatgtacaggtgtttctgccacatagctttcctactcctttccggaaaggaaaaaaaccaaaacgctcagcaattttcactgcactgttctctctctagggtcccgatagtttgtccatatgcttattactgaccatttttgcaggtcgctttttacaaatttatttattttttgaattgaaaaataaatattgtatatatttgtggtatacaacatgatgttttgaaacatgcatacacgtatcatatattcatatacatatatcaagctaattaacatatctattaccttatagatttgccatttatttgcggtgagaatacttaaaattctactcttgtagcaattttcaagtatacaatgcatctttattaactatagtcaccatcttgttcaatagatctcttggacttatgccctaaggtcactttttaaagacaagatctagttctttttcatatagattctcatttttaaagaatgcatggttagcaaatacattggaaagagtggaacttcaaaatgcgagagaatttaaaaagtaggattgtttgtctccaaagacctgtattttcatacgggcagaatgccggatatttgcccccatcagacgaaagggtattttattgatgagaacactcagttttcctctgcacttgctccactgtcaccttttgtgatttgattcaaagctagcaaggaaaaggacacacttcagcacaactcagcacagggagaagtgactaaagatttgtgtgcccacacgtgaagtaggagtatcttctgatgctgcactcttgaggcttccgtcctcatcccgacccatgaggattcagacctggcggagaccacagctcctgctagggccatacatgtaggaggcagggctgtgaggtgagggagttaaaaggttgcaaaaagatttaaggatcttagagggagggaaggaagagcagagtttctggggaatgttctctgcccaaggcaaagggatggcaggtgatgccccagaaggctctataactaagaacagggcactggggacaatcaagagaaagagtagactaggtgagaaaaactctcactaaatctccaatgcccttcagattctgcatggcttgggacaaaatgcttgagattgaaataaaggactgattgactattttcagggtgtcccaggatggcctgaactggataatagagaatttatggtatactgtaccatctatatgtatatgaaatatagtgatggattctctttcacaggaatttcctcaatcatcctaatctagtgattcttccctcctctgatctcctacaacacatacttttcattgctaatgtcttatgacaactcttctgtagttatcttgactactttttatattatattattggttactatttaactttcttttcctgatgggtaaaagtaaaatgcattttctaataaaaaataatgcacagagagcatatctggtcagaaataataggaagaagaaaaaaagaggctcttggggcagataaaataaaataaaagatcttcatggaatggaaacacttctgaaacttctccagtttgtagtcttttgaaagaaaaaaatcagaaaatcctaaggcaaagcatacaggatcttaaccatttttcactgtgattttcaccttgcttttcaggatgcaggttttgttgtcattaaaatgtttatctctaaaagtcacactgtctccacgtcatgtacatatctcagctacttcggcacacttatacatggacgtgtgccttcttcagatcacctttgactcaatacacacacttgtgctccatgacacggaagtgacaagatacaatgtgaatgattaactttgcaattaatattttctatattattttctataatatagaaaatgcatttgcttttggagcaggacagacagacttgtgatttggtgctggtaattaacttctctgaacatcaatgggggtacctctcagagacgtggtgaggtttccatgggatagcctgtgatcagttcttattatctacatgcctgacacatggtaagcccttaagacattcattccatttatagcccttcttctcctcatcattaagtcttttctctccagctggtttggaagctcagtgatggcaagaagcccattttgtactggttggtatattctacaacattctagcaccgtgagtcgcagacttaggtaattaataattacttacaaatttgaattgagaatgtgatggaatggtggaaaatcaaaacatgaaccatcattgcttagatatcttatgaaatttgttttgaatttttttcttaagtgtcattttctataattactaaaaccttcatatgatgattaaagagtaaagtggtttcactattgcttgtatctgaggaattataataacatatcaggaacaaaggttcccaaaaaacttgcttatagaaaatattagatgcatacttattagagggttcttttgggtggttcttcagagtcaaaggaatatagaaaatatttattttttagatttatttttccttatttgaaatttcaaagcaaaattatatgcacattttttcttattcattaatttagtatttgtaagaatgtaagggttatccatcaggaaaaagaaaaaggtaccttgaattaataatgataattatagtgattgccattacttaattatgccaggtacttatataatctcaaaacagtgctataaggacaaatttatttgtatgttctaacaggaccctaaattcaacattccccaaataaagctcatttgcctgatgtactcactatgtgtcagtatctgcttttaacagaggaagcagctgaacctccaaggatctgtggcttgccagctcacactagttgttgggggtgccaagaatctattttccatgaagtaatgtacaaaatgagccatctcaagtaccaccgctacttgagacatcattaggttaaaaaaatgctttatgttctctatcaaaactgaatgcaagattaaacctgtaaaagaacaaactgaacaaagaatgattaataccataatgtaagattatggcattcctcataccccaccctccttccaagaacaaacaaatctaaattacccccgtttaaaaaagactctcctattatgaaagaagcacttgtaaaacttgccagaatgggaaaataaatcatcagcccattctaacgtctaccgcattgtttaaagagataacagaatcagcaggaccattgcagctaggcaagttcttagacaacacccctataatgactgagttaccactgaaatgctccccgggaacatgaaactgcaacttgtggtagaggtttctttcccaacaaaaaacaggcacagagagcctatctggtcagaaataatgggaagaagaaaaaaagaggctcttggggacagataaaagaaaataaaagatcctcacggaatggaaaagcttctgaaacttctccaatttgcagtcttttgaaagagaaaaaaataatcagaaaatcctaagacaaagcacacaggatcttaatcatttttcttaatctgcctacaccttgatctcggacttcagcctccagaactgtcaggacatcaatttctgttgtttcagctgccagtttgtggtcccttctcatggtgacctaagaaaaccaaaatcccttgtgagggcaggtcccttcagtggtctcccctgactcaggatggcttcagtctctacaatgtctcagaggtcatatcacctcaattaccccaagtctgccctgtgctagatcattcaaatggaaatcccaagtctgcactgactaagtctcagttgcacatttttggctgccttgagactgcttcacttgtctgttctgacagcactctaagctccaggtgtctaaaataattcctcctctgatgagactgatgtactcctctcacattcaccctgtcacccaggctggcgactctaaagccatctttaatgttctttcccaatgcttctcacagccaagcagtcatcccctttccttgccattccttcattttcacttctttggcattttctctgcctcgaccttggttgaggcctatttatgttaggccagtccacaatcaactcctaattgaatcccctgcccctagtcctaccttgttgcatgcatgtctcaccagcccaggttcatctttcccctgttaatccatctcggtgtttgggtctttattttgcccacagagctcagccggttctgaaggccctggcatatttgattcctgaccaatcttcaccattgtcccctgcctgtgtcctccattcagacaggtttattgacccatcccaaccatgccttgtattcactcagtgaggagctatgtcttatttccaccctcattgtttttgttaaagccattgtcccttcttggaaatcacttgcatttatctaatcctaacccattctttaaaggtaatttcacatctcatgactgtgtgaacccttattcaaagataccagccacatgcatctgcctccttgagttcctctaacatatcctgatcccctttctaccttgattagcaagaacctctgagccacatgtgatccccagtgtcatactgtctccctctcttcctgatgtgatttatgttattgctttcagtttcattttaaagtctttttgtaaaacatactttttcaacaagaggactcaaatgctccaggcctggctcatactaagctctgaaaaaatattggctattaagttacaagcaaataaaaagttaagctaattacagctcatggcactcctgtggttgtcaattttgaatctcacttttcattattagctatattttttgggcagatgatataactttctgatcagactttacttcttaaagcctgggccttcgacttactttttttttttttttaacatagaacaaaataaatactctataagtgttctctgttcaatgaagagatatatacttcctaggaagactaacatatgttttaatagatgcattgataaacctgaaggacgggcttactgttcagtagtgctttgttcataaatgtagaaacatctgctttggggttatagggaaacttctttcttttaaatttgtacaggcttgaaaaatagttgtgctctataaataccccagtatgagtcatttgcttaactaaacagctgcttactcattagccaaatgcacttcattttaaggcatacacttaaatgaattttctcccatgcctctctccctcccccaagagccagaaaagtgatgtgcaaatacttttctggaatacaaaagagatacagatctgcctttgacatggggaatctaaactccatgatgtagcggaaagtcatcctagcgcaaattcataagctgtctgtatatgctttgcttgttcttataacaacacagtccttcattttctattcccatctctccccacacacctctggaacatcctccctcttcccattcaaatccaacataccaattctcccactggggcacccggcagggctttgttcttttttttccttctgtcaccatcgcccgtttcttatgcaggtggatagtctgcgtcaagactgctggtagaagccatttattttaataagtgtaagcaaatgacaagtattcttacaaatccttttgttaagatggaaacacagatcaacttctacaattagtggcattcagctatcattttctatccttcaacttattttgaacgataaatacaaagcaaccactcgcatctttttaaaattttattttgatttaacttttttttttttttaaagatggggtcttgccatgttgctcaggctggtctcgaacttctggcctcaagcaatcttctagcctcagtcttccaaatatgtgggattccaagtgtgtactaccatgctcggcttcatgcttttattttctttaaaaatggtcaatatcaccatgagttccttcttttggaagccagtaaatgtctaaatgttttggaagagtccagaggagaactttgatttctagaaagaccaaatgagaaggaacagatacagtctccagagttccaattatagtgtagctattctcagcaggattccaatccaacgtggatttttttctagcctgcggaggacatcttcaaacgcccagggctgacatttagctgttacccatctggtatgattgtaccttgttaaaatcacttttataccagttggtaattacctattgtcctgagctccccggatactggacccttcaatggtgacaccctgcctcccacaaaaatgtcctatgatttagcaactgaaaagttaatgctcgacacaggacgaggctctgactacgcagagccattttgattggacactggtttaataacttgactatcaccctgcaaatagcgctcgtttccaggtatgttaggtattaattattttctggaaaacaatctgactgtgctagctttgagaatgagagcatttacctccctaggtttatttacctccctagggtttattttcctcatctgtcaaatggtagagtgccttggcttagtgttcagactgggttccaaagttgcctcaaggggagattgctaatagatagaaatctggccccacttcctgcagagcagctcctcttccaggcctactcactgaggtccccatttcctcgattgtttggagaaaggattttgaaaactgaattttgctaccaaaaaaaagtttggaaaacaaaaaacccactggcttcaatgggcactaatctttcgtcctatttaaaaattctaaaattcaattataactgtgattaacaaaaagaatggcatctgtctaccaaaagcaaatagctacattgggtctactcggtaccaggcatcgttccaagtgctttgcgtattcgaactcacttcacccacagaactatgcctatattataattatttttagttattaaagtctaaaaagtgtatgttcagagatatttattttcacttttataattttcttagatacatttgaggttataatttattcaaagctaacattcctacaatgactatttaatgaaatgtaatcatgatattgtctttcttatatgctccaattacagatttctatgcatattttaaagagcgttttgtctttaacttttggatttcatcttgaaatcattagactaagagtatgtgctatactttataaattatacattagactatgtatgtactttctctgtggcttataccagtggtgcccaacctttttggcaccagggactggtttcatggaagacaatttttctatggaccagggcgggggatggtttcgggatgattcaagcccattacatttattgtgcactttatttctattattacattgtaatatgtagtggaataattgtacaactcaccataaggtagaatcaatgggagccctgagtttgttttcctgcaactagatggtcccatctgggggtgatgggagacagtgatataagtgttgcttatgtccacttcactctataatctcattttggttgctgtcactgcaatctcaggatattccgccttgactttaacccagaacctatggggatttgaagttctctcaaacatacatttcaggacactagatgcagctatacaattgaagtacctcaactcacttgccactataaagcctaccaccagaggcagcttaattgtcacttgccgctcactgataggattttgatgtgcgtctgtaagcgattgacttattatggtctctgcacagttaaacctctctgctaatgttaatctgtatttgcagccactccccagtgattgcatcactgcctcagctccaccttggatcatcaggcattagattctcataaggagcgggcaacctagatcccttgcatgcacagttcacaatagggttggcgctcccatgataatttaatgctgctgctgatctgacaggaagtggagctcaggcagtgatgcaaatgatggggagcggctgcaaatagagatgaagcttccactcacctgcgatgcagcccggttcctaacaggccacggacccgtactgcaggatgtctgaaagatgcactgtgtactgtaccagtaccagtctgtggcctgggggctggggacccctagcttataatgtttgtttcttcactttcaaccaaacctggaaatcagtttctaatgccagtccgcggctgtggcgctgggtagctgtaaatgtgctcagacatttcctgagctccagctcctgactgccgtggcttaactgggataaacagctgaatgcaaatctgagcatgaattcctcgtcactgtccttttccagaacatgaggttatggcaggcatcacaggcccggctgctccctcctgcctccactgctgcacttccgaggcaatgggttgctcgggacttttgcttctccctcccaggacccggtccctatgctcctggagggaagggagttgctggccatggttacccagttccctggagcagcctagcttgcgtccttgctggtggacggcactgtcttttcttagtgagtccagcagagttgggaaatggaaactatatcatgtgagaaagtaaagctgcatgggatgagaaggagaaggttctgagggttcctgtgttttaataaagtggcaaagcacaggagagagggattccactaattcctgtagcctttacgggcaggaacagagctggtaagtggcaggctcaggaggctgtgtgtcaatgaagagaaggaagacttcctgtccactgaggtgtccacactgaggctgtatccacacagccattgtatgataactcgtcagggatgacaaatgaatccaaacaggatgtgtagcttgaacagatgagctttattcagcattaaccatccatccaagacttcaactagtttgtgttaatgatcccccaaacaaatgttaacttgtcagtcttgatttgaagttaaaaaacaaaggaccaaactaaagagcttctgcacagcaaaagaaaccaccatcagagtgaacaggcaacctacagaatgggagaaaattttttaacctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaacagttagaatggcgatcattaaaaagtcaggaaacaacaggtgctggagaggatgtggagaaataggaacacttttacactgttggtgggactgtaaactagttcaaccattgtggaagtcggtgtggtgattcctcagggatctagaactagaaataccatttgacccagccatcccattactgggtatatacccaaaggattataaatcatgctgctataaagacacatgcacgtgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgcagggacatggatgaagctggaaaccatcattctcagaaaactatcacaaggacaaaaaaaccaaacaccacatgttctcactcataggtgggaatcgaacaatgagaacacatggacacaggaaggggaacatcacactctggggactgttgtggggtgggggaggggggagggatagcattaggagatatacctaatgctaaatgacgagttaatgggtgcaacacaccaacatggcacatgtatacatatgtaacaaacctgcacgttgtgcacatgtaccctaaaacttaaaatataataataataataataataataataataataataaaaagaaattactacttgttgagttttggttgagtattaaaagaagaataaccagaaatatatgtgctattaaatactcctcctttctcacattatatatgtatgtaaagccagatttgccttctacagtttgaccaagacaacatagtacatgcaacagagtgaataaagaggcagatataggaatttagctgccttctattaaaccagttattagttataaaaatgtaaaataaaaccactcacttttttttggcaaaatggttattttttttctaaaatgtatgttatttatgtgaagatttaatggagttattagttttcctttccaacttttattttaggttcaaggggtacatgagcaggtttgttacatgagtaaattgtgtgtcacaggggtttggtgtatagataattttgtcacccaggtaatcagcataaaactttataggtaatttttcaaatttttttaaaatttgttttaatttctaataaagtaaatattaatataaaaaaacaaaaaacaaaagacctcatttcctgtatctctaaagcacaagcccattctgagattttatagttttttactgatgtcttgctcagactttttcagtaaatattgaaatgattagaattaaatagaattcttatatatttgtatttactcatctctctgtatttccggtggggggatagagttcaaggaaaagtttaagagacatggttggttcatttcaggagtccaaaccttatgctaatgaggaagctttgtcaggggaatttcagatattggccagtggcagtggtgggaaccttggggttagcatccttgaaataacaccgcagaggtggtgagtggccagtgtgcctggatgacccagatttgagtggggtctcttctggaggctgactgcccaagcagcctgaagaatcacagagatactttctggttggtattgcccttctcccttctccccagagctatgcctgatttgggctgagacagtggaaaatacacaatgcatgtttcagacattcctgctttaatatgttaatatctcacccactctccagaccaggaatctcatatcttgtcctactcttttccacacaaaaagaaaactgcattacatatagaatttttcagtgtagctgttgcttatcccattgtaactaaccactttgatttatttttttgtgtatatcttgccttgacacgctttctttatcgaagaccacggaaacatggattctttgtgatattttgaaaaatgacaaattgaagagatttttatctctggagactcagcttttacatcataaagtacttctctcccctgatggctaacccaatcacatagttccacaataaacaagatgaatctagattcataagacagtatgtgcagaaaaatgctgttactctttgtggcttctttccctgtgccttgaaaatgttcattaaaaatctcctacttagtttgcctcattatattggtttactcatattggtcccctattttaatgatttaaagcacgtttgaaaagatttcttgtttggaacatccttggccaggccactactttgtaaagtagggaagtctgcaggccctagttgttcttttgaacttagttcataaaatgatttttaaacactgatctatcagcttttctcttctctttatcaaaattaataattcacataaaagccacctatttaaatggagtctcagctgggtacggtggtttacgcctgtaatcccaacactttgggaggctgaggcgggtggaatgcttgagtccaggagttccagaccagcctgagcaacatggtgaaatctgttttctacaaaaattacaaaaattagccaggtgtggtggtgcacaactgtggtctcagctaactgggaggctaaggcgggaggatcacttgagcctgagaggcagaggctgcagtgagccgtgattatgccactgtactccagcctggtgacagagccagaccctgtctctaaataaataaataaataaatggagttccattgttagcaacttacacaacctggaaaaatcaactgatctataaatattggcatggatgagtgtacaaatactttcaaaaagaattacaatttctctgtaataactatcaaggttatttggctaatagggggtccctggaagacctttaagacctgtctgtaaaagaaaaggaacgctggcaattcacaagacacctcagcaatgtagcatctgctcctggggcaggtaacaaaatccagttttaaattttgctcttaacagttaaggagataatcaagtcagcttgggattgggttgtgcacaggaaggctgcaaaaagattacaaaatagcctccccctggcagaaatgtaaaaaagccattccatgatttttttttttcagttctgccaacgatttatcttcagaagacaagcagatgaggagacaaaacctactgatgtgggtacccaagcaggaacccccctcttgcaccggcgactcacgtgggaagaaggtaggaaatcaacagcataggggaaagaaaaggaaaaggagtttggaaacaggataagacaggcttcttttgaataatggagaggactcttagaaaaaagaaaagaaacagaataaatttttattcactgattccatttcagcgcagcaaattctcattgattttaatcaattgctttcttacagagttttgtccatatgtatgtgacaaaatcagcggtcatttaatgacagacttagaatgtgtgctaagaatgaaaccattgagatttccttgtctttcctcctttcagtaaaaatcatgaaggggagaaagggagggggtgagggtggggcaaggagagcaatattttataaaagtgacaacgcgttttgcatttgaattattatttattttccctggtggagtttcaagcaggttattgcaaggaaaggaaaaactggaaattaaccaaacgtggtccagactggggatgacgagtttagcaggggctttaatgggacctcctaagcgattcaggagagaatgaatctctcatagtttcccttctcatgggatcactgaccaagcttccccaaatcagggtgcagcaacaaaatcagggtgcagcatcttttaagtgggcttaagacccacttaaaagcttatcatagcgagatgttgagaagataaagttttagttttttatagagcagaaaatatatatgagatgaggaataaaaggttctgtctaaaagcctgacatgtgtaagactttccctccactgttgttttccttttggtttggtaagaatgtggtgagtgaagtaaaaagataaggagagaagaaccacagagacccccttgaagcgtaaaactctgtttattaagagtgagaatgttcagtggcctgtgaccctccctttcctaggccaccttccccagtgcttggcttttccctgcctggcaccgggtgatccaggcaaggccctggctggggtgccgagggtgggggagacagctctgggtccttctgtgccacttcctccctgtgctggtgtttcagcagcaatctgcccctctgcgatggcagcctgtccacagctctagtgcccataggcttggggaccccgttccttcccttcatctgactcttcaggcctagagtggcgagggcttcccactgtgcttgtctctgggtacctcggcctctctggctgtattttcttaaccctgctccctgctctataaacagacccttctctaaattcacctcaactctcttaatgggattctctttcatgggattctgactgacagagtgcggctaaaaatatctcaaacctgatagaagctgagaggagctgaaatttcgagttgcagaaacctggatgcttgccactatatagaggacagcaaaccatttattatttatacaatttcaggcaaataggctctagaaattccaggtacaaaagatctgaagagatgactaaacactaactaggattagttacattaatcacggacttttaaaatgaccagaaccacctgctgctaaattataaagtccaaaaagacttcaagaattgttcaaaactaaataatgtcaactctctagaatgatttattcaaatttaagtaggccagactcacaatttggagcacagctctttaatacatatagattctaattttctaaaagagaaatagatttgttacttgactattagaaaattcattgcatatttaaaaagcgagagaacttagctgtctgcctgttctgagtctgaggtgtaaatgtttacctcatcatacattaagtatctatagattatgctcaatactttttgcaaaatgtagcataaagtcactactcatgcccttaaaataggcaacaacaatgtaattttagaaaatgttaataagttttcctagcttttgattttttttttttttagctttggccttatcctttttttaggtagtggctggcattatggattaattacttaatacacttttgttgccttagaattcactgagctgaaatggagtgagagctaagatgctctcagaatattcttaaaatgactgtgctgcaaagaagcccgggtgaatagaagaaaatagaaggaatggtggatacaagtgaaggttaaaatgaggtaggaactaaatattatactggcacttggggttagtatttatgaattgttactctctggcaatgctctactcttttgtatcttcttcgggacagaaaattccgtaagaaagacctttccaggaagagcttgtccctaaacttatgggctcagggtttgaacaaagcgtctcttccaagaccttgtgaataatatgcatgtgggccacgtaacttcacaaagtaaagttaaacgaatgcattcttttcttgctattagaccccatttatcgcaccagctgttggtgatttcagcgcacctttccaagcctcttgagagttctgctctaaccacactgccccctagtgttctctcgctttggtgcaacgtgagtaaaaaaaaaaaaaccaccaagatttactttcaatatatacactgtattcatcagtgttttgctatagagaatgtaagatatctttctgtaaattatttagatatttaatcttatttatttatttatcccaataagatattaaagcatgctaagctggaatgattttttttcataaatgggtaaaagcaaaagtaaaagtttagatactattaaataattcctgatctaataaacggagacaaattacctaatatttttgagcacctattatgttagacatgtaagaaatactgtattacaagtgaagtctaagtaagcctaattcaatacttaacttttaaagttagaaacattttaaatatatttattaatttgatctcgaatttggggaaaacagtaaagatggaagagagaaaagggagaatttttaaattttacatatctaagtggctttgtattatgttttaattgaaaaatattttaaacaagtcaattctgataagatgtagaaattctacttgcagctttaggacaaagtgaattaaaaacaaaggctttctacttgaaatgtggccagtgtgactgagaaatggagtttctaaattttcatttcattttaattaatttcactgatttaaattttaaaactgattgatactcaattcagtcactgaaaacttttacgtatgcttgtaacaacttaggtatctgaatctatttttttcaaatgtaaattttaagatatctatttagattaaatattcctaataaaaatatagcattttaattgcataggctataagtgaaaaatgtacagcacatttcaaatgtttagtacaaagccaaaagaatgtaatatttctcattaataattgttatatttagtacatgttgaaatttatatttagatatgtcaaacaaaatatattattaaaattaattatattggtaaaaaaggctaatagtatagaaatcataactatgtattcctctatctgaataaactgagagaatcaagttttcagattattaaagattgaaaaattgaaaatatatctgttttccatggtgcagttcacataccactggtgataaattactttagccaatgcaaatgtataggctttttattgttatgcattatttgagcaatagtgaaaatgaaactgagatatcaaatctatgattttgcagatattgatgtttaggactacactacacattaattacagtgctcatgtttataaatttttagtaactttgactccaccattaaattggattagaaatataagttgcagagttttcttttttttttttttcatattttaaaataagctttatttagatttttttttaatattttatatttgcatccatgccttcgagaaacctttcccacgggaaaggttattttcgtctaatgttacccataactcattcgctatttgacgtagttctcttaaataaatcatcctttagtaactcttagaattatctcctaatttacaaaaactgaaatgaaaaggaactactaaatcattagcaggagtggttgcaatcttattttcttgtaagtaaagggaaaatgataaaaatcaaccagaaaagaaattcatgggcaagaaaagtattttctaaaatctgtctccgtagagaaagatgccagcttgggtcgctccccctcacccctaggctcggttaaacagtttggtcaaaggaggacagaaaagtccttatgagggcctcaagttgcagagttttctaaagcctgagttttactgtttctatccttctggtgtcacttaacatgttcctctgtccagtgtatttcctgtaaggtgtcatttaacatgttcctctgtccagtgtatttcctgtaagttgtagttagaattaagaacagcaccatacaatagaaatatgagccacaaatataatttaaaattttaaaatacacatttaaaaaaagaaaacattaaaattaaaattaattttaataatataattttatttaacccaatatgtcacaaatattatgtatgtagtcatacatacatattaaattttaaaatttaagtcaatattaaagtcaatattaaaaattattgagatagtttacatctttttttcatattaagtttttgctatctggtgtgtattttacgtgtacagaacatctcaatttggcctatccacatttcaaatgctcagtagccacatgggattagtactgaatacagtagacccaggtacatcatcagactgaggttcaatttttggccaaaataccccacaggtggtggtgtgtacctccatacagaagcatatgtctggtggcttttttgtgatgttggcagtcattgattaccattgtctacacccaataattcattaaaggttgcaaaatggcaatactcaaattttaaaattccttcttcatttattagatggagtacttttatcaagagaaacatctcatcaactgcttggttacttggaataatatgtatagggaagttaggaaaaatgtttgatctcttccttttatttgccagtttttaaaataatgattttggtttccttgcattttccaaggatgatcaataatattttattttaacagtattattaggaattcatgaatgttaatatttgatgtgcctcagttcattgcagagttaacttaattgcagagttctgatatcaccaaagccgtttatgatattccaggtccgtcttgtacacttccttccacagacctgtaatcagctatttcttcagggagcctgtgattccttttagtggaaaatggtatgtagagaacattatctgtgtgtgaagggttgagcacgttccatcttttcagagaacaaagctagaaaacatgtattttaataaaataatattcatcatgaattcatgatgtttcctattcaaattcaagtagaggacttttttcacagtgtccttttccctgtcaaatttcaaattttattgacatgaatataattattcatttgctgtattcataatacacatgtgcaacagtctcgaataaatagaagactaccactagcaaaatgattacaaaaatcagcttaagatactttgcagttgtttttgtcattatgataacattccgctaaaacaggcaaattattgtgttttacggtcacttgggaatagtccctttggtgctgttctgccacctactggacagacaggctcaataggcttattttacttttgatattcaggaatcactttattttaaattgaattttgctttgtaataatgcaaagttttacatgactctagagtcaaatttacaaaacaagtctagtttttctccctgtctcctcaatcttatttccttcctctacctttaaatattttatttttaaatgctgtgatttatatgtccattagtatatatttgtatataatttgtatacaaattatacaaaattgatatatatttgtattttttatcccgtctcctttattagataattggtagcatactatacagacttttctccacctgaaagaaacatacatattattattaaaagtttatatgtatataacctggagtgttgggttttgctttgttaggtaatctggaaatatttttataaatgtaaatttaatcagtaaatttatttttaggatccaaatgcttggcatcacttttgtcatatttgttacatgtatttctgtccatacaagcatgcaaacatcgtcacatctatatacccgtgactacctctatctttattgccttacatttctactcttttcctatgtggtcaatatcaaggctgctccatgaactgtttgctaccaagctatgatgacttgtgaatagaaagtaacaaaaacaacaacaacaacaaaacacatttagaaacatttaaagtaatttgatattgccactaaattcaagcatatgattttgtatatttcaagtgtcgcttacaaattattggggggaaaagtggcccttcactacagagtctgagaagcacttgcctacattatttgcttgtgcgcatgtgttctctctctctcattatctttttgttttgtgttttctttctgagacagggtctcgctctgtcatctaggctaaagtgcagtggcgccatcatagctccttgcaacctcaaacttctggactcaagggattgtcctgcctcagcctcctaaacagctgagactacaggcacatgccactgcgcctggctaatttaaaaatgtttttgtagggaatagggttctcactttgttgcccaggctggtcttgaactcctgagctcaagcagtcctcccacctcggcctcccacagggctgggattacaggtgtgaaccactgcacccagcctctttttgtatttagaaatgtttgtgctattttgttctgagccctttttattaacatcttcatattatctataattttattaatatctgtaaataatacctttagtcccatttttacttttctcatcctactatgaataaaattgaaattagctaataaccccttcttcactttctcccctgttccctggcatctattttcaacggatatgtttttattctccattgatatccttgaggcaatcacagagcttattctactttttatattctctttccagtttatgcccctcctcattttttgacagttaattgtatatagagcaaatggccatcacattttgtactctctccctcgtaaactacaggcattatgagttatacaaaaaaatgtctacttaatgctcaccgccagttctattgtcgatgattctctagtcatattggttttccgaggcttggtctccataaattccccaggaaaggctcataggaacattactccctgagttgttgtgtgtttattaagaattgtgaccatggtatttaaagatcaatgttgctggttataaaatctttagctcacatctgctttccttaatatttctgaaatattttataccattgtcttctggcacaaagcattgctgtcaaaaagtctgatgacaatctgattttccttctcttataagggatattgactttttaactagtgccaaaaaaaccttttttctttttatttaaaggtcaatagttttagtagactgtttatatgtagtgcattctgggccagttttaccaggtacgtcctttcaaatgttgggcaagtgtatttttatgtcagaaaagcagtctttgaattataattgataatatttgttctttcattacattgattttcttttttaggaacttctattatatgttcatttgttctcctattcctattttctatgccattttcatatgtatgttttaaatctttttattttaaaaatattcattcttttcttttctatttttcttaaggaactttctgcagtgttcattcactattttatttcttctagtgtagtctaaaattttggaataagttttttcttcaactcttaatatttttctatttctataaactccttttgaagtctttgttttttcaaattagcttctttttgagttcttaaaattctgggttatgctgttctttaaaagctgctatcttttttttcagcttgagttaaaatattaggctaaattttcttctgttttgtttgcaaatctttctggcatgcttttattgtctgcggagacattacattcctcaaatcatttttctttatggtagattcgatggccatttttttctttattaatgtttaagtgagatgagttttcttgtactcttaggagagtgaaccaggatagcttcctagctctagagatttagagctgccttttctgttatttttggatgtgtttacaagtatgtatctgctatctgttggctctttgctcttccctccacttgcatctgcgtcttctttcttttgcctcctttgctcctatcatctatttcctgctcaatttggattctattccagtagtttctcctcaatgtggggttttgctgtggaggagatggctattaagggtccctttagggtccatggggcacaggctcctccagcacaagctggttctcttgggttcacccacaagttggaggcggcaggactctaggggtttcagttgcccttcccagagtggcccaccaagccttacagtgaatacttgtgaactgtttttgtttctctgcctcttggggccatcagaagtccctttgtcctctttttatttcttctgatgtgttgaagacactgtacaggtcttaatctcaccagtagtttattacaacccacacatatttggtttatagggatgtgttttcccgctgctttattggagatgttgtctgggaggtcttgcttttgctatcttagttgctctgtttccatggggtgatttggagaggtggaaaaattatgccaccttgccaccactttcctaattactttaagcaaccaaaattttagcaacgaaacttttaaattactttaagcaaccaaacttttagtctatttctgttgtactttattagtaagcatctacctgcctgtctatgttaacacgttttctgatgcactatacagttgacctttgaagaacacaggtttgaacggcacaggtccatttacatgcagattttcttctgcctctccccggctgctgccaccccgagacagcaagaccagacccatctcttctccctcatcagcctactcaacgtgaggatatggataaagacctttatgatgacccactccacttccagttaatgaaatatatcttctcttgcttatgattttcttaataacactttttttcctctagcttactttatggtaagaatacaatatgtaatacatattacatataacatacaacatatgtattcaatgacgatgttatcagtaaggcttccagtcaatagtagattattagtagtttcgtttctggagagtcaaaaattaaacagaattgtgaccctttggggctggttcccctaatcgccacattattccggggtcaactattgtttaatcagcatggtcatattgacgtccatgcatgttgttaatacttgagccctcaacagagaatatgtgcacagttcagggatctattgatgtctttctacactgccaggtctctatctctctctccccttcccggtctgtgaaaagtctctgcgtgtctctttgttgccactatcttgagtgttctggatgctgatacaaggccagttgaaggtggattgtccatctgaagtgctcctgtgtgattactaggctacaggacagtcacaaacatctctccttcctttcctcccctaagaagctttgagccctgattcttcaccagggtggtagaggataagtcttagagaaccatgacccctcgtgggaacatattaaaatgaggggggaatatactgggaggaaacaatagtttgataaaagcttcccagttggttctaacaggcctcctccgggttgtagttggatcctctgctcttggtagagacagggaaggtgccatggaattggccatgggtccagatcacctggacatcctcaggcacaggactgggaagtgactgactgagatttaagggataggagaaaagagagaaaagaaggcaggagcccaaggatgtaatttctttttggacccatcttctttttcaggtgcttaatatcattgtttttttttttttttttggaagttaacagatttatcttgaaagcatttgttgttattcctgcttaaagtctagctaagaaattctttcaactctaaacagaaaacaaagtatttcattttacaggtagagataaaaggtattgaatgggaaagtttgaaagaggtggcatttggggtgaaagtgtctccatcaaagaaaaactgatgacatcagatctgtggctgttttaatagagggagagaatacaggaaggcagaggggctgggaagggagatgtaagagatagggagcagcaagtggatgctggaaatgaccataaactgctaatttcataagtgtatttatcttcacttgtgcacagaaaaataaaggcgctgtgtgcgtgtattaatgctctatatgaatgccaggactggtgcagcctcaggctctaaggaaggaagatggtcaggtatttggtaagatgatttgaagacagagaagtgtcaaagaactgatggtctgacttgagtcctggtgtatgatgtaagagcttaacagactataatattcaggataatttctgaggaacccacagaagctacagtgtccagggcacgttagtaactgagggtcatataattaaacaaataattgttatagatggttcatttgtaagttagtagacatttctgctataagcaaaaatgttgtcgttttgacttcagagaaatagacaactttatatttctgaggcacttatgttttctctattgtggatgatgtatcttccattactaatgaaggatcataggaattgaggtaattgaaacacatttctcctctctatggtattaatatttttcccagtgattgtttttcttttcctgtttcctggatatgacagagcacatgatataagtacctaatcactcggggaacagctacccccgaggccctctgccttcctcctgctctccggggagtcccttcttcccccttcccttccgaattaacctgttctttaccgggatgttaacatcattcagccgctttccccattcaaggttagtgttccatttttagccctgaaatacacatgaattagattactagactattcactgatcaataatgtgaaaaaaacaaaaaagaaaaactatgagtcagaagaggaaaaatagtgactcatcagacagagggcgtctctattctattaatttcaactgcacagtctataataaccagtgtgtgagagtttcagccttcatccaaataacgtatgtgaaaccacaaaggaattcaagctgcagacaacaaggcacatttaagaggttacaatgttagtgttgagcttggggacatagaatagagcattgatttctgataaattattgtgtgcattgacattttcggcacaggcatttctttctatattatggttccataaaaaagtcagtttgggtccattaattgcctcagagggaagggtgtgtgtgtgtgtgtgtgtgtgtgtgtgtgtgtgcgcgcgtgtgttaggtggaaaggtggaatgtgctggattcgggaggcgtagtgggatgttggccttttactttgaaatttagatgtacatgcctaataacgttagccttttatattttaatttaggatatctgggctccattcttcccttactgcttcccaaccatgacttactgttcttagcgccgttgtcattcaatcaggaattctctcgagcagaccctctagtggcattcagtggatcccagaagagatttagcctgttgggagcataatgcatgttttagtctcctggtcacatacaaatgaaataggagggggtgacaaaatataggaatttaggagcgccctatgacttgaccttcttttgcacattagacagacttctcagatgtttgaatcttcaaattattatgtctaattacttaaactgaaaaggtctaagactgaattcacttttttcctctaaacatctttccttctgaatttctttgttgtgttttggtgatactctattccccagctgcccagttttcctaatttttaaaatatatttacccagttcaattatttattcaacaagtatctattctgttggcatgttgtgtgagtcacgtactgggtactctgggatggagagataggttagtgcccaccctcgggagttcacaatttagcaggtccctttctgcatcctctccctcctgtcaagtgcacctgtgtctttagtttcttccttcccatccctattgcagctgctctgataggagccttctccatcacacctggcccacagcaatcaagtgctccatagtctcagggagcctaaaagctacagcttcaaaatccagtttctcactctctaacctcttccagtagttctcaaccttggttctgcatcaaatgtattggtaatttttttttatctgtctgtttttgacacggatgcctaggaacccttttgtagagggcttggttcatatgtaatctctaaatggtgatttccttgggcttccagacaagagacagttgttcactcctctgtgtgtctagttctttgtacttcacttttactgattacattggtattcctgtgccactcagtccatttcactagaccatgacaacactgaggccaagaaatgctactcagctttctgtaagtattagttccttttaccccatctttaatgcctaatgatggacagtaagttcttgccacatcttcattttatgaagtattcttctcttgccattttgattacagggaaaatagcaactatgggagactagcaaagcccctgcatcctgtttgtcttctagggccagagcagggctaaactgtgtttgaaagaacagaaaatgagttgttccaattttctcttagaaaaagtccaagaagcacttgaaattccagcattctcttctctccatgggaagcaccatttcatttctcatttcttcattaatactctcttttccttgtccccaagaaaactaccactctgttctcaccaacgagtataaagttgtttgtttcttgataagaacagaggtcactctaagagtgctccagctgttgaatttttgcagtcacagttggaggagggttaatcatagttatcgcaagcagcctaacttatcaacccttttgagttatgtgtccctgggaaaattagtgcctctgttccccacccaacccctggctttttttttttttttgagacagggtattgctctgtcgcccaggctggagtgcagtggcacgatcacagctcactgcatccttgacccccagtgttcaagtgatccttctacctcaccctctcaaatagctgagactacagggacctaccaccatacctggctaatttaaaaaatttttctgtagatacaagttctcactctgttccccaggctgatgctgcactcctggcctcaagttatcctcctacctcggcctactaaagtgctgggattacaggtgtgagccactgcacccagacacttcatggaacaatgcagtgttctatgaagtgcaatgtttaactgaataagaaacatacagtaattgtatagaaatagggctgtagtgaggagtgaatgggataacaaggttaaaactatcaatgtagcgcctggcccatgctaagcactcaatacaagaataaccctggtgacacatattatcttcatcatagtcagatatttcgaaaagactcccagggaataattatgggctttggagcccagggcagaggcagggcttcttgctcctggggcagctccaggaggtgctgactggaagggttgaaaggccaaggtctgaagagtggctgaagagtgagtgacccttaagggagcatttgagttccaacccccacgtttcccctcgtgctgttttattactttcttaaaatcatttcattgctggccgggtgcagtggctcacgcctgtaatcctagcacttgggaggcagaggccggcagattacctgaggtcaggagttcaagaccagcctggctaacatggcaaaaccccgtctctactaaaaaatacaaaaattagccgggcgtggtggctggcacctgtaatcccagctactcgggaggctgaggcaggagaatcacttgaacccaggaggcagagtttgcagtgagccgagattgcatcactgcactccagcctgggtgacagaacaaggctccatctcaaacaaacaaacaaacaaacaaaaaaccattttactgctatgaggcatcagaataaaaccctaaagttttctcaaaagggaaaatgtgtgtgtgtgtattggcttgctattcggtcataccatggtgacttatgtcaaggatttataaatacttattgtgcaaacactatggatcctagtcagcattcactcaggaactcaacctgcctgtatttttaggttatcttgagatttctttctattattattttgcatgtaagagtggttcccctttttgcagcttctttttctgtcaatggcaagctaaaaacccacatttggaaaatatgactattcatttgcttaattatcacataaactattttttaaaattggaatcagtcactaacaaatcctgctgggctgtttcctctgtctggactcctcacccactgggatttttccactgaactttatgacatacagtagcccccaccttatccatgggggatacattccaagatcctcagtggatgcctgatgccccaaacagaaccaaaccctatatgtaaataaataaatatatatatatacacacacacacacacacacacactcacacacacatatacaccaagtaacaacaacaaagttattatgtccagctcttccgtaaaataaacatcaacttgtcatctctttgtaaaactgcacatctagttatattttttcaggtatagttaaacaaaaaatacctattttcgcaaggtatttgtaggccatatagttattatctttgaatccaagcaggaaggcttagcaaaggctctgtacagaaagctgtcgtgtcttgtatcaggctacaattttttttaagttaaatttcccaaagacaggcacagcagttggatataaatggcttctgaagaaatcacatctgtctaaaaatgaaaatcatttttcatgcctagcaattttgaactttccaattgctctgtgaaagtgttttattctcatacaatgaaaggcagaaaaaccaaaaccagtgacggggaaaaaaataacaattcctatacaactaccatatgcttttgatttaggtagttcagtgctcaatatgttgcttttttgtattcgtttttacttttctgacttttaaaccaatgcacaaaatgggaactggattattcaaaggtagaagaagaagaagaaatgctgctgctgatgaagccttgctacaggacgtgggaagggagtgacagccaccgagtctctctctttgtttttgaaacggagtctcgctccgtcgcccaggctggagtgcggtggcgcgatctcggctcactgcaagctctgcctcccgggttcacgccgttctcctgcctcagcctttggagtagctggaactgcaaggcgcccgccaccatgcccggctaattttttatatttttagtagaacggggtttcaccatgttagccaggatggtttcgatctcctgacctcgtgatccacctgcctcggcctcccgaagtgctgggattacaggtgtgagccactgcacctggccgccaccgagtctctttagactccacttgcgctccatgctcctcttgacttctgacccaatctgcaaatgagcggatgcggatcatcaggtcgctgctttcccgtctggcatcactaatcttgtatgaatagcattaactacagaaagcattcattgagatccatgtttcctactgtattgcagccgatactgggacaaccaccacagcagcagcaaacattgccttgctgttacacatttgtttattcaatcatttcctcattcactcaaccagcaatattgctgaatgtgcctggtactctcctagatactggagatagagaggagcaagaaggtggggtgctttccctcaatgaacttaaagtctcctggaggacacagatctgtcataacatgcccatggcaggatagggttctcttcctcctttgttgctgtatttccttcctctcctcactctattggaagtagaaaatatttgcataataacaaacggaagttatgccatgaatgggattcatgttcccatggtagggatgggtttgtttagtagtgatttcaagctgaagaatgacagcatccaccaccctcccaggaatgggaacctttaggtgaatgagtctcctcaccggaccaagggaacagtagcaggatggagctggatcatgtatggacagggaggtagaggagaagagaagagctccaaaggttagaaggattcttagactcccatatctggctgaatttctaaagactaaagatgtaaagagggcaagtcatgatctgcactacttacaagatcatgcaaattctattctagaacttgagcatatctgtgatccacaaggagcacaattgtcttgttttcttgtaacagactctaccacaggacatgatacagggttacacaccatttctctaaatattccattgagataaaagtttgtaatcagatgattcttaatctgatgttactttgattgctacacagtttagtgtagtgtttgctgagaaggcaacacaataaaataaaagtaaaatcagattaagaatcatcaggattgctgggtgcggtggctcagtgctgtaatcccagcactttgggaagccaaggcaggaggattgctagagcgtatgagttcaagaccagtctgaacaacatgggaagactctgtctctacaaaaaaatattaaaaaactagccgggtgtggtggcacaagcctgtggtcccagctacttgggaggctgaggttgggggaatgcttgagcctaagaggtcaaggctgcagtgagccatgatcgcgtcactgcgctccagcctgagtgacagtgagactctgtctaaaaatcaataaacaaaatttaaaaagataaagaatcatgagaatgaagcatttgaggcaacaaaaagcataggaatcatacaactgtgtggaatgtatatattttttgctttcaactttatttatcaaattttcaatgctattggtcctttcagggttgctcgttagctcctctattctcataagaatggaggtggggatgctactacttcaagatccgcatctttttcctgtcccttattctcattaatgaattatcttattcatcaaatgtctactgagcacctatttatcataggcccttggctagtcatcggaaacacaaggatgaaaaaaaaaaaatccctccggccaggcacagtggctcacacctgtaatcccagcactttgggaggccgaggcgagtagatcacctgaggtcagaagtttgagaccagcccgactaacatggtgaaatcccgtctctactaaaaatacaaaaattagccggtcgtggtaatgtgcccctgtaatccctgctactcgggaggctgaggcaggagaaccacttgaacccaggagatggaggttgtagtgagccgagatggcgtcattgcactctagcctgggagacagagcaagattccgcctcaaaaaaaaaaaaaaaaaaaaaaaatccttacctgccatcagacgctctctgtctagttgtaaagaggtcgtgagcatggtgaccccgcttttataagtgccaccggaagggagagggcgtgggagagaaaaggctcaaggggggtgcagccaggcttttctgaagtgagagaagccttcccagaagacttgatgtaggtaaaaggctgtttagaaactttctagattgtcaaggggatgtgcatatttcagacagagcaatagtacctacaggggcagcaataaatgaaataaccaatagtttgggatggacagagtatagaatgtggcggtggagagggtgctgataacagtcctctgggctgggcatggtggctcatgtctgtaatcccagcactttgggaggctgaggcaggaggattgcttgagctcagtagttcaagaccagcctgggcaacatagtgaaaccttgtctctaccaaaaaataaaaataaaaaaattagctggatgtggtggtgcacacctgtagtcccagctacttgggaggctgaggtgagaagttcctttgagcctaggaggtcaagcctgcagtgagccaggatcacaccactgaactccagcctgggtgagttcagtggtgtgaacatgaccctgtctcaaacgacaacaacaacaacaacacaaaaccaaattaaaaaaaaatcttctaacttctcagagaaaataacagccatgagcataagcacccaaagtcatgatgcatccccaaatgtgatgagacctgtatccacatttatttctaattgtggcatctcaactccccacacccaacagaacagttgactctacaatgtccttgggcatccatctctccctttcatccctctaacactgcttgaattcaagcccaatccttttccacctggtgattaccaaaacctcctaactgcttccagtctcagtgccatgcccacctctcctggcctcttcagtgtcctcccccagccaagggagtgaatgttctgaaattctcagaatattctagttagtgaatgttctaatacatctgcttgttatacgcctgtctacgcatagcacagactttagtggatccccatggcccgaggcaaagttcaggctcctcagagcagcactgatggttcagactgacacctttgcccacctgccatccccccctctgccacttccacacaaagattcccccagccactgcaaaaacatctgccactgtataactgcaccacagcctcacaacacggaatggcactgtggacagtttcagcagccaggcctgggcatgagacatactccttttcaggttccactggctatccccaagctacagagggggcctgggaaatgcagtctggctgtggcacaagaggaagagaaagctggtattgctgagcagcaggctgtctgctgtgggtcctttaaactggtctatgtatttgacatttgtctttttctttttattctataaattttctttgactatcttgttaacagattgctcctgttctttttttttttttttgagacagggtcttactctgttacccaggctggactgcagtggcgcaatcttggctcatggtgtcaaaggatcctcctgcctcagccacctgagtagctgggaccacaggcatgcgccaccatggccagctaattaaaaagaatttattttatagagacagggggtctcattatgttgctcaggctggtcttgaactcctgagctcaagcgatcctcctgcctcgtcctcccaaagtcctgggattgcaggtgtgagccaccggtcccggccctatttatattcttctattgtgattgcaatatcctttcaatgttctgtgaaaactaattgagtaatattaagttgtagtttctgaaagttttcttatttaaaaaaattctttctgtttccattggggtcatttattctgaatgttcgttttagccctagtgtgtcttgtgctgttggggtacctcaaatcatgattgcaaatgcttgcttattgtttgccgggtactattataagcatttacatacgcaatcatttaatatttaaaaagcctctctaaggtaaggactattactaacctcaatatagagataaggaaactgaggcacagggtttccctcacacaggtaaggaaactgatctgtgcccaggtccacacagttagtaagtgaaggagctggacccaaatccagacagtctgaccctacagtcttcctttcaaatgggtagtgcactttggatatctgtttgtggttaaaagtttcaagcactaaattagtcaatgtaggcagttgtcagaggctttctctgcttttgtgtaaagaggacaaatcacaataataatttctatatgctccattctcctcaactctctgacatttctttttcttttcagtgcaggtttctcatacttccggagaaatagaaagcaccagatgacagccaccacacacttttgtccccattgcaataggatgcttctaacaatcgtaaaattatgaaacactgaattccttaaaagttgtccatttgtggatttatctgatggtaactattaaatatttaaaagtaactttaatgaatctacttatgatgattgagtaatctattctctgaattccaccaaaaaaccattttatgaccacagtcataacgaacatatttctatagtcctaagctggcaagataaatagagaacagttcataatataaacaatatatttatttattcctaaactaataagatgactatcaatctgtaagagactatgaaaatcaataccgtatacttggtatagttggtgagaatttcaggagcatgtttgttcttttatttgtgttttggaagatacttagcccacttttttttttttttttttgagatggagtctcactcttgtcgcccaggctggagtggagtggcatgatctcgactcactgcaacctccacctcccaggttcaagtgatactcctgcctcagcctcccgagtagctgggactacaggtgcgcaccaccacacccagctaatttctgtatttttagtagagacggggtttcaccatgttggccagatggtctcgatctcttgaccttgtgatctgcccgcctcggcctacttagccaacttttaaggacaagtccagccatccttatccttcacagcaaataacaaacatagtgatttgtgggggtgaagagatgttggtcaaggggtatgaaagtacagtcagataaaaggaatgtgtcctagatttgatagaatactagggaaattacagttaacaaaaatttattgtacacttcaaagtagctagaagcaaagaactgtaatgtccccaacacaaagaaaagataaatgtttggggtgataatatctcaattactctgatttgatcattacacattgtatgcaggtatcaaaatatcacatatccccccaaaatatgtacaactgttgtatattaataaaaataaatacaaacaaaaagacccaaatagttattaattatagtgtaaatattagactagagccattctggacaagcacctgttcaacaccatatcctcattttctggcacccagtagacactgcggaagtatttttgattggtcctgcagaggttctaccccaacctcaccaggtgcaggtggatgccaggtgccagcctgggagaggctctaagttctaaagagtgtgtcggtggatggtgtgctttcatcttttagttcatatggccctgccttttattaacagcacagaacactgggcccagactcttgcgagaacatgcctttgaactgtttgctgctcaccttttagtgaaagctcttgacagaaatattaaagagaaagtgtttaaaggatgtgtggtcaatgcattcctgacggtgactcttctgtggattgaaagctctgaagtcccacgctggaaaaacacttagagagacttacagagataatggtgtgtataacttcagaggcctgtgctctctcttgaagtgcatattgacgccctagagggttctgtccatgatgaaaaataggcttcagtttttgccatctctaatcaattggtagtgaagaccaagagcactgttttgaaatggatctgagcctagttttgtccaagcagaaaagagttctatgatggatccacacaccctaagttggggtgaggaagctgctgggccacgggctatgattttggtatccttactctggaaattaaggtagtctactagcaagctgtgtgtgttgaccacacactttctaatgtatccagaacattgcttccattgagttggacttggtcattatatcctgtttgcttttagggaaaatttaaaaaagtttcccatgacacctgccttcactttttttgtcagaatgtcattgaaaaacactggctacgacatatcagaaaaaatgtccttgtcagacctaagtgtcaggaaaatctttgcttcactgaagaattttattctttcaggacaaaatatgagtgacataatatacagtattcctctttgcttcggcttttaggaatatcagcttaatgtcaacaattgcatagcacactataacaaaaatcatacaatgatactaatttttatttatatctctatccatcaatctatcccactgttgagctaacaattcttacaagccactccaaattctttgtggaacaaatcaagatatataaaggtaaacaaataatattgtatagatgttgatattttaattctcccatgaaaaacaaaagttctccttcctttggcttcagaaaattcattaattttccaactttaagactgaagagtaatgaacacatgctatcagcagatttaagtatctaactacagttcaagccttccctttcatattcctttccagtatgactgaataacttcttttccctagagacagatatttagccttcaattttatataggagaaagaacacaaaattttaaaatataaaagcaatataaatctacagtggtcttcagagttgttcatttttaatataaataaattactagttcaaataacttctccaaaacaagtttcccagaccaccaaggcagccgctggtgagcggcctcacctgttatcatcagtcttttctcatcacacttccctatttaagtgtggaattgttcccagttcaaagatatatgggagagaagtggctggatgggtaggatacacagaaaaccttgtgtacattctttgggagaagcttctagagaagaatctgagccacaacagattacccttggggaagtttgtggctatcatcatgaaggaaggcttaaccattacacaaatctttggaatacttttcttctgaatttcttaggcccaggaggctctattgctcaagttcattttgaagcacactggtttcaagacctgcgtaagtgttccttgaattaaaaaaaatctttctcaagctctaggtatgctgacaagtttggtagaccagaagtgtgatacttctacctgcgaggctccagcggagtcagcactgcaagggagaaggcagggctcctgagctcagttcagggtcagtgccttacttcctgtgtgatctctgcaaagtgatttagtcaacctctcagtctcagttttctcatacataaagtagggataaaagtcatatccagcttgcagattgactgtgcagattaaatgcatgtcatgtaaagcacgtggagtatactaaaggctcaataaatactagttccctcccttcacctttcagcccctcatctccccagcaatattttcagatgaataagaggtgagaattttcagtcttatttacaccaaagatcacgtttgggtagtcaaaataaaagtgaccatataatctaaggaaataagtgagttatgtgttcttagaacaggacagaataattaaaagcaggcctgtgcagaaaacctggaaatatgttgcacatcatctctgcatccttccctcactcctccttctctctccctcagggtagtagagcaaagaaagtagaactcagggcagggcttgtgtctgttttgttcactcgtgtacaccaagggtgtaaaatcctcatacagatttgatgctcaataaatatttgataaactgaatactcagaaagaaagcagaaatggtttgggacttcatatcctgttttccctggagttcagcataaataaaataattatttctaacaaaaaagttaaagaaagtctttaatcttctaccacagaaaaaggtattggatttttactcattttcctcaagcacatacccaaaaaatgctcccaaacaaataaacatcagtaaacaatttctggaaacccaatgtagcaataggttacaaataaagcaaagagtgcccctgctgaaactgctgtttatcttgcaagggccctccagggtggagctctcgccctctcctggctcagccttaaacttcactataagtaagcagaatacagcggagacaagaggaagtagttcatttgcataatacaaacaaagactctcaggtgaatggtttgccagttatcaatgtttgctttgccgattagtgaaacaatctaccagtaagtctacctaaagcctaatgtgctatactttttttttttttccagaaagttggtcaatggagaaggcatcaattggcaacattcggttggaccagttaatgattcagtttgcttttcaaaagatactagcagacagcattaatcttatcactctctttaagtataatctggacgcagaaaatcactcacatgccttaagttaggttggtaaccaaaatatccattgtttctctggatactaacaacgattatattaatagaaatagcagggactgtgaagattggctatgacaagtgatgctgtggtttactctgacttaggtttgcttccatggaggtctgattgtgagatggagatctgtggggagttccactgggatgtgctctgggcaaaaccactatgacagcagtgaaggaagaaggatcgggtgggaggggcacgctggagtcccgagctgggatgcccttcagaactggcccaaactgaagcagtggggatgagtctttgtatcccccgcagtggccagacattggatgtgggctgcccagggaggaagcatgacctcgtgtgaggcagctccctttggccaaaggcaattttccagaagggatacagctgagagctgtcaggtgccaccaattccagcagctggcagaacgagtaccttggctctgaaggagtatctgggtcgccaactacagcatccgctaaaaccggcaagtttaaataacaaaatatttaggaatgagtacttcccatgtaacctgcatataaaggacatttaacaaatatttgtcgaatgaataaatgagtggttattaggatggaagaatgatcagtagtggatgtaaactccatcagaagggatttaaataaggctgaagacaaatacagaattataataataaaccactcagagcagaagaactttcagcctagatatctgtattatgacttcgtcattagatttaattattcgaattctgaatttaagctttacagcaaaagtagaggggaaagatggaaaaggtactccgatttggggggtcaaggttcaataagtgagggttccccactcacttggaaagggctatcattctatacataagaatttgacagaaaaactcaaggctttaaaaaggaaataattagtctgtgtgaagcagctgaaagaagtgaaaaacatcattgactgaattttttcaaaattaatgactcttcctgcttggagctctttcaactacagtaatcaacatctaaaattcttgcgaaggtcatttctgagcacagtctattctgctccatctaatgatccaattcctcttcctctgagtgtctgggcatgctcatcttgcagccagccgtctaatcacaaagacattttcccgacattatgcattagaagatgccccttactttataaagttatataaattagaatctattttatccaggggcttatatggttaatttcaaagatgctttatcttcttttctcagtggtcttcataccaaaatagattctgacacttaacctataaacacttccgtcgcttaagatttatctgattaaaagcttataaatacacattttcatatacttacaagatataattttttatgcaaaagagtcttcttaaaatgaaaagtccttttcgttttcattatgcaaatgtgtattttccagacttgcctttataactcttcaatgtctttggggaagaatattctgtccatataaggcaaatataacttattggcacttcacagatttgtttctgtagcttaagatagtcaggttgtttgggggaatttttttgttctaatgatttaaatattttattctaattattagaatatatcatttaactagattattaagtagatacttcttctgtgttgcaggatcaatctttaaccagggtacctggctatgcctgtccaaggaatctaggaaacgagacacataggcgcgcgcgtgtgcgcgcacacacacacacatacacacgcacacacccccttccctcccaaaacctgaaatttcaccaagagcaaattctatgacctataaagggcatataattttatatatttcagggagacatagtacatccatcaatacatgtaagatttacattggtttgatctggaagggtgggacaactcacgttttatgtagatttaaacatattctgattggcaactggttgagtttttatctatacaaaggaatgtctgggttatggtaggggttgtggagacctaggttttatcgtgcagatgaagcctccaagtagcaggcttcagagagaatagactgtaaatgtttctcaccagacttaaggtctgtgttgatgttaatgctggaggggtattgtgaggcatgtccaacccccgacttcctgtcatggcctgaaccagtctttcaggttaaattttagagcgcctggctgaggaggaagtacattcagatggttgtgaggggcctttgaattttatttttggtttatcgtcccaaggtttagctacatgaataataattctatgcttttaaaatgttaattcattcattctacagacttcttgagtaaccgttatgtgccaggtcctgggctggggaggaggacctcatataaattaggacttgatgtagtttggatatatgtccccactaaatctcatgttgaaacataatccttggtgttggaggtggagcctgtgaaactgccttagcaaaaattataactgaggaaattatgacagtgaaagagacctgacctaaccaactccatcttgcttctaacctctcagctgtccttgtttattcctgggtgtaggccaaactaagcttgggaaggaatttagttcatagtttaactttgaaacaaagatgataataaatccccttcttaacgggggaccagtcggcctttgtaggactaagaaactagttacaagattagaaattacagttaggagccatacggcctctggttgcaagagtctgaacctccccagattgctcctgggaataacattactgttgtaaaccctaagatcagtgcttgagttattttgcacaacctgtgttctgttctgatggaccagctgacaccacccagactggtaaactggttcaaccagctcggcaatcccacccatgaatagtagaccgcaagaaaaactcacttcggcgccttacgatttcatctccaacccaagcaatcagcactccccacttcctgagcccctacttgccaaattatccttaaaaactccgatccccaagttttgggggagactgatttgagtaataataaaactctagtctcctgtacaggcggctctgcgtgaattactctttctttattgcaattcccctgtcttgataaatcggctctgtctaggcagcaggcaaggagaatccatggagcagttacacctggtgggaggtacttgggtcatcagggcaagtccttcatagcctggggctgtgctcaacacagtgagtgatttcttgtgagatctggttgcttaaaagtgtgtggtacctcccactgtctctctttctctcttgctcctgcttttgccatgtgacatgcctactcttgcttcaccttctgccatgagtaaaggctccctgaggtctccccagaagccaagcagatgctggtgccatgcttgtacagcctccagaacctcaagagaattaaactcctcttctttgtaaaattgcctggtctcaggtatttcttttcttttctttttctttctttttttctttttttagaccgagacttgctctgtcgcccaggctggagtgcaatggcgcgatcttggctcactacaacctccgcctcctggattcaagcaattctcctgtcttcagcctcccaagtagctgggattgcaggtatgggccaccatgccaggctaatttttgtatttttagtagagatagggattccccgtgttggtcaggctggtctcaaactcctgacctaaggtgatctgcctgtctcagcctcccaaagtgctgggattacaggcgtgagccactgtgcccagcctctcaggtatttctttatagcaacacaagaacagactaacacagaactcaaatgaatgagttctgtcctcaactgcagtaactgtaaggaggtattatcacattttctgtcccctagtgagaaagactaatcctttaaaactacagtaagttcacattgtatgagactcaagctgagctttcatgaaggctctcaaacagagttggtgtttttatagtattgttcacatgttcttaattttgttttttcctcaacttttaaatgttcagaaaacttttttaaacatagactttagataagaaaatttaagatgattgtgaactgcatgatattttattatcgtcaatccacagaatgcttctattttgtttcatttactttggttttactttgttctctattatcttctgtctctaatctcacagccccctccaaccatagtcagcttttattatatatatatgaaatatataatatttataatatatatgttcatccattctaccttttacacacacacacacaccacacacacacagagaagatgtgaaaaatttttgcattcactgtgcttaatttacatagatgatactgtggcataagtatcttctaacttttcttattcaaccctgtttttaaagatctactcacgatgctacatataagtctaagtgattgctttttacattccatcatatgccatgctattcatacattggtaagtctactaacagtaatagctctgccatgaacatgaacacaccttattcttgagcacctgagtgatttgtggagggtatatttagcagtagaattggtggattgttgggtgtatccacactaaatgtcagcaaactcagtgagattattttcccaaatagctctgttagattatattctcaccatcaaggtatcagggattccatttctatatatcttcaccagcatttgatgttatgcaactttttagtttttgtcaatctgatgattatagactgacactttatcaatgatttaattagtattttccttagcagtagaattggtggattgttgggtgtatccacactaaatgtcagcaaactcagtgagattattttcccaaatagctctgttagattatattctcaccagcaaggtatcagggattccatttctatatatcttcgccagcatttgatgttatgcaactttttagtttttgtcaatctgatgattatagactgacactttatcaatgatttaattagtattttcctaattttgaaagagtttgggcatcttttaatatttactacccatttaggtttctcttgctgtgaattgcctattcagagacattgcttattttttttctttaggttttctttctttttctcctttcttttctttttaaaaatgtaccatatggacagtctttttaaaaggcttttaacactaggaaaactttgggctttcctaaaagctatacaactgtcatgggtaaactttattgcattgactttgactttcaagaaacctacagccatatttgccatgtaatcacagctgtgttttccctttcagcaagtgtattcgcattcttgtactttcttggaacctaatttttgcattcaatgttattattaactttatttttatgtctcttgtcataacctgactcaaaagatgttttgaaggagtcaggcacaagtgaatcaataagcttattttttttcaaaatgttccagtttaatttaaattggtcttcttgctagaacaaaatgtgttcccactcaccttaaagtgacaataggcttctgaattccatggctgtaggtgtcatctagttcaacaacacgcttttcaaataggagatggaagaccactgaagtcacctgaagctgtttaggagacacaggctggagcaaaactggaatggcctagcattgaatctggtttctcttttctttttatttattaatgtaataaaaaaaattttggtttctattctgcttagtagaaaaggtttatatatggatcacatgtctgtgtgtgtatctctgtgtgaaagtgtctgttttttgtaaagtttatgtatttttcttcccctctctcattggcatttatctcgatgtaattgacttgaggtttctggtcttggtaaatttcctattatttcaaaagctttgaaaaattattaaatctaatttagaagtgtaaaattccaactcaaactttggaagtcaaattaaaactcctctctttggtaatctctgagatagtatatacaaatatcatccctcttattaattgttcagctcttttcttaaatcatacatgaatgacttgtcaaagacaaagtattagcatcagaaagattctcagtatcaggacttggaggtcatgttgcacttcagtctggagcttctgagaatggaaccctgatctcccatcctcgtaggatccccactttcccggtgaggcctaaacaggaagggagcaccacagctgggaagaaccccatgttcctgatctggatcaagggagtgctacccccacaatggtgatactaatgctttttcacggaaactggcttccgagttcaacaagacaggcaaaggggacgtggcaaattcccctcttaacacttatgctcggagtgacatgtctgttcgtgctcacaagctggcattaaagcaactcacgtggccacatctgtctagaaggggtcaggggagtgcaattcttttatgtacccagaaaggggggagaaatattgggtaaagactactaatgactaccaccttctgcaaccctcactttttctgactatgatgataatgacaccctttgcctttacatagtatagctgtgcctaatcaaagggcacactggccagacttagaggtgggagtgacttctaaggagcatggactttacctgggaaggtgatgggcttgctggggagctgtggtgttcgagagccagatggttgactcatgaaacagtaatccaggagtgaaacagaaaccaagttcttaggcaggcagtgctaccaagtcatcaatatgaagggaccaggcagagagcaggagactcggacactggggaaatcagacaaaacaagaacccacctacctgccctctgtcctcctgcctcccataagtacttcttgtgcacttataaagtggcaagcactattttaggttctagggatttagcagcggaaagacaagtagaggaaataaaaaagagtgtgtgaggccttgagtgtgcataggtggagtgaccctgtccaaggtcatgtgtgtgcactctacactgagtatttcatacccacggctcatttgaaacatacaagaactcaaagaggtgagtactgctattacaggttgagtatcccaaatccaaaaatctgaaatccaaaatactccaatgagcattttttttttgagtgtcacatcagtactcaaaaattttcagattttggattttcagatttgggatgctgatctggtaagtggaatgcaaatattccaaaacccaaaaaaatctgaaatctgaagcacttatagacccaagcatctcagataagggacactcaacctgtataaccatttttccaatgaggcaacagttcttcagggtggtaaagtgattggcccacggtcatgcaattgatccaagtcctggttttctgactctaaaggcccttttcattttatttttggacaataacattgtcatttttaacagaacaaacatattgtaagtttccagagtttagatctctgccttctaaggttactgttttccatctgagttctattttctgctgataattactaagttttgaaaataattcaagccatatatatacaatttataaatatcatatatacacatatataaaattgttttacatgactgctaagggattcttcaaactgacatttttaaaagccaagtgaatatattgaaggtatttttaaaaaacagttactttgatttgaaacaatctcttgttatgataaaagtagtctcatctctaaaatagccaaatatagacagccataagataattaaatcagaatctgttttctcttcccaggaagtgaatctaagtgtcaagacagtccccactcttttcaggcttatagtattaacagcatcacatcacaaaatgttgtcaggttcttgcggcagcaataatgctttcatttataaaaggtgaccacggttcttaagttggttcctcttgacctctgtcatctacacacacaaacatgcaaagtcactagttaggttaagttgaatttagtttaagaagtgctagaaaaaggcttctgaactgttgaaaccatgccaggggtcagtgggtggatttttcactaaaagggtcatacagatgtctaggtttttcagtgtgagatatccatattctaaaatgccattctgagcgggaagcaagaaagggttttacaaagcctactttaaaagtataatgaagccaaattcttctgctccagtttagaaggggttttgcacttttcagggtggaatacttaaaactcaaaattcacagaccaaacaggtacacaggacacaggtacttaggggttggatgttaccaaagggtgaaaaaaaagaagagtcgagagaataggaattttctttctatagcactatctatgagatggagctctgagtataagcaatcatttctggttctccagattggaaaaatcatcaggagatcacatcataatctgtgaagtagaaactatcctttagtggtgccacattttctatttctgattctttggacacacagggactttctgggctatgaaatagtctattcagtgaaactagttatcataaaagacatgcaaaaaccttttcacagtctttgtcctggaatatctcacaaaattaattataaattggcatgcgactttctgatttagcctgacaggattgttcctttccaaggtttaggcactaagctgctgttattaagataggaattgtacaggtggtggctcagccccaagggaggctcggcctgaataacctcactatgcagaagtagagagcacctggggagaagagacaggctccttacatcctggattaccctgactctactgcagccacagtgctgttcttgagttttatgtcaggtgaatattaacaatagcagtaggatagggtactagatagtcagcatgctttttaggaaaaagcacagaaattttggaggtttttggtatatcctaacatttgatttgtgtgatgtctctgaggctcgcttccccatttaaaaatagaaataatgtggtctggtgtggtggctcatgcctataatcccagcactttgggaggctgaggtgggaggatcactggaggccaggagttcgagactagcctggccaaaatggcaaaaccccacctctactaaaaatacaaaaattagctgggcatggtggtgcatgcttgtaatcccagctactcgagaggctgaggcaggaggattgtttgaatccgggaggaggaggttgcagtgatccaagattgccactgcactccagcctaggtgacagagcaagactccgtctcaaaaaaaaaaaaaaaaaaaaaaaaaaaaaaaaagaataatgatatgctctagtgaaattaaatgagacggcacacttacctagtgagcccagagtctggggcatggtcaggatgcaaaaaatgttagttccctcatactccttctcttctctgtaggaagaagtgatttccatcatttatgttaacacagattcccttgttatataaaactgtaatttatttgagatcaacttagaactttgttgttgcaaaaacagagagatagcaaaatgtaacataaaaaacacctcagattatggtgactcagataatttgctttccagctcagcagtgttagggagagcttgagtaatgagtgaccttgaatttgatttactccacttaagctgctccttaaaaccattctttgtggtgccttcaagatggttttgcttaagtagcatgtcttcctcaaatggcccttgataaccaatcagttgtggtgtcacctacctcaacagaaaagaaaaaacatttcaatctggagaaagataaagtgtgcttctttgctagaaatggctgtaaagtgctaccaagtagaaaaatctagaaacaaacccaagattgtcaagaagattctaaaacttagctcttcctttcctagatgaggggctgttattgcaaagacaatctgaggccttggggattttaacataggttacccaaaatatgtaaatatatagggaactgtctctctgtatttacatagctattcattacttttatttgtaactctatgcaaagcatatttatataaaaaaatacaaaaacacataatagaccataaaagtgacatgtggaaagcagcattaccttgctctgctctgagggggcatcagcctcctgacttgcttgtgcattcaggtggcagcaaatacgttattacctgatctcagttttaaaaaagcaggcacagggcacatcacgccaaatgttgaaatgatcaaactaaacagaaacttgcttaatatgaacagtgctactcaccctgacttgattatacaatgtatacatgtgttgaaacaccataccttattccataaatatatataaatatgtcaatacaaaagaaaataaaacttaaaagaaaaaatgaaatctgttatccttacatcttttttacctttatcacatccagtcacgcctcactgatcagtttcaggagatgaggcatcagtgtaattacattttccagactactgaagtttaacatttaagcactgaacccttttattgtaagcatttgtgatgggaagttttctcaaatgcatcacattatttccctgctttgtgaattaaatgtgctaaatgccatctaaccctttgtttttttccaagcaagtagcatttttacttaaattttttttcaagtatgcaatacattaacaatagtccccatgttggacactagggctcttgaagtcattcctcccattcaacaaaaattttatattatttgatcatcatttctctaaacctcaccttctccatagtaaccactcttttactctctgcttctaagagtttgacttttttagattacacatgtaagtgagatcatgtagtatttgtctttctatgcctggcttatttcacttagcataatgtcctgtgggttcatccatgttgcaaatgacaagattttcttcttcttaaggctgaatggtattccctatgtatatataccatattctctttattcattcaaccactgatggatgcttagactgattccagatcttggctattatgaatagtgctgcaataatcatgaaaatgcagatatcactttgatatactgatttcatttcctttgaatatatacccagtagtgggagtgctggtagttctatttttaattttttgaggaccttccatattgctttccataatggctctactaatttaccttcccaccaagggttccctttcctccacatccatctaacggcctcttaatgactccatttttattaaataaatagttgagtgggcaagaaactctgaaatgattccatttcccaggcctatccttgtattttatacctgaatgctagagatgctaagtgacttgctaatgcccacacaggtggatataccaggagctcaccctaatgcctacgtttcctaattcctaatttcagtgtcttcctagtagacataattcccaataatattgaattcttggtccttgctgttgttctcaccaggcaggttcttcccttaaattcaagtgtgccctaatgtctctcctacttcagggttttcctcatttatcaccttctcagtaaggccctccacgatggccctatttaacttggcaacctccttccactcatggcattccttttggttttctttgatttgttcttttctctacagcattgatcaccttctcacattctatttattgcctttctcctcccactagaatgtaaactccattaagaaattattattattttttgagacgggagtctcgctctgtcacccaggctggagagcagtggcgcgatctcggctcactgcaatgtccacctcctggattcaagcgattctcctgcctcagcctcccaaatagctgatctcacaggcatgtgcaaccatgcctggttaatttttgtatttttagtagagatggggtttcaccatgttggtcaggctggtctcaaattcttgaccttgtgttccacccgccttagcccagaaaatatttttgtctgtcttattcatgactgtattcctagggctagaatactgcctggcaaataataggtgctcaataaatacttgttaagaaaatcatatatggcagatgcacctggcagcagaaacttaactgaagtataccctgagaatgaccttatgggctaagaagaatgtgtgttcagagttccaagctaaggaatccaggaatggccaacccagagattcattcttttccagagaggaacatctgaacctccagcccatcccatggaatcgaggccatacaggggattgaggcctcttgttttggattgagtgaaggttgccaagtggaggtagctagttggaaggtggtaaatgaaattgctatgtaaactgtatgcttttggctgggtgcagtggctcatgcctgtaatcccagcactttgggaggctgaggcgggcagactgcttgagcccaggagttcgagaccagcctgggcaacatggtgaaacccattgtctaccaaaaatacaaaaaattacctgggtatggtggcatgtgcctgtagtcccagctactcaggaggctgaggtgggaggattgcttgagcccggggaggcggaggttgcaatgagctgtgattgcaccactgcactccagcctgggtgacagagtaagacacagtctcaaaacaaaaacaaaaacaaaaaactactgcaagcttttcacaaacggtagctgttctatccagcccatcgccactggaccaccctacataaatcccctcattaaaccctatatctcgttcactggctctgggtctcttctttggcctctcaaacatggcgccattcctattgaagtcagcaggggtccagcatgacaaatcattggtctgaatgacaaaacttgacagagtttgatttctgaataagtcagttcaataacaaagagatgtataagttattttttttctgctggtggagaagatatacgaaattatgtgttgagcaaagtctggtttgaaaaaaaaaggaaggtggagttttagctggttaatcagtatcaaaagttggcttcctattagatgatacaataaaatatatattgtatttacaaacatatttctaccaaactactgaaaacattggtgactataccatcaactaaatttgtaactaaaataatggccccctcatgaaaatcctctgtaagtgcacccggaaagggtaccatcaacgtttcattttgttcgcccaaaagcagtctcactggttcaatagggagctgttatggcccctttagaggcagttgatgggaaataagcaacagtgtttgtcaaggaaccatttgttaaaaccacaggggtggctgggtagtttaaagagtaatcttcagtaaggtgcatgaaagagctttccaatagtcagtttcaaaggaggatgagtctttgagggatctgtctgatgataatgaaaatataatgaaggttaaagtgttctttgcagtttttaccataggaaatgattggaaggaaactaacattttcaagtaaggaaatgattcataaattactgacaagaaaatagtgcttcaattaaaatgatgatgataaaaatgacagagcaactttgaaaaatcatatgaaacaatattaaattcttgacatatatgaaaccacatgtggtggctatggtcatatgacatatggtcatatgtgaacatatgcacacagataaacaaggtagcattatgagtaacaagcaaaattatcccttttctctagtttcccggttttgatacttcacattgcaaggaataaaataataataaaaacatattggtcatggggcatgagtgatattaacagtagtttacctaaggtaactaaggaaaacttgatttaaatggaaggtgattgctgacattttcatactgacatttgaaaagaatttccaaaactgtgctttctgaatttgcctgataatagctgcatcacccacagacctaagggatgtgaggtaaaacaagctttgatgtcttttggagattcatcatgcaactactaattaaagggtctgaaaatctctgtagtctacctattgatattgtgagaaaaccagtgttttacagtgcaccattagcaaacagtgcattaagcacacagataccttggtttttccccaataaagttttgaacatcaaaaaaaagaaaaataagaaaacaagacataacaaagctaagtccaggtttctttgtccttgaaaactttctgaggaagactggccttatatctaattgttggggtcaggaggtaaagaggaaacctctctccaaagacagaaacagctaaatcaaagcctgtccctagagagtttctacagcagggccggctaaaatccaggggtggatgatcatgtcacatcgtttggacacaagtcacttggaagccaaagttttaaggtgtatagaatggatttaggggctagtaggaaggtttctgagcccatgtactcccatcatatcctgtactatccactataggagtgtttaaattatcttaaggattgttctcaatagagtgcaaacctctctgtctctgtctctccgtctctgtaagcttcttgatgatagcaaacattatggtcacctttgtatccacagtggctgggtcttagttggtgttggataagtaaatacacattgaattaatgacagaaagcatgaataaatgaatgaatattattgtaagctacagaatatgaatattggatcagaggaacttattctttccaagtgcagctcttaaataaaatagtccttaatcaatgatatatttccattagattggaaggtacaagaataatagttctcaacctttccctagtttctgccctaatcattagttatttcatttttatttttattcattaatttcattcattatttttaatttcatatgatatgatgtgtaaaacattgaaacagttcagataaggctaacgtgtctcttgaccatcacccgccagttcctactcagagctggaaagcttggggtctgtttggcatacaagattgtcttcaaggtccttctattttaggaaatataaattacttaaaattttgtcagtggctgcagaggattccataaaatggttgtaccataagttatttagttttctcccattgatagacatttatgtgttaccaaggcttgctattatgggaaatgtatcagtgaacatctttgtatcctaggccagatactcagaaataaaactgttggataataaatttaaaaattcaaatatggccaaactgtcatccaaaaaatggctcaccacatttacattcctgccagcaatgtagagcatatgcattttctatatctctgccaaaatatttctattatcaaatttaaattatttttttccaaataattcgggtgaaaaatggtatcttcctttattttgcacttccctgattaccactgaagtttagcaactttttttttttttttttgagacagagtctcgctctgtcacccaggctggagggcaatggtgcaatctcggctcactgcaacctctgcctcccgggttcaaatgattctctgcctcagcctcccgagtagccgggactacaggtgcgtgccaccatgcctggctaatttttatatttttagtagagacaaggtttcactgtgttagccaggatggtctccatctccggacctcgtgatctgcccgcctccgcctcccaaagtgctgggatgaggggcatgagccaccgcgcccggccctttttttttttttttttttctgagatggagtttcgctcttgttgcccaggctggagtgcagtggcgtgatctcggctcactgcaacctctgcctcctgggttcaagcgattctcctgcctcagcctcccgagtagctgggattacaagcgcccaccaccacgcctggctaatttttgtatttttagtagagatggggtttcaccatgttggccaggctggtctcaaacacctgacttcaaatgatccacccgccttggcctcccaaagggctgggattacggacataagccactgcgcccggctgcaaatttttatatactatttgtcactgtatccattttagccaagatattattaatcacattaaaatcacattaaaaacataaaaatcattaaaaacccacacaagtcacaactataaattaactagtcctgttgccttattgtaagcaaaactgtacctttaaactattcacaaatatatagttgtcaatttggtggctcctgaaaagatctctagcattacagattttataaccttcctcagtaggaagttggaatgcttcctacttccaacacctttatagcaaagttggtcacctttctggaaaaacaggcctcacttcaagagaacgtcacttatttcactttgtaggtgaaccctgtctcactaacattgccttcttgtgtacagacatgaggtttatacttttgtagcctttgtgcctagcactgtggtgggcccatgaaagaaacaaatatattacaagtgtaatgaatttagcaattcagtcatagtaaactttcaaatgcctgaaattacagactctaactactttcccctgcactaaatgctaattcttaccaccatttgaaaaaaaaaaaaagtcttcttgttctgtccttgtgatagtttgctgagaatgatggtttccagcttcatccatgtccctgcaaagaacgtgaactcatccttttttatggctgcatagtattccatggtgtatatgtgccgcattttcttaatccagtctatcatggatggacatttgggctggttccaagtctttgctattgtgaatagtgccgcaataaacatacacgtgcatgtgtctttatagcagcatgatttataatcctttgggtatatacccagtaatgggatggctgggtcaaatggtatttctaagctactaaggaggctgagaacacaaggggggactgcttgagcctgggagttcaaggctgcagtgagctatgatggtgccactgcactccagccttagggacagaacaagaccttgtctcaaaaaacaaaaacaacaacaaaaacaaaaacaaataaagtttataagataagatacctgagttaggattaaagatactgaaatatcattaaataaaataagtcatatatgatgttttggggatgtttcacattccatggctactgatgagaaaaaaggatttttaaaaatctgcagggatgagaagacacaaaaattgattatttactccacaggaaaaaatatctaaagtgagaggagatcgtatacctttacttctctaggttctgagctttaggaatgttcctgaaataaatccgttgagctcagaacaacaggaaattgccacttacgcacttaaaaagctttcgtgctaccatgaaaccacctactcacttgacactaatcggttgctaatggtttctggctaggatttgattttctttggcttaatcaccaagggatcacctctttccagatcaatctcagtccactggctaatctgattctgtgatacagcactcagttctgttctatcttgaaagttcctaagtacataatcagtctaattttggtgacattcgattcaatatttacgatttatgtctactaagaagtagacataaattcttagtctactaagactaagtgtccaagaggacacttagtaccgggaaaacctacaggtatcacagatatgtcatttggtaaagggcatgatttagctatttattttcagggatggaaagatagaacagatacctttaaaactagtagttccatttgcaagttctatgacagcttttaatgatgtttattaagctgattacacactactgtacaaaagaagtccttgaaatgaggtaatactaggagaaacacagctggccatcaatttaagcatcctttaaaagcagatgtgttaaaactcaaagtgggtgtgaagaggacatgcaaatcagtctaaggtacaaggcactgcattttgaaatgcagtacttaggaagaatcttggagagcatttaattaaaactcttacatttaaaatgaagaaactgagtcctaacattattaaacatagttagaaaagattttttaacctggaatttggcatagtggtcccttccccaagtttgacagttcatttaacttaagtagaatttttcttgcttctgtatatcagtatttctttctcaaggatccttacaaagtactgggatgtcacttcacagattctttgccaagacacgtgattacttgcatcactgaacatgcgttctaaatactttttcaacaggaatttaagattgtcatattgacatgaagaatgcatttagcttgtttgctcttttaacagaaagtatacattttaagccacagctgtgtaccattcaatcattatgatttaagaatttttcagggggggaaggcctgaaagaaggggagttgtaaatttctcatgcttaagaatgatgaagaaaaaaaagtcagaatagaattcaatagcaaaataaagcccaacaggataagtattcaataaacaaaaatagcattattttctcttcagtatattctatccttcaaactctggcaacagtttcttaatatgagtgaattgccatgaaactgcttttgcctgacaaaattcctttgagtagtgtgcaaattgtaaagcctatttctctctgttcattagtaagagagttcatattgtatagtgccacagactctttgctcattgattgtgagaagtgataattggctggcactgaaatactagaaggcaaagttgtacttcagaagatgaagagagttgagaaacagtagcaacgtgtcagttaggaaatatactgtcaatgcataagaaggataaagaacaccagtttagggttgatttgcaaagtatatcattccgctgctgactacagaaagttaataattaatattattaatatggatagatggatatggagtctatactaagaaaaatggccagtttatgagcaaaagtggagaaggtgatagccattttttcaattcatgcacataaccagtgagtttaactttcacttacttatatgtatgtatcatgtgaagatttcatcttaaaacttcttagacttggttaaatccacattaattgatacatattatattactgtaacaaatctgaacatggattttttattcagttataattaaagatgggagcccttctcttactttccctttgttctgagctgcgccatgccttttctcttttgggggctcttcagcaaagacaagtgtccccagattgaaactctggatagaactttttagactcagggaacatagattaaatttacctttcagctgggtgtggtggctcatgcctgtaatactagcactttggaaggccagagtgggtggatcacctgaggtcaggagctcaagaccagcctggccaacatagtgaaaccccatctctaccaaagatacaaaaattggctgggtatcttggtgcatgcctgttgtcccagctactcgggaggctgaggctggagaatcacttgaacccaggaagcggaagttgcagtgagctgagatcacgccactgcattccagcctgggcaacagagtgagactccgtctcaaaaacaaaaattaccttttaactgccatgtgatcagaggcaaaaacatgactgccatatccataagtttcttttgatagtccttctataatcaatttgctcactctaataactctagatatgtaatcatgcaatacaggcatgattcttcatggctctaaagagtgatttcttaatcctagatgctacagttccaatgcagagaatcagtcctatattaaggcaaaagacttgataacacgtttcaaccaacattaagtaatgatttaaacatgtattaacttcactcattcagttgattctgcctattgtttcatgccattctttttgccagaattggtaacctttaataacccacattcatatgcattcagataaacacacactcttgaaggtaatatgtatgggcttcagtctgggggggttagggatgatgacccatttcatatttcacagccaataacagaagcctataggagagcagccacagagaggcaggaatgaaaaccgcttgcagatagttctgtgttaatttttatctccctccatttttcaaatcttctataaagtaggtttatttttaacatcttctcattctctttagtatgaggtaaaatagacaaaatgcaagggtgaaaagagagaaggaaggcagttaaggatctagccggtccacaaatattgaaggaataatcaagacacaacataaaaaatattttcaaaatatgttctggagtatttttcctcttggtaattcatttttcttcctctttttgccatcctgcctctgaggttggacagggatctttgccccaggtaaagaaagaaagatacagtccagaggtacaggagttctgcagagtggctgtatgcgtttcctctggctgtggtactgcaaattaccacaaacttggtgccttaaaaccttacacatttattctctgacagttctgatgcctgaagtctgaaatccattccactaagtcaaaatcaaggcgccacaagggttgcattccatccccttccttccggtcaagcacacaagcacacagaggaaaacggcagcacgaggaaaaagagggttaacttgatcagttactctagggtttacgctactaccttagccctcaacctcgaaaacaagaaagaaaaaaaagttcagctcagcttttagaaatatttttttcatacaaattggaatgcaaattaatttttctagagaataagagaatattcaacaccaacgtccttgagggtggagacgatagtttacttatttatagttattccctctctgacccaggccccactatcctctgtacagcctgacacagaaccttcccaacaggagacacccaatgaatgtctctgaatgactctctagggctcagcagtacagctgccatccatctctgtcctccttcagaagatgtccaggatggatgctggggtagggtagggtggatgttgctgaagaaaacctctttttctctttcctaagagaaaacttgctattaattattccatcaaataaatgcctagaaaattgcaagaaaatgtgaagcaaaatataaaaaaatcaaacatcaatggcaaagcagacagaatagaaagggaatatacattgtggccagaaaaatgagaagaatgtggtcctgcaaggtatgtttcattactgtatttgtaaagtaagcatgggttaatcttttacctttttagagtatgactcttcaaatataaaatggtgatggtgataacactaacttatttgttgagatggttaaagaatatacaaataaaagcagtgataaaacaattaagaaccaatatttttaacccccatgctacttagcttgtatttactaaatcaaatttgatagaattaagagaactatgtgtgaaagttctttttacaacattgcaaatgatagctttaattattacttgagataaattacctttgagtcagcatcatacatttccatgttgaggacacaataaaaatttggaaaaatgccttccttcgctttaattcctttctgctaatatatagaacagccttctattcaaggactcccaatttgggcaaaacagtacctattcttgttttctaaagatgttttagaataatatgccttgcagaacagctgtagcctaatggttaagagtttggactctctagggtcaaattgtaactctaccactcatccgctgtgtgatcctgggcaaattccttagcttctttttgctttaagctcctcatctatcaaatggaggtaaaaatattacctcacatgtagttgtgaggattaaataagttaatatatgtaaacagcttacgctagtataccagtgaacactcacttaatgttggctattataattctagtcattataaaacagctatattttattgttgatgaaacttataatagataaatagaagtttacttaaatttaatggatggccctttcttatacaattacgaaacattcatccataacaggtctaggatgcagagagatttctatcttggctcaagtaaagagaaagaaaaaagaaatatttcattttcacaatgtggtagaaactatgaagtaagtgattagtagtttctttgctatctcttttttccctgtcacacaaatcttgacataccattaaaaaatttgagtgaggactcatttcagccaaggtatcagtttgttgataagtggtgctcatggcaaattatttaggagatgaagttctggaagacaatgtcttggaagctgacatgtgaacgtgaaaatctgctacaagcataggactagaatctcaaagcaggcttggggtttcagcattgtgttctttttaggcaagtttcaacaaggcaaagggctgcttaacttctccatgtcaagaaacagctttatcattgtggctgaaagtactcacacacggttgctagtgagcaacctgccacaggcctgatccagagagacccggcattaacatgattctccctagggaggaaatctagcaatgcctgaacagacatggagtcctcatttccacgcccttggtacagactcagaagcagcagggtgaagcaatagcagcagctagaacagagagcaaacgcagcacccgaagtgttcctccaactattatgttggtgccattacttttaatggcaagaacctcaattacttttgcactaatttgatatctagaaatctggttttgcaatgcaatagtggggagatgtcaatgtaaaatatgttctatttccttgtagttggttgatgcttatttatgtcatcatcatcatcatagcatgttacactacatttatctgagtgattttataggattgtcacactattcataaatgaggaatatggagtagaaaatattcccaggcaggctacagttacagaggtcagattgttacaaagttaagaaacatttgcaacatcaatatgtgacatgcttactgaattccctgtcctggtgtcttctttaggtaatgtttcatgtttgagcatctttcttttataactgacctatttctaacttaaaagtatcttctgtattttactgatactcccgaaagaaacatgttcatattagcataattattaccacaaaaccaaagcaaagaataaggatggaactatcttgttcttccactcatacaactttccttatcccactctttcaatatcccacccttgcccctggaccagtagcaagaaaaaactcattagttccactgtggagttggattcatgggaaagtccatacaaccacatctgtttcctacaaaagatggtgaccaattgctcttcatctctgttagggatttaaacaataaattcttaacatattaaagggcatataaggtacaaagagattaataataaaggcactgatatctcattttgtgaatctttttgaaaagaaaatatgggaaatctagggttgatctaccgggctgtgggcagagatatggaatggaataaacaataacttgagctgatttttataaagaagaattttctcattccattgtgttatagagatgttttgatgacatccacgtttctaagaattgtgtgttcctttaaagaagagcaacagaagaaatacatgatcctgtaattgatgtgccacatttcattttcttagagagttaccattcttcccataatactagattggacagttttgggttaatggattttgcagtgtaccattacaatcattcaggtcacttggaaggtttgcaaaaatcacatgtttcaagtgtcctgattaatggaagtaatattctctttttcattccccatcaaatgtaacttacttcaaatttatggtttaataaagcacgtcagactttcctaaattccttttcaatatattacatgatattttctgatactttatcaagtttgtatctgcaagactagaattcacaggcagttatttttcaccaagatgaagatagccttcaggacaccgcttgtccacacctgtaatcccagcactttgggaggccaaggtctgccgatcacctgatgtcaggagttcgagacaagcctggccaatatggtgaaaccttgtctctactaaaaatacaaaaaattagctggtcaggggtggcgtgcgcctgtagtcctagctgttcgggaggctgaggcaggagaattgcttgaacctcggaggcgaaggttgcaataagccgagatcatgccaccgcattccagcctggctgacagagcgagactttgtctcaaaataaaataaaataaaatagtaaaataaaatgaaataaaattatggttcatagcaacgatgtatatcacttcttttaatttttaatagtttccgtattaaaacatccgagtttccccaaaagatcatcattttggctaaaccaaatactttaaaatattaaaagtttatatatgattaatagttaacagcagaacataggataatttttctcttctaaaagagattcatttatatgatttgaatttacttgaaacaaaatataacattttatgttccaaccactaaaaaatgtttttgtatttgtcctcagacgtaatttaggttttaaattttctgttgatctctttttttagaagcagagggaagagtagaccttctcatatgattttcattactgtagtaatatttgcacatacttaatttctattggaaatatttgttgtaaatataatttctatactcagtataggcaaaacaatcaaatttaattaacaaaaagcatttgcacagccagtctggctggaccttatgcaaatgtagaaaatgacaagcttgaaattaatcaccaaatgtctgaaattaaaacagaattgtcaaggcagaaatgtatgaatcataatagtatctaattccatggtttctgggcagatgtctttctgtattctgatgaaaactagcatttatttatattaaaacctcttcaacaaaccatatgttatatttagctcagccaaaattcccaggtggagaatatttgtatggaagatttcaaaaggatgatcaatttagatgtaacctacatcttatttatttatttatttatttttgccttttatatctgaagactgcattgaaaagacagatgcatcttttcttttatacttcaacatccccagtttgatttaataagtcaggaaagcaagcacctgaagattttatgaatcacagttccgatttagaatatccacagaagtgatctgtgtttccctttgtgtgtatccttcaaggatacattggagcaacgggtatccttcaaggatacattggagcaacgggaccagcaaatctcagcagaaacttattgagaacaactaaaaagctgattcaggcacttggtgttgagatgctatcattttctcaagtgttagtaagtaagaactatgtagaggggaaattgataaaacttttgaacatcatcttagcattgtgtaacgaagacagaccaatgtcataactgtgcatttaaaaagtatttaaaattagtactaaatgcaaattgggtaatgtaagacatttcctctattctgtgtttgcctctggcaaactagaattacttcaaaaaatttaaaaatcagggatatgaaatgtcttccaggagacaagcacaaaatacaaaacacaagtaatattaatatttcctttacagtgtttacagaagtctgggtttctctttcctggaaagttcaatcactttatctaatgtctgggttttgggatatttatactcctggccacctcacaccaagtcatctccatctaaatgctgtttatggcttcacgtaaaaggagtgtaacttccaacagtaaaaagccacggggaacatctctacagtcctccaatttgaacactcaaatcagcacagaaaaccaagtaggtatttctccaaattgcccggtgttgagaatcaacagacacacttgttaaaaatacaaatcccggccaggcatggtggctcacgcctgtaatcccagcactttgggaggccgaggcaggtggaccatgaggtcaggagtttgagaccagcctggccaagatggtgaaaccctgtctctactaaaaatacaaaaattagccaggcacggtggtgggcgcctgtaatcccagctactctggaggctgaggcaggagaattgcttgaacccaggaggcagaggttgcagtaagccgaggttgcaccactgcattctagcctgggcaacagagcaagactccctcaccaaaaacaaaacaaaaaacaaacaaacaaaacaaacaaacaaacaaacaaaaacctaggttgacctcaggtaaaagaaatagtactacaaaatctcatgtcaattgtaatccccagtgttgaaggtgcggcctggtgggaggcgactggatcatgtttacaaatgtcttgttgaattttttcattcttcaggcttggggaacactgcatatcaccacctcctcttcccatagaggaaacaacccagcaaacaccaagataaaccaaagaacaatgtcaatcagagatgagtaactaaagacaagttataatcataattaacccaaatttattttccaggtcaacataatatttttatcccttctaagagacggtctgttctaatgggcaacagtcctccacgccgagccactctcatctcctactaacttaactgccctgcactgtccctcgactttcacctttcttgccttaggagccatccatgaaaccctcttctaatcatctcactttctccaataaaaaaagtagtttcatatgtgccgaaaataaaaggaaaaaggaactgataactccttggtatcttttagtaattcttgatcattggctcccaatttctagaattacctaagatttgcatttcttggaaatagagatcacagcctgtgtaacatagaaagaccccatctctacaaaaaaaaaaaaaaaaaaaaaaaaaaaaaaaaagcttgcccctgtagtcccagttacttgggagggtgaggcggacggatcgcttgagcctgggaggttgaggctgcagtgagccatgatcgtgtcactactgcactccagcctgggtaacagagcaagaccctggtctcaaacaaacaaacaaacaaaaaaacccaacatatttttgctatcataatcatattgctgcttttctctcctaccatttaattaatagagtaatataatgttaattagattttttttgttggtgatcacgccaagtatattttaccactatttggcattcttcgtttaaaaggttaatctttaaaactttttttttttttttttttaaagttagcatcttgctctgtcaccaggctgtagtgcagtggtatgatcgtagctcactataacctcaagcaatcctcctacctcagcctcccaaagtgctggggttatatgtgtgagccaccttatctggctcttttaaacttcttaaaagagataaaaaccagacactactttaaaaaattactaagaatagtaaggacctcataagagccaagtttatcttacagcactaaaattatcagattccataagaagcttcagtttacctgcagtctgtatgtccccatctggcattaacctgccaattatacaaaggggctaaccagaacagaactgacctgtaagctgattagtttccaattctgatgaacaaaatcgtgcagttttttggccaaaattcacttcttatggttggttgtacacttgttcacttatttattggtagagcttctaaagattgcataatagattgcaaaatatctattgcccaaatcccaataatagcaatatttacctaattatagaccactagtgagtaggatcatttggggtgagtatggtgataactgatttaataggccttctgttcctggcctaagaaaagtgggtgtctttccatatcatcttagttagcatgcaataaaggtagattaaacaattcttaggatacaaaaatgaagttctcaactatgcccaggggcgcacaatctgataagaaaccatagatatcatcaaataattaagtgttagaatataggtctgtgaaacgtgctggacatattaattctgagtatttgggcattatctccttaggtctctggctaagctcagtgtctgaagtgttctcaatagatgttttttgaaagaaaaataaacaactgattaaacttacatcactagtaatcaaaggagtgaatacattgggacaatttatcctcggaggttgtgggttgataggaaattctgccttgcagaggctaagtttgaagtgtctgtagaacatatatagctggagatagatacatgggtctgaagttcatgtctagaggcaacagtgcctttacctttgctctctaagctggcctcaggataaaaggtgcaaatctgcaggagatgtgacaattttgggatgtcagattgataagacctgagcgagatgctaatgacccttattctttgcctccacatcctggaactagagatttttgttacagaattataggaaagtatattttccagcctactcaaataacttacttcaatgttgaatttccagaagaaaattagagtcaaatgttgcttaaccctactctgaatgcagaaccatgcaaaaagaacatttatgttgtctatgtaactgtttctaaattccactcccggagcttcctgtctttacaagaaattctcaggcaattttcagacaaataaaatggtttgctttaactataataacacatgcataattaacatatcaatctgtatgtggcaaatagtggaataatgatttgcttattatgcaaaacatattttttggaaggatattgtataaatattacttgggtaaatgtaatgagacttagttataaccaaaaattgtattgcgccatcttgcttgcatcatgatcaagctctatgtaaagtagccaatagtaataaatggatacaagaaacagaccagataattatgaaataaagaatatttagctatgaaacataatttcagaggttatacatagtaagataagttgacaaactagaaaccaaatcccatgtgacttaggtgttgtagccaggggtgaatgcctcagttgttacttttagtccatttgtatcagatgtctcaagacacatattatctttaggaagaaaccttggtcaatcacctttatccagatcaagaattgagctgttatatggtccatgaatctgcttatcacctgtaaaatggcttcttccattagatcattgaggtttaatgagaaagtaaaaacttattttttagtttttagagatggggttgctctgttgccctggttggagtacagtggtttggtcataactcactgcagtctggtcttcccaggttccagtgatcctcccacctcaacctcccaagtagctggggccacaggtgcatgctaccatgcccagcgaagtttttctttattttttgtagagacggggtctcactacactgccaggctggtctcaaactcccgggctcaagcaatcttccagccttggcctctcaaagtgctgggattgcaggcatgatccacagcatccagtcctaaaaacttctttttgaattagaaggagactgttgttcatctcgactatcccatgttcatttgaacagattattagaaaaacaaattaaatgtagaattgtgaattacataatgcaaagagcatataaaaacattttttcagccatttttaaaaaatgtgtttttgaagaaatgtaattgctcatatttaagatgaagaattaaaacactaatctaagccatcagagctcattcttgacatttgaaagcaatgaaattcaaattttgccttttatccttatcttgtaccatattgattctaaattacttagagtttttcacagcatgatcaagaatgaagcttgcagtttgccaaatcttttttggtcagaagtggcattttcttgacaaggcctgtcactcactcagtgcctactcactcatccagtgtaataatttaaacaagacttaaggagggtttttggtaatttttttctttgacaaacaaatcctacaatgtcgatagactgagagaatctgaaaactgtgacctgaccaacttgtgcctgcactagatcaatctttcaccatacctggggagggtatggggacaattctgactataagtgccagccattatgaaaagtctgaatgttagttgccaaggcaaaagcagtagaaaaaggctgctttgggatgaaaaagaaaagctgacttttgtcactatctctaagacaacaatttctcagtataatacattatcaactgaggactacttgtatgtatagttctttcaaatatttctatcttttgcaagtcattagttcacatgtaacccttattctcacttcagaattaaaaatttgaggctgggcacagtggtgcacacctgtaatcctggcactttgggaggccgagggaggcagatcgcttgaggtcagcagttcgagaccaggcagggcaacatggtgaaaccccatctctactaaaaacacaaaaattagctgggtgtggtggcacatctctgtagttccagctagtcgggaggctgtggcaggagaattgcttgaacccaagaggcagaagttgcagtgagccaagatcacgccactgcactccagccttggcagcacagcaagactctgtctcaaaaaaaaaaaaaaaaaaattatatgcctggtcgtagaacttcccgccacacagatgtcagccatagcctgggttatatttggctctgtgactgcattcatgggagctgccctcctgccaacttagccctgccccagtagctgagccagtcctgtctgaggggcttcccgtctcctcctcccatgcagccgaggcactcatgctggccgtcacactggagcctctgtgctccttaactgcttgcccaagtccagcctgccaccatatccctgttctaaaaattatactctgaacctgacttccctctgggctctaatttataagtctgggattttgcctcagtttccttagggaattccttttctggtaaactgctaagcattccagctccctcctgggactgggccatctgccttagtccttgctcttgtcagttcctgtctccagcatgccacccaaggacagactcctcagatgtggactgcctggtggactgcttaccccattgtaatcatgcgcttagactaggtttttactttacccttgactatcatcataattgcctctgggattttccacccttccatctttccatccatccatccatccgctcacctacccaaacacctacctactcatttatccatctgtctattcacgtatctacctatgtatccatccaacggtccatccatccatccatccatccatccatccatccatccatccatactttaattcatttattctttctctcatttattaggaacttactctttgccagcctctgtgcttagtggtagagaaacaatggtttctaagacagatatcattcctcctctagcaagggagacagaagttaaagaaacatttacaacaaagtgtgataagtcgctgtctcatgcattggcctaagtgggtgggtgcaatgccaagttcctatacttctgtcttgccctgtttctctaagtgcacacagctttactctgtggaggcaaaacagactagtattttcagttctctttttgagaactttaggagaaaaaaaatgctatcattccaagtcaggagagcaagcattaacattatacacatatttacgtaataatcccctagacttgtatggggttttgaaatatgcaaatacttttatttacagatattatttgttcttcagagcatacctgtgaggtatatgcaggataggtattattttcatcctcacttcatggaacaaaaactaaggttcataaaagttaaaatagttttaccaaagcctagagctgaaactaaaattaagctttattattgtcaatataggcttctatccacgttattaatactcaatggaaacttgcacagtttccaaaatcttaggaacgtcagttccagttattgccatctatatttttaaacaggttaatgctcacaggatagccttttatgtcacttgttttataaaaagacaaaagataacacacagaactctaaagtattgatttatattccattaactgtttattactttaatctatgaatccaagtggggaggtagaaagatgaaatcacttgcctcttatctttgaaagatgtgagctcattattaaaccctgacaaaaacagcaggtagctcaggaaacattttccaaagaacacttagagattttgattcatgactgaagttctactgtggcattttcctctccatcacccttcatggggaagcctcatcctattatcatctgttgtcatatttaactagggtcatcagaatgtgttgttatatgtcacttgtttcttcttcctttttctttatatagcactatgacttttattttcccaaacagtttgtgtgtttgaaactgcagttgtttcttttgggggcagcctccttaagtccaccatggtggttagttttaagatattaataaacaaggcaaaattcaaatgtgtatcacactcctggatcttagttaccctatttttctatttaccttgtgatatggcttggctctgtgtccccacctgtattatctgttctcctgctgctaataaagacatactcaagactgggtaatttagaaaggaaagaggcttaattgactcatagttcagcatggctggggaggtcacagggaacttacaattgtggcagaaggggaagcaagcatgtctttcttcacatggcagcagcaagaagaaatgcaaagtgaagtggggggaaagccccttataaaaccataagatcttgtgagaactcactcactatcacaagaacagcatggagggtaaccacccccatgattaaattacttcccactgggtccctcccacaatgtggggattatggaaactacaattcaagatgagatttgggtggagacacagtaaaaccatatcattctgccgctggcccctcccaaatctcatgtcctcatatttcaaacacaatgatgcccttccaacagtccctcaaggtctcaactcattctagcataaactcaaaagtccaagtccaaagtctcatctagacaatgcaagtcccttctgcccatgagactgtaaaatcaaaagcaagttagttacttcctagatacaagtggggtacagacattgggtaaatacacccattccaaataagagaaattggccaaaacagaggggctataggcaccatgcgagtctgaaatccaataggtcagtcattaaaccttaaagttccaaaatgatcttctttgactccatgtctcacatccaggtcacggtgatgaaagagtgggctcccatggccttgggcagctctgcccctgtggctttgcagggtacagctcccatcctggctgctttcatgggctggcattgagtgtctgcagctcttccaggcatacaattcaagctgttggtggatccaccatttgggagtctggaggatggtggccttcttctcacagctccactaggcagtgtcccactggtgactctgtggggactctaaccccacatttcccttctacattgccctagcaaagattctcctgagggatctgcccctgcagtaaacttctgcttggatatccaggcatttccatatgtcctttgaaatctaggtggagattcccaaacttcaagttttgtcttctgcgcacccacaggaccaacactatgtggatgttgccaaggctggggggcttgcaccctctgaaacaatgtcttgagctgtaacttggccccttatagccatggctggagtggctgggacacagtcccgaggctgggcacagcatggggggccctggacccagcctgcaaaaccatttttctctcctagtcctccaggcctgtgacgggagggactgctgtgaaggtctctgacatgccctggagacattttccccattgtttggtgattaacatttgactcctcattacttatgtgaatttctgcagctggcttgaatttctccctagtaaatgggtttttattttctattgcatcatcaggctgcaaattttccaaacttttatgctctgcttcttcttgaaggctttgccacttagaagtttctttccccagatatcccatatcatctctctaaaattcaaagtttcacttatctatagggtggaggcaaaaagccaccagtctctttgctaaagcattgctggaatcaccactgctccagttcctcatctccatctgagaccacctcagtctggacttcactgtccatatcgctatcagcattttggtcaaagccattcaataagtctctagggagttccaaactttcccacattttcctgtcttctgagtcctctaaactgtttcaacctctgcctgttacccagttccaaagtcgcttccacattttcaagtatctttacagcaacgccctactgtctgcagtaccaatttactatattaatctgttctcacactgctaataaaggcatacctgagactggttaatttatattggaaaaaggtttaattgactcacagtttagcatggctggtgaggcctcaggaaacttataatcatggtagatggggaagaaaacatgtccttcttcacatagcagcagcaaggagaagtgcagagtgaagggggccaaagtcccttatataaccatcaggtcttgtgagaactcactcactatcacaagaacagattggaaggtaactgcccccatgatgcaattacctcccactgagtccctcccatgacatgtgaagattatgggaactgcaattcaagagaagatttgggtggggacacagccaaagagtatcactatatgaaactcatgttgaattagagttctcatgagatctggttgtttggaagtacatagcacctccccctttgctctatctttcctgcttcgctatgtgaagaggtgcctgcttccccttcacctttcaccatgattgaaaatttcctgagatcttcccagccacgtttcctgtacagcctgcagaaccgtgagccaattaaacctcttatctttataaattacccaggtagtttataaactactcaggtagttctttataccaatgtgagaatggactaatacaccttgtttctggaattatgggtaaaatccagtatttggtatcatataattaaaagtatttaaaatatgaaatttctcatttttaaaatgtggattctgttcatgcagataaaccttaacagttattttatagtttcttgaatacttgaagcaagggtattccagaaatctaaaaactggtcttataactctttaattctattaagcagagagcaacctgacaatcatgaggggtgaggtcaaagggcagtgtgactgccacctgatacttctgtgccatttgctgtcaggtgactttgtcactagttttgtagaatggagaactttctctcatgattctcactcgctccctgatcttttaggtctgaatatgtattctctgaagctttattggtggtagcattatgaacttgtcaccatgggagccccatgagggatagatagtatatcggcagggaggaaaaacacccccaaatctcctatgatgtgggctcttttagaattgattttttttctcaataattttaatgaaatccttctcagcatggcaaagtaaaccattagtctgttttgaaaagtgcatatttcttccaagttgaaaagaatcattgttctgcatggataagatcacagttcatttaatagctccatataaatagttctagaaaatccacaagtataaatcataactacacaacagtacacatagacagacaacagggatgtgccattcctttaggaagagcaggacacgttggtgtaagtattaaggtgaatttagtgaatggaaaattccctgtaactttatcaactcttttcaattggagtttttctcagaaattatactgaaggtacaagacccaaacacaccaagatgacaatgctacaggtgctaatctaaattgagattgttcatatttggtaacatttaaaggtggttaagtttttagccacaatatcaaacctttcatagcattctttctttaattacatattactcactgaaaataacattttcttcagtgtatacttgagcactggctttagaaaatgcatgctcctagaatgattaagagaaaattccctttttatatttaggaggcaagcaccaaaactttgaatcaagttgagatcaaattttatgatttagatcatctttattaagtatttaaactgaggtattattttgcgtgctttgggagcagaaagttgatggtatgttttccgttctcaaggagatttttagtcaaggaaaatataggtccgcacatactgtgataaataattccaaatacaagtttggttcctgctcatgtgacatgagcagtgaggttggcacagggatctggtcactgtggtcactgagggacacaggctggcaagggtttcatctggacatgcatttccaagttcaccacagcggttgagagagactggggactctgtgggctctcctgatgtatctttttcatttgtttaacttttaaattttaggttcaggagtacatgtgctggtttgccatataggtaaattgcacaccgtgagagtttggtgtacagattatttcatcatccagatgataagcacagaacctgataggtagttttttatcctcactgtcctcccatgctccaccctcaagtgggccccggtgtcgtctgttgttctcttctttgcgtccatgtgtactcaatgttttagctcccactcttaagtgagaacatgcagtatttgttttttttgttgttgttcctgcattagtttgcttatggaaatggcctccagctacatccatcttgagacttctgcttacattttattggccagtgcaagtcccagggtcacgactaactgtaaataaggcagggaagtgtaattctgtggtgtaccctgggagcgacctggcactgtttggtgaactgtactaatgctgccacagaatggtgagatgtgtgtgggccacccccatgtccctgtgccatcagaggtgtgagttaagtgggctgctataaaaatttaggaaaaatatattagaaaattccagattgcttagaattatactgtcataagtaagaaaggtgagatgtgcaggtggatgtgtcatcttcactccactgttgccacggctgattctctcaatgttaataaaagaaaacgactctcacagaggaggtgtatacttttacaaaggatgtatatatgcggggaaggggaaaaatagagggttgatcatcttccctttaaagatagatacatattcatgtggtatataaattcagggctgtcatgaagcaaacactgatgatgaggtgagagaggcaggttatctatggggaagggggcaggagaaggccgtggagccttcagaccaaagctcaggtctgatcctgtcatgaaagaaagggggaaggaatgaggatcctcgtactgcaaggtgtttctaagaaaggtttgggcaggctgatgggtggcctgcaagccaaagtcactcctaagagcgctagcactgtttgctagctgtgcctgtcttcatacttctgatgtgcttagtcactggccagaagcggcctggggaaaacacaaaacttgacataaatgtggtagattcagaatggccagaaactagccctcagacagttatgatcccacagcatgagatctgggtggtacatttttatggctacaacacatggtttttagatcctgtcaattctgtattagcattggtcttccttggatagtacaattccaaaggaagctaacaagtggtgaactaataagcaaacaacctcaaaagtcaaggactgttacttcatcactgaaaccaaagtaagtcctgtcctctcaggctgtggtctgaggtcttatatagtctggagaattccaaagaggttaagaccctaggagccacctaggaattgagacatacactaaaaaatacctgggggactgatttggtttcagatattcagactgaccccaggaaagtacctctaatgaatctacagagcccttttattttcaaaggattttctagatgaatctaagaccaatgcactttagcatctttctaatccacaagcacatccggatgataactagactcattgtgggataaatttggtagcagactggagaagataactaggagctttctttttttctcatttgcatttattagcaactgaccatacatacacacacacacacacacacacacacacacacacacacacacacacacacacacacattacagcaggtagttagacagacatgagcagggcaggagaggggctcctgccaccagcaatgtcaggtgaccatcaggtgatggtctgatggttaggcagtttttaaactgtctctgaaataataattgatggcagccagcaccagggaaaggcagtctcccaatagacagaaaactcctgaaactggtgatcagcaacttctcgataagatctcaggagttgaagtacacccaagcatgcattaagaggcaaaatggcaggctttaactggtatatgaccttgtaggaacactttattggtaagggaaaaacacctcaagtgagcatgtgtacaactccagtaaacacactgtgtgtgcagcccctcccaagtgctggaaggccactgcgcatgtggacagcccaccctaacggaagaatcaggggagaaggatcgcaatcccccagaagcctgccaatgtataagactccaagtcaaaggtcaaaccatgcacgtgaatctctcaagttgcctgcttggccctcttccaagtgtactttacttcctttctttcttgctgtaaaactttttaataaactttcattcctgctctaaaatttgtcttggtctctctctttctctctctgctttatgctccttagtcaaattctttattcggaggaggcaagaatcaagtatgcttcagacctgtatggattcgccgctgctatcatactttggcactgtgacttggatatgtcacccagtgttaagacacctctatgacttgccttccttagctggatgtgttcaacccctgtacatgattttctcctcccctttcactattgtgcttactaaccaactagtagggatgattcctctcagccatagaggctctgctcctcctggctgatctctcggttcactctgatgggtggcttgtggaggaaggaagaaccctggagtctgcactaagtagacctgaggcacttatggccctctgggacaggaggcttatgagagtagtagggttaaagcctgagaccatgcaatgcctggggtttcctctgctttttcaactaaaatcagctctttcccaaaaacccacacagcctattctcctgttttctctgtgtatatttgaaatggccttgcacacctgccagacagtccacattgggaacaaatctgtctcttctctgttttaatttcacatgtaaagacacactccctgttatttgtgtgcccggggctcttgttgcatttgtgtagcagcaaagaaatagactccctttcatatgtctgttggctcattgccaggacagacactaattggaaccctaactctgccagctccttatgatttaccatatactttttgttcctgctatgccccagggccaagtttttcagtggcttttgaagcagtttttctgcctgcacagggccttactctgtagccttttaagggccctgcctacttgctttttttgaattagcacccctttgggaggagggaaaattctttctttaccatttatgagcacttaccccaatcctcaagtcctccagaagttccttctttatgtcaagagggcaaatgaacattcctctcttgaatccaacatataaaggctttccatgagtattcctcttgttttctcccacttcctcctgtagcctccgtttctctaataatgtccatgcccttttcaatatgccttgagaccttcaaggtcttattcaaagggagaggagtctagattcttgcagcagctagctgcaaaacaggcctcctgtctacttaaagaacatgggaaattgggaatctgagaaaagagacaatcattttgttgctaaaatgctctgagtgagagtcaccataaggtcatggagacaaggacataggctggcccaaggccaaaggctcaagagacccacaggacagagatgaaggctagtctgaggctaacagattaccatgagaacagagatgcaggcagggttaggggtacacaggtaagggcagtggtaagaccagtacatttcaaaaccccaaggatgaatagggggccctctgtgtgctccattgcctcctctgtaattgtggcaagatgggaccaagggtccatggtaagactggttcattccagaatcctaaagatgaatgggggctgccctgttcaggatagggaaataagagggctgcccttgttccttttccttttttttctccccttttctttctttgcacatgggtaactgtgtctccatactcaggacactccccttggatgcatccccaagaattgggaaaagtttgatttccccaaaccttaaaacaaaaaaaaactagctttcttttgtaacactgtttggcctaaaaataaactagaaggcatgagccgccgcacctggcactttgggaggccaagacaggtggatcacctgaggtcaggagtttgaggccaacctaaccaacatggagaaaccctgtctctactaaaaatacaaaattagctgggtgtggtggtgcatgcctgtaatcccagctactcgggaggctgaggcaggagaatcacttgaacctggaaggtggaggttatggtgagccaagatcgtgccattgtactccagcctggacaacaggagcaaaactccatctcaaaaataaataaataaataaataaataaacagactggaagaaaattacaaaaatcagccttagaactcgtgcccttagacaggaaatcctcaaattagcttcttcagtcttttataactgagattagaacaaggaggacagggctaaggagaaagagaaatgcaagatgcagaggcaggctcaactactggctgctttagaagttgtccggccccctccaggatgccctcagaataccctcccaggtaatggccactggtgctagaagccaggccactggaaggcaaactgccccaatggaattagtgggaaaaagccccgcacaacttgctccctctgttacaagctctgccactggaaacagtacttcccttaaggccaaagggtctccaggacagaatcccaatccttgatgtccttaagatgaagggtctctctgctctagctggcttccaaatcagacattgtcattaatgggataaagccaagggcaactctggagttgggaagtaaaatgataaatttctctcttgagttcaagggctgcctactctgtgctagtctcctctgagcaactctcctccaaatcctgttgggtaatggggcaaatggcaccccctccctctaaaagaaaaggttaacactgctttagggtaaaaatatacttcccaagatgggtacctgcttaatatttaccaacctctgaattcatctttctctctgatagccctatttctcctggaaagatacctaaatcttcaacctgcaactttaacctcgacagtcctgcctcggaggtttaaaaatagcccacaattattcagacaagctctagtgaaaatcaaactgagcaatatcttgaggaagaatagcttctacagtatgtacataacttcctcattttgctcccccttcacagaacttgcacaacaacttgcagtacaaacaacttcctcacagaaggaaaatgacttatctcattcaaaagttatcaaggtaaataagtatttctcgtaaggaagattataaataaaaatattttctatgataaaggatcttgtatggtaaattcttgtcctaaagcaaaatgactggttatttgaaaaagaaagatgttttggagaagtcagaaagtccaagcatgttgtatatgatctatgtaagtcatgagaaaattcatgaaaggaaatttatgaaagaaatgtggtaaaatttaaaggttattaggcctactaaatgcatcatgaagtgctactacgactcttaactgtacaacttgccttctttaaacctcggtaaggcctggggacatataaagctagccatgccctctagctatgctggacagagtcagaccttatcttcacttctatctggtgtcctagtcttcacacctaatacataattagaattgcctacttaccaagttttcaccaaaagtaaaagttgccaagagttaacagtgtaacatgtacttgagactactggaaaaataattttacatgcagggcatgtaaggaaattagaatgtgctttttgtaaaagattataagaatacatgggaatgtgaatttttttgcctagtttagagggttaaaggattgttttaagttagataggataaagctgaaggtttgaggaagttgtggaaggtttgtgaaagattaatcttataaaaatctgtgtgtgaacatattagctaaatttaaaggggtattattcagtttacccataaattgaacattggaataaaagtacaacattttttttgagatcactgttctgctctttaacagaaaattgtaaaagattataaaaggtttataaaaatcttatcttatggtcaaactgactaagattagatacatttgtctataaggttttactaagaattgggtttaacatccatggtgctttcatgcaaaggtacaatttggatttctttggatggtatttgtataagtgtgttactggtatgtattccaaaattatgcaaaacttctataattctgatatgacttagtatatgttatcagtaataattataattgttacagtaaattatgtgtgccacagaggtaacaaattttctatcagctgtgtctttgactgtggcttccctaggactttttgtcatccacagacagtttttgtcttgttttaatcctcttgaaaagatggttttataatcacctataggactgtaacaggtgctcttaaatgcaggatgctgataactttagagattgtgacattaaaatggagaggaaagaacttctatcactcttttggaaaactaatgtgttcataaatatcaagcaaaacaagaattaagtagccaaagtaatccttgtgtgactttttgtttaaaatattgctgatcctttgtttttcagaaagtgtattcttctaaacaaaatttggagcatatttctttctacctgagtactccaaaatttggaaactatttgtgagtattcttaacttacggcaatatagtgatttgcctaagcgcagtaagaatctgttttctttcacaacaggacacaattggagaaactggttattttaccagggctttaactggaatggcatgctttcctttaagcaatcaaatttgacttatcaagccaataaaagccccttgggaaaactggcctcatacctcatctacacagtccgtgtacagggtacctgatttgtggtaagtaaagaatgtcactttctgacaggcccaggagctccaagttatcttgggaccttgaggagagaagcttacccaactcatacatgtatttgatggcacaaacctatggctgggcttaaggctttaaaagttattatctgagatttcttatggaatgaagttccatcaaagccaatttaaaaagaaacttatatggcaaataattatttttgccgtgcttcatgcaaataatcaggccaagtgtaataagactaaagtttattttgcaaacaaatcagtctcattatgatttgtttttaataaaaatgagaatgggagagaaaaattatgtttcaagaactatagtatacctgttattagattctagtcccatcaattgttttaactttcttttttttccctgcaatttagactgaccctgtttcttactgtgaaccaaccagtgatcactggctacagcttagaagaaacaagagggatgggccatcaagctccatataatccttagtgagggataccattctctcaatattaaagatttcattgcttctaacatatacacacacaaaaatacattatatatattcctttgaaaacatcatccaggtgtattaatgctttttttatgtttagacaaataaattggctaaaaacattaatggaaaatttgggactcagagcctatactttataaaaaagcttggtatccaaaaggagagtttttcttggtaacagatacagagtagaacttctctaatgagaggcgataaatggctagcatatataatacagtaaagtcactgaagcaatgttacacatattctcctatcaatatattcaatattggagtttactacaatctatgaagggttttgtttccattgctatccaggaataactacattttgagctcaaaagtctgcagataagcttggctaaggcaatgaagctagcaggaaagtctcttatttatctgactatataagatacagaagagaggatcttttattctgaaggaaattaaaatattttaccccaaaatatattttttgacatattttgaaacagctattggttggccaccctgacagaagtggccttacaaggctgtcttaagtggggcaaatttgcatttttagagaatctccattaatgcagtcataccccctctaccttccatgcctttcctcagatctaggagagataaagagttttatacctataaaaatctgaaaagaaacatttactatctattctcactaagggagccttcatctacataacaaggccaccttgctacccaagcttcttccttcctttctctcttaacctgttgccactaaagctgatttacctgtttctggccaggctctgaggctgcattctttacatggtctcagggtggtttctgtaactcattaggtagttgggtcttcattctgaaggctcccatgtatgcatattaaataaatttgtagcccatttttctattaatcaatccacctcatgtcagcaatttttagtgaatctttaaggggctgagagcctatggcccccacaattcattctcaaatccaagtgtttcctaatgtagtttcacccacctggcatgtcctcctggatctaaaacttactcagtcttttagcatctggcatcatcagtcaaaagctttgttgtcattgatctgatattctagagaaatcatctgtaccatataatctactacttaggttttgtctttttttttccactaatgaattctcatttaaattagaaggacagtatctcatatatcttttacaccctccaatcagttcttatcacaaaactatatatatatgtagatcaaaaataaaattctaagcccctcaaccaactgaagggacccctcttctcagccaaggacattccaaagttaatttgaaaaactagttcagtgaaagagatagagacacatgaaaaaccattcaaaagatcaatgaatccacgagatttttcttgaaaaaattaatacaatagactgctagcgagaccaacaaagaaaaaaagagagatgattcaaatgaacacaatcagaaatgataagggggacatcaccactgaccccacagaaatagaaacagccatcagagactattatgaacacctttatgcacataacttagaaaatctagaagaaatggataaattcatggacacagacaccctccctagactgaaccaggaagaaaccgaatccctgaacagactcataatcagttctgactgaagtagtaataaatagcctaccaataaaaaaaagcccaggactggatggattcacagatgaattctaacagatgtacaaagaagagccagtatattcctactaaaactgttccaaaaaattaataaggagggatcctccctgaagtaggcatcaccctgataccaaaacctggcaaagatacaacaaaaaaagaaaacttcaggaaaatatccttgaagaacattgatgcaaaaatcctcaacaaaatactgaaaaatcaaatctagaagcacatcaaaaaggttatccaccacaatcaagtaggcttcatccccatgatgcaaggctggcttaacatatgcaaatcaataaatgtggttcatcatataaacagaactaaagacaaaaaccacatgattatctcaatagatgcagaaacgtcttttgataaaattcaacatccattcatgttaaaaaaaatctcaataaactaggtactgaaggaatacctcaacataataagcaacatatataataaactcatagttaacattatactgaatgggcaaaatctagaagcatttcccttgaaaaccggcacaagacaaggatgccctctctcatcactcctattcaacgtagtgttctggccagggaaatcaggcaagagagagaaataaagggcatttaaatagtaagagaagaagtcaaactatccctgcttgcagatgacatgatcctatttctagaaaaccccatagtctcagcccaaaagcctcttaagctgctaaacaacttcagcaaaatttcaggatacaaaattaatgtgcaaaaatcactagcatttctatacaccaacaacagccaagctgagagccaaatcaggaatgaattcccattcacagtagccacaaaaaaataaaatacttgggaatacagctaactagggaggtgaaagatttatataagcaaaactacaaagcactgctcaaataaatcagagatgacacaaacaaatgaaaaaacattccatgctcatggataggaaaaatcaatgtcattaaaatggtcatactctccaaagcaatttataaattcaatgctatccccattaaactaccactgacattctttgcagaactagaaaaaaaaattaaattcacatggaacaaaaaaagggcttgaacagccagccaatcctaagcaaaaagaacaaagctgaaggcatcaagctccccaacttcaaactatactacaaagctacagtaatcaaaacagcatggtgctagtacaaaacagacacatagaccaagggaacagcatagagaagtcagaaatatgaccacacacctacaagtatctgatcttctacaaacctgataaaaacaggcaatggggaaaggatactcttaaatggtgttgggataactggctagccatatgcagaagactaaaactgaacctcttccttacactatacacaaaaatcaactcaagatggattaaggatttaaatgtaaaatccaagatcataaaaaccctggaagacaacctaggcaataccattcaggacataggcacagtcaaagatttcatgatgaagatgccaaaagcaattgcaacaaaagcaaaagtagacaaatatgttctaattaaactagagagcttctgtacagcaaaaaaataaaaatgaaaaaataaaactatcaacagagtaaacagacaacctacaaaatagggaaaagtttcgcaatctatgcatctgacaaggtctaatatccagcatctacaaagaacttaaacaaatttacaagaaaaaaacaaccccattaaaaagtgggcaaaagacatgattagacacttttcaaaagaagacatatatggagccaacaagcatatgaaaaatacctcaacattactgattattagagaaatgtgaatcaaatcagaaccgtgagataccatctcacaccagtcaggatggttattattaaaaagtcaaaaaataacagatgctggcaagattgtggagaaaaaggaagacttttacactgttgggggggtgtaaattaatgtagccattgtggaggacagtgtggtaattcctcaatgacctaaggacagaaatgccattcaaccaagcaattccattactgggtatatacttaaaggaatataaatcattctaccagaaaaacacatgcatgtgaatgttcattgcagcactattcacaatagcaaagacatgcaatcaatctaaatgctcatcaatgatagactggataaagaaaatgtggtacatatacaccatggaatactatgcagccatacaaaagaatgagatcatgtcctttgcagggacgtggacggagcagggtgccattatccttagcaaattaacataggaagagaaaaccaaataccacatgctctcacttataagtgggagctaaatgatgagaacacatggacacatagtggggaacaacagacactgggccttacctgaaggtggaggttgggaggaggaagaggatcaagaaaaacaactaatgtgtacggggcttaatacctgagtgatgaaataatccatacaacagacacccatgacacaaatttacctgtgtaacaaatgggcacttgtacccctgaacttaaataaaagtaaaaaagaaagaaaggaagggaggaaaggagggagggaggaaggaaggaaggaaggaaggaaaagtagttaaagccacaatgggaagtgggagttaggggttggacatacctcattatatacttctccctttggaattcaggcacagttgaccagcgttaacattaaaacagacatcttgagactgccaaagcagactctttgtagcaataagatactaacataacccaggagagaattaactgagagtttggcattttttttttttaagtctgataagaaacttttatgacctattctctctgaaacctgctacctggaggcttcacctgcataacacaaccccttatcttaacccagacactctcttctattgattccaggtctttagataatattaataacttaaccccttcaagcaattgccaattagaaaatctttgaatccacttatgacctagaacctcctcccttcacttctagttgtcccccctttcctgaccgaatcaatgtacaccttacatgtattgacttatgtcttactacaacatataaaaccaaactgtagaccaaccaccttggttgtatggtcttaggacctcttgagactgtgccttgggccctggtcactcatatttggccagaatcaacctcaaatattttacagagtttgactgtttccattgacacacatagtgtacataatatgtattacacttatatatataaaatgatcaaagcacaccctccttctcatttagacatattccttttctctgttttgtttctcctttgcatttattaccatatggcatactatatacacactaatcttctctctttttattcaatcattgcctcctcaatgcaatatgggcttgatgaggggaggattagttctttactactgtatctctaggcttgtaatagtgacttactcagtagttgctcaataaatattgaatgaatgaataaataatacactttgtgttttggcataaattttaaactatattataatgttacatatgtttatgtacgtaggcatatttatgcatattatatataatgatatatactatatattaatgtcatatatttttccatatatttacatttggaaaccataactttagtcttctgattttgtgatatttaatataccaacaatatcatgaactgatttagatgtttagattatttttggatattaataaacatgatgcataactatgcatttttaacgcataaaatatgctttatagtatacattattgtataaaaatgtttttacatttgtagtgactatgtaatacctaataaataatagaaatgaagagaaatcattatttttggaatcatagggacctgaagagaagcagctaggttagccggttcttgctctgtactgccatctgctgtgtgttggtaaaactacagtgaacatgtcaaatgtgtaaaagccaggaactggggagcaccttagaaaacatccaatccgatgtccacgcgtacaggtgaggaaacagagacaacagaaattaagtgacttgcaggcttgttgtctctctgattattagtagagcttaatgtggaagaagtgctgcttagtggcaaggctaggagttctggagtcagataggcttactttagtattttgctacatggccttcattgagttacttagccttctcagtttcaatgtccttttggggttagagctatttacattttatgattgctctgagagtatatagatagatattacctggcatgcagcacaatcatgactgtgcttaagaaatggtaattatttttatcctactaaagtgtaagttcttccacagcaaaggcattttttccttgaaattctcagtgatataaagtattcaaagcacttggttcatagtcagtacttaataagtatttcttgattaagtgaatgagagtaaggatgagaattggggtccctcacatatcattgtaaattacattgaaaatcatgccttggggattgatgattctttgttgtaaagtgcaagtcatactgactgatacggtttggatgtgtcgtcacaaaatctcatgtcaaattgtaatccccgatgttgaaggtggggcctggtgggaggtgattagatcatggaggcaggtttctaatgaatggtttggcaccatcccccttggtattgtcctcgagacagtggatgacttttcgtgaaatctgcgttttaaaagtgtgtggcacctcccccatgctctcgcttgctcttgctctggccatgtgacatgcccactgcctcttcaccttctgccatgattgtaagtttcctgaggcttccccagaagctgagcagatgccagcatcacgcttcccataccgtttgcagaacgtgagccaattaaacctctttttaaaataaattacccagtctcaggtatttcttcacagcaatgtgacaacggactaatacactggccaatttatctcttcatttgtttctcatgaggtgccctaatctgtgactatgttagcatgtttaatgcaaatcaaaatttctagttctcacattttagaatagttatcttcactacttttaattcaaactgagacaacagacaaaggcttaatccatattttctttttctttctttcttttttttttttgagacagggtcttgctctgtcgtctaggctggagtgcagtggtatgatctcatctcactgaaacctccacctcctgggttcaagcaattctcttgccttggcctcctgcgtagcagggattacaggtacctgccattacgcctggctaatttttgtatttttagtagagatagggtttcatcatgttggctacgttggtcctgaactcttgacctcaggtcatctgcccacctcagcctcccaaagtgctgggattacaagcatgagtcaccgcatctggcctaattctgcattttctacccaacttttttcacaacagctaaatactagagttttttggtacctccacagaaatcttttttttatgattaatcaacctctggattcagagtccagagtgctcactattacaccacggaaactcacactgattaatcaacatctgaaaagagaatatcggttttggaaaattcaagtaaaaagaagttatataaaagttacttataaaagtatattttttttgcataaggttttcccatatatgataactataaaacagttcttcattttccaagatctatgctaagagaaacagcagtcagaaaagcaactctctttattttattaattaattatgtattaatataagataaaatagaattcatggcaaggagccttaaacagggctaaaagaagcatttccatatggataaaaaggttggatccacaaagatataataatcataaacgtaaacaagaaagagctctttaattatatgaagtaaaaacaatacgtataagaagttaaaagtcgtgttgagagaatttaatacatgcctctcagaaatctatcatattctattaaaaaataaaaaagtgagtattaattcattatttctcagattttagtggacataagaatcatcagaaactggccccatctcaaaagctggtgctgtcttaaggcaacctttattttcatctctactcaactgagatttgcttctttggagcccctagtaacttatgagaaatgtgatttttcaatcagagataatctaagcaaatgtaggagacagagtaaataattatttttgtctattcaagatatttacatgttcactattatatataattctataactatgaaataaatatttgacttatttccttagaattgatttttagaaatgggaaaatataaatttaaaagctaaaactttatataaagatatacatgtgtgtgtgtgtgtgtattcaaatatttaactaaaatatttattgaaaaacccaaattattgagaaatctgtggtctggattggaatctttctttgggaaaattaaatattaatataaccaacttttcataggaaataataatatgcacatcaaaatgataaatgtaattatcttaagttctgctcggtgatcgatttgctattcaaaatgctttataatttcctttaatgatttcaagcacaactaaccaaatctccgacttcccagggcagtgccctctcccacagttcccaagaaacatttgtcagcgtcgtctcaggaaaactacacagccatcaccgcattctaaggtagaattacctctaataatagtcccattatattagtgcttactctttcacaatgtacgataatgacactattctgaaatcccttactgcaagaaaagtttgtctctgacattgtaataggtccaaaaggatgggtctggttgtctgaattgtctcgaaggagaggtggaagagacaatgagagccttcttacttgcagcctgtcattatgattttctaactctgttcaaatacccattcatcattacagagagaatttcaactttgttaattcaaagttcccattgttcctaagtatattgcagccccctcagagctgtacttcaagagaggagtttcagttagacttatggtcactttccccactgaaaagtacttttaaaatacagaatataatgaatgtgctcatatatgtgtgtctaaattttaattatctcttggttcctgtggctgccttgtagaggctgaggacatatgctgtgtgtgtctgtgttggaggccgcagtactgctaatggtgaatattaaacaggtagcatcggttctgtgtagatgttaagcagtataaagcaaaaacttggagtctatgtttttctgaagactttctcttagaagaattactttaaggagcccagataatttaggggcacaaaaaaagaccttcgctgcatttttagttgaaatctgacttcactggtaatgatgaaacttttttttttttcatagattgagattggcttctcttagatgtgatgtgtcctaaatagtcaatgtatcagtcctattagaaatcagtctttcatcttcattttcatcagcatcatcattttcattatcatcatcatcatcatgatcaacatcatcatcattttcaacatcattatcttttttttttttttgagacggagtcatctctgttgcccaggctggagtgcagtggtgcaatcttggctcactgcaacctccacctccgggtttcaagtgattcttctgcctcagcctccagagtagctggaattatggctgcatgccactgcacgcagctaatttttgtatttttagtagagccagggttttgccatgttggccacgctggtcttgaactcctgacctcaagtgatccacccacctcggcctcccaaagtgctgggattacaggtgtgagccaccaagccagaccttcattatcttttgtaaccacttttaatgttatgagttatagataagtattaactcaactatctcaacagcctcatgaagaaggtattattattacaccttgatttgacagataaagagacaaaggcaagataatttaagtaagttgcatagggtcccggagttagtaatgttggagtaagaacgtggacttcagagtaagtctacttggatttagaatctggactccccattacaaacagtgtgactgcatgcaagctcatcttccctgactcttagtttcctcaactgaaacagtggcacataatcatggacacacaccaaggagattaagatgggatgggaaagaggagaagtataaactgtggaaagaaaagagcttagaaaaacgggatgacatcagcctgcttactaggcttcctcccttacatctgtgctgttacctgtagaagtctgagtaaccaggctcttaactcataaccaattttttgaaaaagagcagggcttcgtaaatcccagtttctcatgcaaaatagactctaaggtaaaaatctacgcaagccctagcacacacagctgtttatctaagaggaaaatggaattaggagttcacactttagtaagaagagaactaagatattaaaatgctctatcaacagcacgttcttccagagagtacatgaattcattttaatcttctggctttacattttcaaatcagggaagtcaccttcaggcagtgctatcggaggataatgaagggggaaaaaagaggtagaagcatatctaagagttctgataaaagtggtttaatgcataaatcaaagtgaccttattttaatgttaggcagaaataaataagcagaggttctttacctacaaaaaactaagtggatagaaacttgattaatttccaatgaatgttttttaaaaaataaattagctgctcaataagaaatagaaaaaaatttgacactgataggagaagatatttagatatcatcaccctattttggagatccttagtcaaatgagtcaatgaaagtcagattattcatagtaaagctttgtttagctaactatttaaactctgataatttaaataccacaaacaaccaattaagactttttaaaatagataaaatgaaaataaaaggaatgaaacaaggtcaatattttcaacaaaaagcatgaagtgaagatgaagacattggagaacattcttcatagcctatatatgagcagataaccttattcatagggatagatggttttgaagaaaataagtgaaattcatctttctccacaatactttataaagcttgacatactcaagacatatgcatacagtagatgaaaatgttttatgtagaataaagaccaataaactaggaggcgatataaatggattctagacttagttctactaactacctaaacttgggtaagtatattcatgtctttgtgcatcagtaaatttttttggcatagattattggatggatatattatttcttaggttctacctctcatactctagctagacacactattttgattatacatcatctaagggcttgaaggagtgcagcaaggttctctcacttaaattttcataaaaatgaaaatttttagaaggaaatgagggagggagaatctattattgcagaaataattgttttatatttctagattttctgtaatttcagcatgacccctagaaactcattttaatgttaatcttaaatttggaaggcaaatcaattgccaaaagcttaacaatgttaatataaagaatttaaaaatcgttcagccacttatgtcatcatgccaactgccttttctacccaggtccaatgagtttttgttgctgtttttgttgttgttaacattttatttatggtgtcaaatcatagctcatctacgatcatacagtttaaccaataccgtaaactcctaaatgaacaaacacaacatgcagttttctgaagacctcagataaagaccgattgtaatctcaaacttgttctttcttgtcccaaaaatgtaaatgtaagttttcactggagaatgaatacatctcatactggaatacagtcagcactcagaaagtgtttactgaagaaatggatgaatcaccatgcctaacacacacaggacaaatcagaatattaaaacttccagattctagtaaagaaactttgtttcttgcttgcaacactttcctttttccattaatctaaacttttgaaggtcaaagcttttgtctcattagttttcttgacagtaaaatgacttatgccttttctactttagaaccactgaaattcaccaataggattttcctcttgtttacttcatgggggcagccacttgacattaaaatgcttttttagcatcattacattttttaagaaatcagtggcaacagtttctccagatatgcattcttatttcaatgctatcttgtgctggtgagtaacagcaagaaatcttcaaacactttaatacgatagctagttctattcttctgagttgtgactgggtcaacctttctctacagtgtaaaaagaaatagggagaaagcaaatataacactttctctttcttttcttagacccaacaaaattttaaaaaatcatgcaaccaactggaagagaaataaatggtatatccaataactagagaatattttagctactgtaccccatttgaaagcacccatatttccctacagctacatttacataggaaaaatgtggttgggtcccaattagtttgattatttaagtcacaggtgcactgtgcctaaaatatggatggtcaacatttagtgacaagacctcattgaacaaaacttagagacagctggttttgtctggcattattaggctagaaaacaacaacaggcagagaatgctatttaattatctagagcgtaagtattaataataacaataagtgagacaacaatacattcaactttggtatttctttccaacaaggcaagcactgtttctcgttatagagttgttctttgttcacttgtatttaaatacgacatgagtttattgctttacaagagaaatgctgattatttaaagaagaatctaaagttgttgttgttgttttatcagaatctgttgtctgaaattgaatcatggagcttattgtcagtcctggatccgctatagctctagggctcttttgcagttaactcttggtcgctctccctctccctctccctttctcgctctctgtctgccaatgcctattgcatttcctcaaaaataagtatacaactcattgaagtgaggccacacagtttggaaatgcagaagagagagctgaaacttcatttattggttctcagctcagtttagtttcctcccaatgtgctgtttttcttttctccttaaaaacacaccatatattttatttaaaaaaattatatgccatggaaagagcttattgtagcaagtacatttgattaaatctggcataaacttgctagaactgagttaaacacaggtagaataaaagcttcttctaccaaggcattcaaaacctaatccacaccttttaagtacaggaactatatttttatgtatggaattgactaaaattagatattgataagcaaagtagagaaaaataaatgaaaatccctaatgcaaaagaattacattttggaaaataaagggtttgcatcctatatttggaggcaaactagcatttaggatcattactaaagcctagggtctagtgctttgatttaaatactttaatctcatcattatataaactgttttcccatttttctcacaacactctgttttctttctttatagtattattattattatttttcttgaggcagcatcttgctctgttgcccagactggagtgcagtggcgtgatctcggctcactgcaacctccacctccagggttcaagcgattcccctgcctcaacctcccgagtagctgggattacaggtgcataccaccacacctggctaatttttatatttttagtagagacagagtttcaccatgttggccaggctggttttgaactcctgacctcaagtgatccacctgcctcggcctcccaaagttgctgggattacaggcgtaaaccacggtgcctggcctctttatagtatttatcaccatttgttattatatgttaagtacttgttggctcaatgtttgttacttcgcaaggctgagctctactagagcagggacctgttctgctcagagaagggttccagtgtgcatcagtcgagttaatttataaatgaatgaccttcactctatgctacccaaagggtcatggttaaacaatcagatcttgtcctttcagtattttatcatctaaatgcatagttaatataaatacattaaggaaaggagattcaacaaacaagtaaaatacccagtgatttttttggtgacaccaatttaaaaggtgttaactctaagtagagaagagccatacttgaaatcaattttcactttcatgtttaacttcctaaatcttgaagtgatactaggagaaacagccatttaggagttgctattgtttggatatggtttgtttgtccccaccaaacctcctactgaaatttggtccccagtgtcagaggtggtgctcagtggaaggtgtctgggccatgggggtggaaccacatgaatagattaatgccctccttgtggcggagggcaggggtggggagctgtgagtgacttctcactctattagttcctataagagttgattgttaaaagatcctcctgcccgcctgacccaccctgcttcctctcttgctgtgtgatctctgcatattactggcttctctccccctctgccacaagcagaagcagcctgtggccatcaccagatgcagatgcccaatcttgaactttcccagatattagaattatgggtaaaataaactgttttaaaaataaattacctagcctcagggattcctttatagcaacaccagatggattaagacaggagtatacaggccccaaatccctatgtaaatttaaacaaactattaggaaatctttgcatgtcatttaagcattctgtgaaggaaggcactcggtactcaagagctctgaaccatagaaagtgccagtttgcttcataggaatttaaacaggctgtgtaaataggcagaatgctgaagcctctggtggaatatggcctagacaatggggaccagtctgactgctgtggaaaatgtcatggggtttacaaggttaagagtttttttctattcattgtaaacgacagatactccatgggtaaaggggacctcttctcagggaaataagttactaaagctttagagttttagcagagttacaatgggatcgaatctttactatcttcatacatatccttctagaaagattattctgtacaactgataacagtaacactaaaatattgagagacttaagcacctacaatcaataactgagacaggcaggaccacattggaacagccaatgtgactcagaaaacccttgacacattttcaagcttttggaagttacacacatttatatttaaatagaaatcaccgaatagatggccaagtgtaagacaaatgaccataaagcacacagagaatctccggcgagggacctaggaatggacgtttttaatagctctccatggttactcttgaaatgagtgctaacaaagtgcagagcagctgaaagaatcaatgtgaaattaggcactagacacttcacacatcagacaaaattaaatcctcaaaacctccattgtttagataaaaaatgaacaaagaggttccataaactcatatatcagtgtgagtgctacagttttacaaaacactggtcatctatctaacttactctgaagtaactttacacgatctggaaacctggtattcaatcatgtttcttgggtgggagaatgcaggtttcaagggaggaagacgggaggtatgaatggatatatcaatgagtccatgtttccttgaaacttgaggattcttaagtgaaacatggtttgccaatctcaggcttatagccctgtgataatgataaaaagaccacagattcagtccccattatggactagttagcatttttttttctattttatggccacagtttacattcccaaactttgactgttttacaaatagatactcttgttcataacccttagatgaagaagtgtggtttgatgaagaaaaaaccattatcattggcagaagacacctgaagtccagcccacgctggtggtgggtgatcagagcacggacttcccacataaatttaaggatagcccagcatagatggggcaggcctaagctgctggcctcattaggcatatgctgtccactcagcatccattggcttgtggagagctggggacaaggagagacagaaaagcaatgtgagcaattcaccattgcaaagtgcccatcagccaatgagtagataaagaaaatgtcacacacacacacacacacacacacacacacacacacacacacacacaccatggaatactagtcagcatacaaagaataaaataatatctttttcagcaatttggatggagttggaggctattattctaagcaaagtaactcaggaatggaaaaccaaataccctgtattctcacttataagtaggagctaagctatgggtacacaaaggcatagcgagtggcataatgggcactggagactcagaagtggggagggtgggagaaggtaagagataaaaaactacctgttgggtacagcgtacactgcttgggtgacaggtgcaccacaatctcagacttcacctctatgcagttcattcatgtgaccaaaaaccatgtgtacaccaaaagctattgaaattaaatatatatatatatatatatataaaagaaaatcagtgtgtgtatgtggagggtaagttcttcccatagatacaaccccagtgaccacttcaggtttgcttttctccagattcaggatctggtgcttgagttaagggggaaaaatcctgcttacatcctaggagtagcaatagacttgccttgtcaaggagagagaaaagaagcagaaagcaagctcttccttatacattcggggtcttactaaatcactcatctttcatctattcccacatgattagatagatgttatatgggtgtggctgtctaactttaacatggataagaatcactagcttgttaacagtgaaatttctgggtttcatcccagagtctgacatctagcttgatgacgtctagtgaaagagctatgttcctatttaccaagaatatgaagtgagggaaggaacaacagattcagagttctttatgcctaaaaatagacatattgcagtgctttcctttataaaatttgcttctggggaaccatgatttaatgttaaattttatttcactgtgctacactatgggtcttaatgaaattttatcagtgataactaataaatcatttcttaatgataacgctatcattttattaatgataaagttaaatataaattaaagaaatgagcaggaccttttagaatgtttgtttttcttattttctgttggagaaaataaaaatatttcaccccaaaatatagttctttgacatatttcaaaatggctattcaggaagggctggaaacatgataatagctgcaaagctctctgttgggcagagatctgcatctgtagagaatctgcattgatgcagccaggctttctctgaggccttgtttggatctaggaaaagattaacagagtctgatacctttaaaggtctaaaagaaacatttaccatctcttctttctgcgggctgctccctgggaagtttcatctatagaacaagaccccctttgctagccaggcctcctcttctctccctcccataacctgtcttgccgcgataacccgatttactactataggctgtttttgctcatcctgtgagccaccattctttctgtaacctcaaggtgatatataagcttctgagccccatgaggggaattcatcaccctgttgttctccccgatgcatgttaatagatttgaatgccctttttttttttttttgagatgaagttttgctcttgtagcccaggctggagtgcaatggcgcaatcttggctcactgcaacctccgcctccctggttcaagtgattctcctgcctcagcctcccgagtagctgggattacaggcatgcaccaccacgcccagataatttttgtatttttagaagagatggggtttcccgtgttggccaggctggtctcgaactcctgacctcaggtgatccacccgcctcagcctcccaaagtgttgggattagaagtgtgagccactgtgcccagctgaatgccttttcttttaaaaaattaatctgccttggagaattgcttgaacccaggcggcggaggttgtggtgagccgagattgtgccattgcactccagcctgggcaaaaggagtgaaactccgtctcaggaaaaaaaaaaaaaagtaatctgcctttgtcagttgaccttccaacaaaccttcagaggggccaagtgaaaaagaggaattttcttatacttcttactctgtttgtataagactcctatagtgtgcctcctgttggggctcagaaactgataccccaaaatatggtgctttgacatgctgaactgaagaagtcacaaggtctctctgacccatccctcacccacctttcaatcctctctctctcgcaaagtaagggatgaagttgtctcatctgcttatagtccagacctgccaaagaagccaacaattaccttgatcccttccctgagttttcattaacttaactcatattggaggaagaaagactgaagtctgtcaatgcaccaggacaaacttgtcatcaaccattgccttctgttttggtcccatttggtattttaaagagaatcatttagcagctgttgtctgctctgtgggcccaacagactttgtcccaggccattgtatattcttcaagtccagtcatttttccctaaaaatcatttactatgctcctaaaatcattcacactttcccatttcccttttccttaagaagaagggtatagaggcctggctcagtggctcacacctgtaatcccagcactatgggaggctgaggtgggcggatcacctgaggtcagatgtttgagaccagcctggccaacatggtgaaatactgtctctattaaaaatacaaaaaggctgggtgcagtggctcacacctgtactcctagcaccttgggaggctaaggcgagtggattgcctgagctcaggagttcaagaccagcctgggcaaaatggtgaaatcctgcctctactaaaatacaaaaaaattagctgggcgtggcagtgtatgcctgtaatcccagttacttgggaggctgaggcaggagaattccttgaacctgggagggggaggttgcagtgagccgagattgcaccattgcactccagcctgggcgacagaacaagactccatctcaaaaaaaaaaaaaaaaaaaatttgccagacatggtggcgcacacctgtaatcccagctactcgggaggctgaggcccaagaatcacttgaacctgggaggcagaggttgcagtgagttgagattgtgccactgcactccagtctgggtgacagagtgagactttgtctcaaaaaaaaaaaaaaaaaaaaaaaagaagggtgtataaccatcagtaccccattccatggtgggggtaatcattcagcgatccacccaccatgcatgctagtaaatttgcatatcttttctcctattaacctgcctttttgagctgatttttcagtaacccttaggatgaaggggaagttttcctttggcccctacactccatttttgcagatagggaaactgagggactgacaggttaagtaagttgtgaaattcaggcaactggtgtcagaacaagaaagattccagttgaggtctgtctggcttctttgctaaggctggcttcattgacgtgccgctgctcagtcacatggggccccatgtgtttgctgtaatgcacatggaccccaagcttggtttaatgctctgctgtagctaccctgaaatccttaacaatttttgagtaagggtccccgccttttcattttgcacggggccttgctagttatgtagctcccttcactgccatggccgtttcaggctatgatcccccaaaggtttcaaactcaaaagtcagaaattctgatcatttctgctaatgaagagataaatatacatgtgattcctactattggtagggggtagagtagaaagttgttcaaagaaggaacaccccaattattccacataagtgtttgtaaggattaatgcactaacagggatttgatcttataaattctgctgttttggtttttgaccaaatgactttaattttgttttgttttgtaatattttgttttaatttctgctggttacattagggacaaagcacttctacttcattctcatcttcctctttctataaaaacagtgtgtctttttctttattataaaagtaatgaatgtttcctgcagaaaatatgaaaaaaattacatgtaattaaccaagtagagaaaacattttggtacatatcattttaaagtacatttatatatgcgtcagtatatatttttatttctactgatatctatcaactctctaattggaatcatagtgaagccattcttacatggttaccaagaatttggacagaaatataatgaagcattaatcatgctgtactttgatccatttccttgttgctgaaagttacttcgtgaaactagaaaagttcccttttcctccgtgcagggcatgtgatggggtgtggcttgcttctttcgtgccctagagttaaaattcctagggggagcatgcagatgagcaggtcatggggagcgtgggctctgaccccatggtagcatctagggttgagtgttgacagctcccgaggccccagtaggcaagtgttacagggtgctctttcagcttggccgtcagcaggtggcttatgttaattagctcaatgagaccctctgccttatctctaggacagagggctttctgtttcccggggttcttgccttagtgtactggaaaaatcggatcacacgggggcttggagaatgagtgcaaggttttattgagtggtggaagtagctccagaagatggatgggagccagaagcgggatggagtgggaacaatctcccaaaacccttaaaaatcctagcccccaaactcctcaaaaagatggacttgaggtttcctcccatctcctgtttgagcagccctgtgattaaacttccttctctgctgcaacctggtgtcttagcataatgacttgcagcacgcagtggttatagtagcattcacgatttgaatttgaatcctgtaggtttttctcttttaatttaactatactaaggattttccttataggaaaaatgattgtttaccataactcatttaacaatctttccattgttaaaaatttagatttgttttcgacagggctcagaacaagggccagataatagcctcttggcatacttaatattttaagctgaaagaatttgagaaaagcacagaagcaggaaagtctctctgaccttctcctacccctttctctttctctcctatgaccctcgtgtgaaaggtgtccaccctatacccacaggacaggagcatcgttatctctaagactcagggacacagaagaatctgcacaaacaggccttgctcagttccctccagtttattgccatgagatcattctccctttgtctaatcttacttctccacgattatctacttatttaccaaacttagcataaaaatacatggggttacttatttctttgggctttcatttcctgataaagactcccatgtcatgcaacacttattaaatatattagcatgcttttctcctatcaatctgtctttgtcagtttgatttttagacccagccaagggaccctaggaagagtgaaggaaagcctttcctcccctacattttattctgtttaagttttgttgtttatgattgactctaaatcaaagagagcatgctgcaaggagcaggcatcgtccaggatggttaatggggaagacatcacacactcaaaactgcagactgcaagtctatgaaccagggaggttttctgtacttctgtggcatgaaaatagaatggattattctatattattttatatataccaaaagaaaatgaccgaggcaggacaggcagtcttggtgcaactgaatggtagaattaagtgggtaaataaaaaaggtaaggggaaatactatttgcagaatctaattgtcagcctttttaaaaaatcaggaagctaattatttactgcacagacaagtcaccaaggcagaaaaaaaatgtgggtggtcttggggtttgattatttctaccaagcagtgattatatgcattagcatctgattcacttacatgctaatatcttcactgaggaatctgcttccttttcagcaaaacctgcttaagttttcagcaaaacctgcttaagtcagaagtttgttacctaggaagcctttattcccttcttaccacaggagaaactttctttacattttgggcaagactaagtttagatctagtctacatccagagttgtcacacagtatttttagaaatagactggactgacccagggaaaggaaatactttgagagcaaaaccttctaactgccaatatctgttttacaaactttacaagtctgtgttcctttgatgcagcttccaaatcacaggacttcttgttgacaactcaccctgcttgagttccgtctttgtcccagaaggaaacaaaatgtatttttcccctttaaacacagaggaatttctttagataacctcagaacacaattatccggtccagtcaaacaatctgaagttatagttctgctgctgtctctgacctaactccctcttcttccaatgtttcacagctctttctattttcatttccttttgatttttcaattatctctattttgcttactgtgggaacttcttttgaaagtgattattgactttgctctcaacttggtttgacttaataaattggtaacataaataagacctaaactgggcagaaacagaaaaagaggttgttcgtgtcaaataactacctttcatgtatttgaaaggtgaagattatagaatgtccaactctgcttctttctggtgtggggacaatctgagctgtgataaagttttgacatgggaacagagcaggataagcatgtggtaggacgggagtggggtgatgaaggactttgggaagctgctggatcaaatttgagaaaaagaaggttcaaaaggcatcccaaaagagcactaaagctggtttagatttagtcattcaattgctcccctcgtcttcattacctctgtgtaaagacctaataacaaagtatgaaaaaaactgtgctctaaaccggaaggtgctaaataaaaacggcattattactaattactttagctaactaagttgactgaaaacttattcaattcacatcagcatataatgctataaattttcctacaagcactgctttagctgtgtctcccacaagtttcgatatgttgtgttctcattttaattccactgaaaatgatttttaaattcccattgtgactttttaatgggttactcagcactgtgttatttaattttaagatattaggaaatttttctgtttttgtttttttaatccgatttaattccatcgtggtctgagactataccttgtatgtttctaattcttttaaatttgttgaagtttgttttatagcctacaatatgatctctcttggtgaatgctccatatgcacttaaaaagaatgtatattctttttaagtcaggtcaagtttgttgattgtgttgttaagttctatatccttattgattttctttctactagttctattacttactgagagagaagtgttaaaatttccattataattgtggatttgtttatatctccttttagttctattagtttttgctttatgtgttttgaagatgtgttgttaggtgcatacacatcattatttaatactcttctgcatcttcattaatattttagttctgaagtctaccttgtctgagatatatatatatacacaaacacatatatatatacacacacttatatatacatatatgtatatatgtatatatgtgctatatatatatacacacacacattctgagacatatatatatctcagaagaaggttgtttctgccaaattcatttatttgaaaggtggagattatcgaatgctccagtggttatatatatgttgggaacaggcccccaaatctgtccataaactggccccaaaactggccataaacaaaatctctgcagcactgtgacatgcttatgatggccttgatgcccacaacaggtttaccagaatgagggcaaggaacacctggcccacccagggcggaaaactgcttaaggtgttcttaaaccacaaacaatagcatgagcgatctgtgccttaaggacatgctcctactgcagataactagccagacccatccctttatttcagcccatccctttatttcctgtaaggaatacttttagtaaatcttatgactggcttgctgtcaataaatatgtgggtaaatctctgttcaaggctctcagctctgaaggctgtgagacccctgatttcccactccacaactctatatttctgcatgtgtgtctttaattcctctagtgccactgggttagggtctccatgacagagctggtcttggcatatatatttcttttaattaacatttacatggtgtatttttttacatttatatgctatatatatttaaatgacatatatacatattttcatccttttactcttaacctagttctttattttaaaatgggtttcatgtgaactgtgtagttgggctttgctttgtttgagttgacatgatctgtcttgatttgttatgttgagaccattgacatctgtgtcactgctatgtttagactaaaatctaacatctggctagctgtcttctatttgttctgtttgttaatctttcccctttccctctttttctgtttttttaattaaataatttttatcattctatttttcctcaactattgatctcttgtttatgtttcttaaacatttatttttttcctatagaaaacatttcctattttaattttaaattaaattaaattttaaatatggattttttcctattgcatttatgatatactttcatcattatttgtagtttatccttgaataattttattctgctttatatataaggtaggagtctcacaccaatatacttccagtgtttctctctgatcttttgtgctgctgttgtcaaaaattttacctttacatatgctataaaccagcaacacaatgctactacttttcctttagacagtcaactatctcatagcatgactaaacattaagaaaggagtctttttatttaccctcacataattttcctttgtgtgtgtgtgtgtgtgtgtgtgtctgtatacatttacaaacatacatatcttcaactttcccatttctttttgaggatccaagtttctgttatagattgtttctgcctaatgagtgcctttaaccattcttgtagcactgtctgctggcagtaaattctcttacctttcatttgtttgaaaaagttattatttgctgtggttttgggaggtttttaacctgaattctgagttgatttttttcctccagccgtctgaagatgtcaaaccatatgattatctcaatagacacggaaaaggcctttaataaaattcaacattccttcatgttaaaaaaactctcaataaactaggtatggaagggacatatctcaaaataacaagagccatttatgacaaacccacagccaatatcatactgaatgggcaaaagctggaagcattccccttgaaaactggcacaagacaaggatgccctctctcaccactcctattcaacatagtgttggaagttttggccagcgcaagcaggcaagagaaagcaataaagcgtatttaaataggaagagaagaagtcaaactgcctctgtttgcagataacatgatcctatatctagaaaaccccatcatctcagccctaaagctccttaagctgataagcaacttcagcaaagtctcaggatacaaaatcaatgtgcaaaaatctcaagcattcctatacaccaacaatagacaaacagagagccaaatcatgaatgaactcacattcgcaaatgctacaaagagaataaaatacctaggaatacaacttacaagggatgtgaaggatctcttcgaggacaactacaaatcactcctcaaggaaataaaagaggacagaaacaaatggaaaaacattccatgctcatggataggaagaataaatattgtgaaaatggccatactgcccaaagtaatttacagattcaatgctattcccttaaactaccattgacattcttcgtagaattacaaaaaactactttaaaattcatatggaaccaaaaaagggcccatatagccaagacaatcctaagcaaaaaaaacaaagctgaagccatcccaccatctgatttcaaactctgctacaaggctacagtaaccaaacagcatggtactggtatcaaaactgacacatagaccaatggaacagaaataataccacacatttacaaacgtctgatcttcaacaaacctgacaaaaacaagcaatggagaaaggattctttatttaataaatggtgctgggaaaactggctagccatatgtagaaaattgaaaccggacctcttcctggccgggcacggtggctcacgcctgtagtcccagcactttgggaggccgaggcgggcggatcacgaggtcaggagatcgagaccatcctggctaacacggtgaaaccccgtctctactaaaaacacaaaaaattagccaggtgcggtggcgggctcctgtggtctcagctactcaggagactgaggcaggagaatggcgtgaacccgggaggcggagtttgcagtgagccaagatcgcgccgctgcactccagcctgggtgatagagggggactccgtctaaaaaaaaagaaagaaactggaccccttccttacatcttaaacaaaaattaactcaagatagattaaagacttaaatgtaaatcccaaactataaaaaccttggaagaaaatgtaggcaatactattcaggacataggcacgggcaagtatttcatgacaaaaacatcaaaagcaattgcaacaaaagcaaaaattgacaaatgggacctaattaaactaaagagctttggcacaacaaaagaaactatcatcagagtgaacagacaacctatggaatgggagaaaatttttgcaatctattcatctgacaaaggtctaatatccagaatctacaaggaacttaaacacatttacaagaaaaaaaccaccccatcaaaaagcgggcaaaggacatgtacagacacttcttcaaagaagacatttacgtagctaacaaacatatgaaaagaagctcaacatccctgttcattagagaaatgcaaattaaaaccgcaatgagataccatctcatgccagttagaatggcaattattaaaaagtcaagaaacaatagacgctggcaaagctgtgaagaaataggaacgcttttacaccactggtgggaatgtaaattactttaatcactgtggaaaagtgtggcgatttctcaaagatctagaaccagaaataccatctgacccagcaatcccatcactgggtatatacccaaaggaatatgaatcattctatcataaagacacatgcacatgtatgttcatggcagcgctattcacaatagcaaagacatggaatcaatccaaatgtccatcaacgatagaccggataaagaaaatgtggtacatatacaccatggaatactatgcagccataaaaaagaatgagaccacatcctttgcagggacatggatggagctgggagtccttatcctcagcaaactaacacaagaacagaaaagcaaacactgcgtgttctcattcaaaagtgggagctgaacaatgagaacacatggacacagggaggggaacaacatatactggggcctattgttggggtgggggtagggagagcatcaggacaaatagctaatgcatgcagggcttaatacctaggtgatgggttgataggttcaataacctacagtggctcatgtttgcctatgtaacaaacctgcatgttctgcacatgtatcccagaaataaaatgaaatgaaataaaataaaataaaattctcatctttattcttctgaatctaagatgtctgatctttggacttcagctatttgaatatggtgtgtaggtgtgtggatttctttttctatttatattctttgaggttttatgagtgtattggattcttgctttgattctttcattatatttggaaaattctcaacaattccatcttaaaatacttctaccttattttctctttatattctgtctcacatttcaattatacatatattcaatcatttgatattgtttaacagctcttcaatactctgttctgtcttcatctccttttttactcttttctttcaggtgggtaatatctattgacctattaagttcattgattctttccacgactgtgctgactctactgataagcccatcaaggacactgttcatgtttgttgctgtttctttttcatagcatttccaattgattttttgttacagtcaacatctctctgtgaaattccgtatctgttcaggactgttactcagcttttccaatggatcctttaacatattaaacatggtcattttaacttctctgcttgatagttccaatatctaggtcatatttgagtctagttgataattttgcctcttgatcatgtttttttttttccacatgcttttttgtacatctcataattttttaatgaatcacaaatatcaaggataggacagtatgggctaagataaatagtatctatgtctggaaacggcacacttcttttagtaggcctacagtgctggagttggtcaatctagttagaagttgagctgggtttgggttttgttattgctatggttaacctcagtatattactagcttcaaattcctctagtgctaccttgtgtgtaggtgggggctatggtatcaaagggcgtgtctcaatgtccctgctccaccctcagctttctgctttctttgagtgtctgcaacacacagggagctcttccttgctctccccactcagaagtagagtgccattgcttgttacctggtgcttataaggccgacgggagtggagcagcgaagaggttttccattgtcctggccccccaatagtcttagggaggccctgtgtgtctggatcttaggagtggggcttgctctgtgatcctgcccctcctcccagtgtcaaccaaattctgccttgcatctggtagatctcccatgagagatggtttctcgtccatccccttgtggtaggagacatctaatggtattggtgtaggatctcggacttaggactcttttgtacccctcacccaggtatggagattgttttttttccttgtattctttccttaaccaaaatgggtcatacttgtgcctaggggcagcacgatttgctgctccttctctatcggcttaaggcttttgttccataacaggggcaggccagatggtgcttaatatttttcctgaagtggcccatcctccaggctcacaccacctagagaggctctgtcctgtctccagctctgtccttgatccttctcgtgggcacccagtaaaggtctgtggaaaagagcctgtgactgggtaggagttccctttgtgcctgcagcttctggggttctgcacccacacactagcctacacttggcctttagcaatttgttaaaaggtttagctgatttcttcttttaactgtatggagcctgatgcctcttcctccagtgctcacaacccacatcgtcctggaggagcttgtctttcttaggatttcaggctacttgtttacgtgtgacctcagctctttgatgggtttaagaacatttatgacatggtagtttatcttgcttttccttagccttggtggaagtggcaatttgttcaattatatgtattgtatgtgtatgtatgtatgtatgtgcatgcaatgtggttgatgtttcctttcaaaaacacagcttagaaaagtgaaggctacattacaactattgaataagaatattttaaggaagaaaacagggataattaaaaaaaggaaaaacccaatgtgactctatctaggctttgagctttttcccagtaacgggaagaaggaaataggaatttcttaatgttctttatctgaactaggttctgtggggaaccagagggaccaaatgctgatttaacattggaaaccagatgagaatatgggaagcctactagtctcttaaaaatatttaagaagtggattttgcgttttgtctgaaaggaagaattcctcatttggacaagaaggttatttcataagtgcatatgaaaacaaaagttaaatccaatctctgaacctaaacattaatcaaaaaaaaaaaggtctttgatatacttctccaactttgtacaataaggaggtataagttggaaaactctatagtagcagagtttgttttgtttttgtgtgtctgttactcactgaatagttaggggcatggtagctgttctcttcctctacaagcaatcaccttgtctgctttttattataaaatttgatggcttttttcctgtttttatctctcttggtctcattgcacccctgcttcctgtggcttctgtgaagctatactcttctggttctaattctgatgagcctctcttctctccctcacgcttttgacatgctaatgttcccagacttttcaacctcatatcctgacctcttgcttttaaacttcaatttaatttaagacgctccacttatttaaattttttaagagcacaaagtgaacttttataattttcttcatgtggttctgacatcattgttgttaggattcttccttagtattttatgatttttacatcctttatgaatcaacccagcctccaattatgtcatctactgtaatgactggaattaaaaaaaatactgatatgtattatgtgggacttctaaaattgacattaattcaaagagatttttcttaatttttctttgttccttagttttatctcttagctgtttacatattaatcttatctctttccttttattgtcatggtcagaacttttggaagcaataaaaatagtgaagatggtaatttttgtcacatttctgattttattgaaaatgcctttatggtacacggttatgtataacattgattgttaatttaaaattaattttctgtatctttatcttgcatttcagttgttatctctatatagtctgtgttctaatgaacttttcttgtttgtgtcctatatcatgtatattgttttctgtagaattgattcttttcttattgccttaaataaattcagtttttatatttatattttgatttttatatattttatcttccttccttccttcctttctctttcttttttttttttttttgtcttgttttgtcacccaggctagagtgcagtggtgtgatctcagctcactgcaacctctgcctcctgggttcaagggattctcctgcctcaacctcccaagtagctgggactacaggcatgcgccaccatgcctggctagtttttgcatttttagtagagatgcggtttcatcatgttggccaggctggtcttgaactcctgacctcaggtgatccacccaccttggcctcccaaagtgctgggattacaggcatgagccactgcacctggttgcctattttttcttgatatctgcaattttgtttagacttacctttcctatctttttagtaggattacattttaaataataaaacaagggtgcactcctccatgcccttcttcccgttcattcagtcagcagtatcaccttcaacctaatataaaaagcaagattcagaatcttgcttggatgaccaagtaaagaggacctgagatatcttcctgagagcatttgaaatttccttttgcctcaagaggggaccagctctaaaactcagaaaagacaaaagtcttaaaaccaagacaagatatggcaagagtgggacttttgaaagagattttttttccggtttcataaatttgtgccattaacaaagttttggaaagagaataaacagagacactggccaccttccccaatcaggtacacattttttcacttggctgagagggagatttatagaggggaaaagcttaggcttggatgcttttagacatagatgtatccccatgagacgtctgggtgaacaaaagaacccctaaagagttctagtgatctggaaacaggacaaattgtacttccttttccaggggtgctttctaaccttgtagagaattcttttcttgctaacaggttatataaagaatataggagacaagatagtaagagatgatcaagtaaagaagacctaagacatcttcccgagaacataagaaatttcttgtgccccaagtcagggccagaaagacagatagggctggtggccctggaggggctgcatcatgatggtgacagggtgtgtctgtggaatttgacatcaaccttcaactggaaacgacataatataacacactagatgccaattgggatacacattgatgaataaagacaagaaggaaagggaaacaacttcagatttgacttctctccaatgccatgaagctacatcagatttctccaccccgagaacataagtgcctccttagaaagaaggaggggtaggcggaatcttcgaagtgatttaatttaaacctgaatcgatcagcagaaacaaattctaaagagcctgtgtttacctgaaactgcctgagatgatgatgattattttttacctttaggcagaatgtggaatctatgtttttggggatttgtttttgagacaaagtctcgctttgtcggccaggctggaatgcagtgtggtgatctcagctcactgcagtctccgccttctgggttcaagtgattctcctgcttcagcctcccaagtagctgggattgcaggtgtgtgccactacgcttggctattttttgtattttttaagatatggggtttcaccatattggccaggcaggtctcgaactcctggcttcaagtgatcctcccacctcggcctcccaaagtgctgggattacaggcgtgagccactgcgcctggccagaatgtggaatctagaaaagaatcaaagcaggttatagaaaagtaaagaagctatttctctcacataggctttgtcatggcctgtgaaaatgtaaacccaccatattttatcagaaaaacctgtatatatttctcatctgctatatgtccttttcacagatatgctttttcctttgcttaaggtactttttgccattcttttttttttttcccctggaatcttttcataggtttcatttatctcatccctgaatgaagagtgagtcaactgacctatatttcctttggaccctcccagttctttaggatgctgccagatttgtcctcttagatctcaagggagaatggagccgaataggttcagagtcctcagacaaccttctcgtgacgtgactcacagctatgtttaaaatctgtgtctgctggactgaagcagaagcttttttataggctgcctgggttaacgtcctggcttgtccatttactagctgtgaaggctgagcaagttacttaaccctcctgtatttcagtttacctaactataaaactgagctaacaatggtacctggcaaagttgtaaagattacatgaattaagttaatgaaagtacttagattagtgtctggcacaaagtaaacattgtgtaagtgttggtcggtatatttttgtcatcattattcttacaggggtctcctctctctttcaaatccagcttatcttctgttttgtttccagattaatctttctgcagcacagacccacatatattattcaattgaacaaacactttcaaaggctccaattgtttaccacattaaggaccaccttcttgccttgggattcaaataattctggtacagggatcaggacttcgtcccaacctctcactagtctactgcattatgctcagtccgtggtggggatctgattgtttccttgaacttgctctgttcttttctgcctcagagctgtccttactgcccctggcactttccatcttccccatttacatctgtctcagcagatttaaattctaccttctccaggatgccaatcataatttccccatcaaatgtaatctcttggtctttgcaagccccactgtactttgtcaaaagtgctcaccacgtggtactgagaactatagcttcctgcaatgtggatgtagtcatcctccatttttccttcccttctgcctccagacacctcacaggtaggagtttaggctgatttatccgtgtattccctaaaattccagccacatgcttttcatgcaatggcagtgcaacagatagttatattctgaacggaaccaatacagataaatcccagttaagaactctagcacacaaaacaattttcttggttctacttttgctgcatcatacagcagagcttcttaacttgctaaaaacaaaagttttaaatgtttcgacaaaaatattcagatagatatactttcccacaggatgtcagaaaccattgaatgtcaacaaatatagtgggatatttttctacgaaggaggaagttgatactaatcattcagcataattttaatctctcatataattgatggctgcagattcttttcctttttctttttttgagacaggatctcactctgtcactcaagctggagtgaagtggcacaatcttggcctactgcagccttgatctctgggactcaatcgatcctcccacctcagccttctgagtagctggggctacaggcccacgccactatgcctggctaatctcttttgtatttgtagagacgggattttgccatgttgcctaggctggtctccacctcttgggctcaagtgatcctcctgtctcggcctcccaaactgctgggattacaggcaggagctaccgtgcccagctggttgcagatttcataccagcagtcaaattaaagtacataaaaatacaagaagatattgtctattaaaatctacagagaacatgagtatttaagttacaaaatatggggaaaaggttaaatgtcttcacagaataaatcaatcaacaaatatttattataagtcactgagtgatataaaaaaagtaaaataaggcttttataccccaggagataatgcagtgggtaagataggagaggaggctgtttcaccagtccagggctgcagtgattaggattggagaacagctgtggtgaagagttaggtaaaaggaaaggagaagcaaagctgacttaaagaaagaacaaatgggaaatggagattaaataggggcaacggagaaagactagtttaagatattgcaacattttaagctattgagaaaaccgccaatagaaatatggaaaaaaggaggaaattattggggatggcagtggaagaaagaataaggacaaaataaaatgcaattttaagtgcactgagattgtagaaaggtaaaatgttcaggtataaatatccagagggcagcagatatttgcatggtactttacactttaaaaagcccttttatatttattattttgtttgagatctttagacatatgggcaagtcagatagtttaagtaagttgtgtaaaatcctaagtccagaagtctgaacatgaacctaaggtttggactcctagtacccttacaagcactgggtttgttatcagaccagctttggatttacttgcttaagttgttagctctgtaactttacataagttacttcaattcctctaagctgcatttcccatccataccttgacctcccaggctcaactgattcttccacctcaaaactatcttctagttttgttgtaagaattagatgacataaagcacttaagtaattggcatattctaaagtcttaacaaattttacccattatattatttctacacctcagctgcttcccagagagcctggaacttgaaaatagatctgtctgtctgtctgtctgtctgtctgtctgtctatctatctatctatctgtctatcatctatctatctatctatctatctatctatctatctatctatctatctatctgtctgtctgtctatctttttacaggcataccttggagatagtgcgggtttggttctggaccacagcaataaagaaagtcacatgatttttttcagtttcccaatgcgtgtaagagttatgtgtacactgcactgtagtttattgaatgtgaaacagcatattgtcttaaaaataatatgtgaaccttaattaaaaatactttattgctaaaaatgctaatgatcatctgagccttcagggagttgtaatctttttgcggtgaagggttttacctcaatgttggtggctgctgatgatcagggtggtggttgctgaaggttggtgtggttgtggcaatttcttttctttttttacttttttttttttttttttagagttgaggtcttgcactgtcactcagcctggagtgcagtggtgcaatcatggctcactgcagccttgaattcctgggctgaagctatccttctgcctcagcctccctagtagctgggactacaggtgtgtgctgccacatgcaagtaaatttctttctcttttttgtgtttagagatgaaatcttgggtctgggtatgttgtctatgctggtcttaaactcctggcctcaagtgatcctcccaccttggcctcccaaagtgctgggactacaggtgtatgccaccatgcctggctaatttatttcactttttgtaaagatggagtcttgccatgctgcccaggctggtgaatattcttaatagcatctagaataattaattatttccagaaggtttcttaatggaccttgacaaaatccatcagaggaatcactatctatggcagctatagccttacaaaatgtatttcttaaataataagacttggaagtcaaaattagtccttgatctattgggctacagcatggatattgtgttaacaggcatgaaaacaatattgatctccctgtatagctccatcagagctcttgggtgaacagggacattgtcaatgaacagtaatatttgaaaaaacatcttttttcttctgagcagtaggtctcaacagtgggcttgaaatattcagtaagccatgttgtaatcagatatgcttccatccaagcttgttgttccatttattgagcacaggaaaagcagatttagcctacctcttaaaggccttaagatattcagaatagtaaatgcgcattggcttcaacttaaagtcaccagctgcattagcccctaacaagagagtcagcctgtcctttgaagctttgaaaccaggcattgacttctcccctttagctctgaaaggcctagatggcattttcttcctatacaatgctgtttcacctacatttcaaatctgtggtttactgtagccaccttcactagtgactttagctaaatcttctggataacttgttgcagcttctccatcaccacttgctgcttcactttcacttttatgttagaaagacagcttctttccttaaacctgatgaaccagcctctgctagcttcaaacttttcttctgcatctttctcatctctttcagcctttatagaattgaagagagtcagggccttgctttggtttaggctttggcttaagggaatgttgtggctggtttgatcttctacccagaccactcgaactttttctatattatcagtaacgccattgcactttcttaatgcttgtgcatttactggggcagcacttttaatttccttcaagaattcttcctttgcattcacaacttggctaactttttggtgcaagaggcctagcttttggcctacctcagctttttacgtggcttcctcactaagcttaatcatttctagcttttggtttaaagtgagagacgtgcaactcttcctttcacttgcacgcttagaggccactgtgggattactaattggtttaatttcagtattgctgtgtctccggaaatatgaaggcatgagaagaggcatgagaatagctggtgaatggaggagtccgaacacacacacttattgattaagtttgctgccttatatgggtgcagttcatgacatctcaaaacaattataatagtagcatcaaagatcactgatcaaagatcactacaatagataacatactcatgaaaaagttgaaaatataattgtgagaattagcaaaatgtgatacagagacacaaagtaggcacatgctattagaaaaatagcactgatagactcgcataacgcagggttgccacaaaccttcaatttgcaacaaaacacaatttctgccaagcataaaaaagtgacgtgcaataaaatgaggtatacctgtgtactgcagtcttgctgccaactctgactttattctatttctcccttgccactatatgtaaccattgaaattaatttattttttaaccttccagtgtttcctaatgccaatatatgtatatatttaataattatacacacatatataatatacatgaatatagatctgtaactgcctatatatgtataaatccatatgcatttgtacatatataagcagttacagatctatattcatatatattacatatgtgtgtataatgcatatatgtatgcatttatacatatacaagcagttatagatatataaaacattaaagcagtcttttgtgtattaaaatttcaggtgcattggtatatattaaagcattaaagcagtcttctgtgtattaaagggagccatatatatatgctttaaaaggactgctttaacatataccaatgtataagaaattttgaaaataatctgatgaaggagtaaactttttacccaaaatagatgttcaacttttctttctttccccaactgttctaaaggactccagtaggggacctctgtcattctggtgattaagtatctattgtgtcactttctggaaacagtactacgcattttcttttgagaaacgatttttgtcttggcattggccttatggtttgtgtaaatggaattcatactcaggattcgaggtgggtttataaactttagtcattttattacaagagccatattgggtttaggcatatgctttaagccaactagactgaactctgggaaattgtttgaaatgctgagacagaaatgatctcttttgtgctggatgtaaaggaaaaagcccttgagcacctatgagaagactcagctatagaataaaagcaacatcctacaaaatggagcagacaaaaggcagacacaggatcactggtgatgtttcaaggcccctggagtaagccctacttactccatgaaaatgaagtcgcttccttcatctcccttcagatttttcataatctgagttaacaagttctctttaattttggagctaatatgaattaggttttctgttacttatagctgaaatgatcacactgacatagtttttttattatgtataaatatctacacatacttgaatgtattttggtatttatttctattctcataagcagtatgtttattcctgtgccaacattagtgttttaatttctttaactttattctttgtgttagagaaactttattactcagtcccatgtttcctagtggggaattcccacttctctctcccatactaactctctccttcccttgggaagaaaagtgatttatgtgattgagaacatggagttcttgccctgtctctctgggacctgcagggcctgcaagtgtgtactccttttctgcttcttctggggctaacagtatgttttgatacttggcggagaaagtgtttccatattctgtagtttttttccctttcttcttcctcagatttcttggctcttctttcatgtttcctcttttagatacatttttaggtcagcattttagaactgatggaaacactttctggccctttgatcagaactgtattaatttcatatcataactgtagaggaactggtatcttgttcaggagcttggtgtatttttctgtgtactcagggcttctatgtataatatatcacaaaagtttaatagttgtcttcaataggttttatatttttctttgtatatttatttccagctgtttgatgatattggttactatggtaaagagcactaaaaaaatctaattggtagggtagtgtacaagaaaaaccatttgtgtttgcttattaatttttattctggccaacttgattaaatcttttattagtcctacatagataataatatcttaaataatagaagttttctcctgtcaccccactacacgttttgaattaactgtagtgactaggaattatagtattgaataatacctgagataacaggtaaacatatcttgttcctaacttttattgataagcacttaatgtcttaccattgattatgatgcttgctattcacagcaagatagaagttttgtctattgtttgctatttctttgaaaatcaagtaggttttgtattaaatattttttcagaatcaaataatacattttttctttcatttgttaacatagataaaaaaattgatatgctaaattgaactagctacacatagttcatataaatggcactttgtccacatttttaatgctttagagtcattcttataattttaattcctaatagtttatttaggagttttacatccacatttacaagtgagactgacttccagttttccttgtctgtgtgtattctttaatctaatttggtatcagagttttgttagccttttctaattccagtctaatttctatttctagttaagataattgcagtctttttctactacctggatgtagtttcagaatataaaaattatttgtttcttaaagattcagtagaaatcacctaacattttctgaatttcatgcttattttagagatagatttttgaccaccttatcttcttctgtgattattattgtcttgaaatattctattattttagcgaattttggtaatgtatatatttttgaaagctaatagttgtgtctacaattttcagatgtgtacaaaatattctcatgctttcttgaatccctgagtatatcagggattatataactgtagctatatcccatacatttatctgtaattatgtcccttttctcactgctaacatcacttatttgtagcatttcttttttcccctttgatcaaccttgccaaggatttgtcaattttcctggttagtttaagaaatcaggttttgatttattgctccaactctagtattgtttattttttcattttgatcgtttctggcttatgcttttctatctttgaaagtcttcaaatataatgcttttctgatcacgttcttcttgagacacgttctgttttttgaatgcagattacgtatagtatacatctcttctctgtctctgtctctctctttctcattccagaatacatactagaaaataagaatataataagaaggggttggtcctggtgactcaaccaatgttcttctcttctcgagttcaaatagtacagcataaggcacaagtctttatagttctgtcaattatttaaaagtcaaaattctattaagtttgtctgatcttcctgtattccttcatgttaactttgagcaaatgcaaccatcaaacagacaatggaaatgcctagtgcctgaaccacatttactcattcagtgtacaaggattgaaacacgcacacacacacacatgcacacatgctggggctaggcactgtgctggctgccaggacacagagatgagtcaaacaaggtccactgcataaaagaagccctgagaggagtggagagaagcactcacacggtgcataatccactgagaccaggctttagtgagatgtgtaccgagtgttctcaaagcaagacgagcagtcagggatggatgctcaggaagtggcatgaattgagtccacggggcactgaagtatgccagcctgtgttcaaggccacgcttagtgtgctttcctctatgcaagttagcagcaaagtcctccgtgcacacatgcccaggaattttaaatgccatttctttggggaaaggaaaaccaatgtaacttaataatatcaaagtgaaataaaagtcttttatttcagaggtggaaagaccattgtaaattaaactgtaaatttagtctaaatctcacttcacattacttctgatatttttagcaacactacttaaattcatattatactcacttatcgttgagtttgtgaataacatgtatttacttcaacttataaattttgatataacctttgaacttttgggttaacccaaagaaacatgtaaatggcagaaatgtattgctatttaaagtaatttaaatgcgatctatttctacaaatgtttgttgcttttttatctctgatatccaaaaatcaggagaaaaggaggccttaaaagttgtaattaggccgggcgcggtggctcacgcctgtaatcccagcactttgggaggccgaggtgggcggatcatgaggtcaggagatcgagaccatcctggctaacacggtgaaaccccgtctctactaaaaatacaaaaaaaattagccgggcgtggtggcgggcacctgtagtcccagctactcgggaggccgaggcaggagaatggcgtgaacccgggaggcggagcttgcagtgaaccgagatcgcgccactgcactccagcctgggcgacagagcgagggtccgtctcaaaaaaaaaaaaaaaaaaaaaaaaaaaagttgcaattaaactaaaaactgcttaatttttaaaaaaggtttttgttttgttttgttttaagaagtagcagttggtaactgtctctagctcagagacaatacatggccaggaaaagattgctcatctcaactcagaggataagggccacaaaacagcacgttcagtgccaagaaacctacgatgtggctgtagctcacacagaagcccgggttctagtcctgagacctccaagggaaacttctgcccttggaaattcaccccttttccaatcattacgctagtatttcattggcagaaaggcaggctgcacaatcagctgtcatgcccccagccctgcatgcatcacctttccacattccgtgggtgtaggacgaggctagggcgaggagtgggtagaagaaattgtatttgcctttggtaattttaagtttgaccactgcattgcgtttagctgttttaactgtgcaggtcagaaaatgtgcccaggtttgctaaaataaatgcataaatgcaactcacgaagtgccagtagtacttccttcagccggcagagggcagaacagaggaacagaacttcacaaagcaaggcgctgcctgtcttctcagaccaaaacacaaaccagaagctgtgttttcctttgtttcttcagaaaagttgtacgtagaagaatagcatttttgaaggaggactttcaccaaagcttttaatatcagaataatatatccactttagtatttgatgtgtccagtgtcaagacatccagattcacccaaactgtggcagggatgaggcaggagagacccgaatacagagctgtccagtgtgccaatttcagtcaattcttagatcaatccggagtgtataattctcagaaaggaaaagatttgtggattttgttatagttgtttcatgccaatgaacgttctcgtcacattctgatcgtttaaaataaaatgcactagatttactttaacactttggtctctgaaagagaaagaaagccacgcggcttaataaaagcaacccaatgcaagtatttgttttaaaactgcctagctaaaacacagcgccgctggattacaattgcctctttgctgaagcaaaacacacatggtgcttagattctacttcagcctgaactccttttgaaaggaaagggagaaagctgtagtggaatgtgattcacaattcagcctttctataaggcctgacactcccatgaggcttaaatggaatcacacagtgaattttccaccggcgaaatttactagggaaagccgtctggaagctgtcttttagtagaagcacaggaagcccgtgcgatcgatgaagaataccgaccctcctctagctacgtctggctcccctttccctatcctgcttcccaatgtacttgttccccatgacccagaatggattacaatgccttctgcctcaccattatgaaaaaagggatttcagggtttctttctggggggatgaaattgaaaggttttaatatttaggctgtagtgatggttgcgtagcactgctaataaatataccaaaaaccgttgaactacacattttaaattggtgaactgagtgatgtgtaaattatttcttaacaaagctgttaaaaataaattgatttatctctctacgatagaaatgaatgtaatgtaatgaatagtaatattgaaactcgcttgctttttagctaaaatgagagtcaaagcaacattatttgattgccagattctatttccttttaagttttttattcttccatttggtgtttgtgtgtctgattttctttctagatttttcttttagtgtttcaggtccgaagaaaaatcttggtttttgtttatttactctaagaattgaaaaatctatagatggggtgcagaaaatgctacctcaaaatatagcccctaggcatactgagtaacttgagaaaacagtggaagcagggacatctctgactttctcctattccctctctcctgaagcagatcatagaaactgacattcttctgtcccctgactcccctgaagtgggccatagaagctagaattcccttcataccttcttccctgaagtaggtcataaaacacaggaagaccactctctgaccatctacctctctcctcccataataaccctcataccctgaagaaaggaatgtcacacagagaggacatgaagaatccaaacagacaggccttgttcagttcccccagcttatcaccattagatcacacccattggtcctccaatcacactactgtgtgactgtcaatacaaatacagtttttcctggggctttgggtctcctttctgaaggctcctacgtcaggtaaaatttatattaaataagtctgtatgttttgctcttgttcatctctcttttgttataggggtctcagccatgaacctgtaattggatgaggaaaaggtattatcatttctcccataccctgtattacacaataaaaaaaaaaccagtaacatcttgtatttgtcctatttgaaaattttatttattagcattagctaataaattatttgtatatatgcaaaacaagattggaaatgacttcctgttatatgaaaatgatttcatcatgtgatataacagctaaatattttaaagcaactttaggcagcatttaataaaggtgctaacagtgaggaaggaagtatcttctacttggtacaggtcagacacatctggggtttggtgttagctttaaacaacagtgtagcctggaatatttccagtagaaggagaaagggctcaggcacacttaggagaaacctatttctacctccaaataatggaagggctgtcacatgaaagaatgaacttctttgacacagctcttacagtataaaattgtatttgttttacaaatagtacaacaggtataagttctaaggagacacgaaagaactccgtaatgtttggagctgtctaaatgggagtgagttacttcattaaacagtgagctcctatttgagaagtgtggctcatgacctggaaatgattatattgtgggaaggatgtgctaattccaggtccagcttgtaactgatatctggtgccatccgcaactggcactcggggtgtcctttggggaagtggttgtgtgtggactaactaagctatatcacttgatgatcagatcattttgccaaagcacacctatgccagcttttaaaaggctcatgtaattatattaggcccactaaaataatcaactttttgccatttaacataacataattaagggagtgatatctcctcatcttcagaggttccacccacactcaaaaggagggaattgtacatcagcgtggggcattaggccactcttagaattctgcacttcacagggtgactggaattaaaacattccatggttactgtagtgttcagagaaggctaaagtgtccattggctttggagctcctgcttcactacttggagacctgtattttttttcagctcttgatgctggaaggaaggttctttccaacttgatgaaacaatcaccaaatatacaccagtgggggctttcctgagcccctgctcctgaaccaggtcctctccttcctcattcactcctagaatctctaggactccagcctataccaagttcaaaacttgtccagatctaactttaatgaatgtaatcaccattaatcctaactcaaactatttcccccatatttttttttattttaaatcattcttctttacgtctttcttgcttaatttctcctaagaagcaagatttgggttcgattttccttttctaggtgtttttttgtttgtttgtttatttgttttttgtggggacaggactcaagtcttgaaatgtgaaatatatatattcatattatctatattgtgtgtatacatacatatatgtttcacatgtgtagaagatttctctcgtctccaaaaaaaaaggatacacagatacacagtcatgcattgcttaacgatggggataccttctgagaaatgtgttgctatccaaatctgtcattgtgtgaatattacagaatttatttacacagacctggatgacctagcctactaaacacctagactatacggtatagcatattgctcccaggctgcaaagctgtgcagcatgtgactgtactagatgctgtaggcaaatgtaacaatggtaagtatttgtgttatttaaacatattgaaacaaagaaaaagtacagtaaaatacattgttatagtcttatgggaccactatcctatatgtataccattgttgactgagcatcattatgtggtgcgtgactgtctatatccttggtaatatggattactcttaagccattaatccccccagtgtgtactcatggaatggtaactgactatagaattaagcttaacaaatcataattaggaaaacaaatcatccataaaaaatactgtgcacaggcagtttccaagttatgaatatatcaggtccccatagtttacttttcagtcaattgtttagagcctagtcctagagatactatattttggggaaaatgctggttaggtttctgggttccctgtgggtttgatcagcccataatgaaaatgaattatagtagtaatagtaaaagagatcaggattctgggaacaaaagaaaattttactccttattttttattgagtagggctatctgggagaatatttggaaatagtttgctttttatatttttcactctttgcacattttgttaatttacttttattcctctactattgctcagaaagtcccctgagattcctgggattttctgactgcccatcttgcctcactggccaacagcaccatgctccctgtcccaggcgggctcttcttccaaaagtcctatcgacttacaaatcctttttcctcccaaatgcaaatgaagctctcttcatttcatgaagctgatctcatctaaaggttatgatattagccgtggtttttttctaggtgctctgtatcaagtggaggaagctgccttccattcccagtttgtcggtttttatcgtgaagggctgtagaatttcgtcatatactttttctgtgtctattaagatgatcttctgagtttttttctgttgtattgatatgatgtattacattatttgagttttgaatgctgaaccaacctcacatttctgaaataaatcccattaggtcaaggtgaataatcctttttctatgttgcttgattcagtttgctagtgttttgttgaagattttcatgtctatattcataagggatattagtctgcagagttttgttgtttttttccttgagatgtctttgcctggttttgatattagcaaaacgctggcatcatagaataagttaggaagtgttttctctcctctcctattattaagaagactttacaaaggattggtattcattcttcataataaaatttctggaataacttatcagtgaagtcatctgaactatggattttctttatggaaaatgtaaaaattactaattcaattttttaagttgcagtttttaaattagtgattcagtctcttataggtcgatttagattttctctttgtctgataattcgtgtttttctaggaatttgtccatttcatctaagttatctaatttgtgggcacacattattatataatgtttctttataatcctttttatttttgtaagatgggtagtgctgttcactttttcattcctgattttggtaatgtgaatctcatctttcttctttcggtcagtctaactaaagggatgccagctttgttgatgttttcaaataataaattttttgttttattgatttttctcttttgtttttgttttttatttattctgtaataaaataacataataataataattattatttatatttgctttaactttagtttttttcctagcatcttaagatggaagatggttatttatttgagatctttcttcttttttaatgtaggcacttacagctacaaacttccctgtgatcactgctttagctacaatccatacattttggtacgttgtactttaattttcatttctttctaatttcccttgtgacttctgtctttgactcattagttatttaggatgcgttgggtaatttccacatacttgagaatttccccatttttttctgttgttgatttctaatttaattctgttgtggtaagaaaaaataattttttattattttaatttctttgaatttattgaggcttgtctatggactcctatatggtctaccttggaaaatgtttcatgtgtacttcagaagaatattctgttgctgttgggtggaggattctatagatgtctgttagatcttgttagtttatactgttcgagtttttgatttccttgtttatctactgtctagtaattctattcattatggaaagtagggtgctgaaacatttattattgttgaattatccatttctcccttcagttctgtcaattgctgttgttgtattttggggttgcattgttaggtgcagtatagcatatattttcaacttttatcttagatttagggtatacatgtgcaggtttgttacctgggaatattgtgtgatgctgaggtttggggtacaatttatcccatcactaagcatggtacccaatagttactttttcagctcttgcccctcacctctctcccctctccagtagtcaccagtgtccatttttgctatctttatatccatgtgtatccaatatttagctcccagttaaaattgagaacatgtagtatttcattttctgttcccgtgttaatttgcttagggtattggcctttagctgaatccatgttgctgcaaaggacatgattttattcttttttttatagctatgtagtattctgtggtatgtatgtaccacatttcctttatccaatccattgctgatgggcaactaggttgagtccatgtcttcgctattgtaaatagtgttgtgatgaacatatgaacacgtgtctttttagtagaacaatttattttccactggatatatattcagttacgggattgctgggttgaatggtagttccgttttaaattatttgagaaatctccaaactgctttccacagtgactgaaataatttacatttccaccaacagtgtctaagcattctcttttcttttcagtctcaccagcatctgctgtttttggactttttagtaataatcattctgaatggtgtgagatggtatctcattgtggttttgattttcattccctgatgattagtgatgttgaacttttttcgaaagtttgttgaccgtttgtgaatcttcttttgagaagtgtctgttcatgtcttttgacatgaacatttttaatggggttattattattattttctggcttgttcagttgtttaaattccttttagattctgggtattagacctttgtcatatgcatagtttgcaaatattttctcccattctgtaggttatctgtttactctactgatagtttgtatggctgtacagaaactctttaattagttccctcttaccaattttggttttagttgcatctgcttttgagaacttagtcgtaaattctttctcaaggcagaagtccaggatggtgtttcctagcttttattctagaataaaagtctgaaatcttatatttaaatctataatccatctggaattaattttcgtatatggtgaaacataggggtctagtttcatccttttgcaaatggctagccagctattccagcaccatttattgaatagtgagtccttttcccactgcttatttttattgactttgtcaaagatcagatgtctgtagctctgtggctctattactaggttttctattctgttccattggtctatgtgtctgtttttttgccagtaccatgctgttttaattattgtagccttatagtatagtttgaagttgagtaatgtgatgcctctggcttttttttttttttttttttggtttgcttagaattgctttggataattttttttttggttccatatgaattttagaatggttttttgtctaattctgtgaaaatgatattagtttgataggaatagtgttgaatctacagattgttttaatgatattgatacttccaatacatgagcatggaatgtttttccatttgcttgtgacatctgtgatttctttcagcagtattttgtagctctccttgtagagatctttcacctccttggttagctgtattcctagatattttactttattattattttttgtgacaattgtaaatgggattgctttcttgatttggctctctgcttgaatgctactggtgtatagaaatgctactgattttggtacattgattttgtatcctgaaacttcactgaagttgtttaacagtttcaggaggtttttgatgaagtctttagagttttgtaggtataggatcttatcgtcagtgaagagagatagtttgacttcttcttttcctatttagatgtcttttatttcttttttcgtgtctggttgctctgggtatgacttctgcatatatgtttataattgttatattctccttgtggattaaccctgttatctttatgaaatatttcccattatctctagcaatatttttgtttcttagtttatgtatgtcgtctcatatttatatggccactctagctcttttaaggtttctgtttgcatggtatatctttttctatcattttactttcaacctacttgtatatttgaatgtaaaatgtgtcctgtagagagtatatagttgggctttgttatttttccagtctgatagtctctgccttttgattggattgtacatatttaatattttattgtaatacttagatttaatctgtcattgtttttatttgttttgtcattgttttctgtatgtctcatgtttgtttcattcctttcttctttactgccttgtttagtgttaagcaaatattttctagtgtgatatttatttaacttatcttaatgatctttaaataatatatgcattattctcttagtgatgtctctagtgcttaccatgcatgtcttatcaaaatcgacttcagatttatataaaattcattccaacaaaataaagaaattttactcatatatgtgtctattcctttcccctcttttgggtactattaatgttgtgtatattgagctaaatatgttacaaaccaaaaaatacattgttataattttacataatcttatgtttttttttttttaacaaaactgagaaaagaaagaagaggaagtacgtatttatatagtttgctgtattaaccttattatatactgtttacaattcatttctttctgtggatttgaactaccatctagtgtcattttcttcctttctttctttctttctttttttttgagacggagtcttgctctgttgcccaggctggagtgcagtggcgagatctcggctcaccgcaagctctgcctccggggttcacgccatcctcctgcctcagcctccggagtagctgggactacaggcgcctgccacaacgcctggctaatttttttgtatttttagtacagacggggtttcaccgtgttagccaggatggtctcaatttcctgacctcccaaagtgctgggattacaggcgtaagccaccgcgcccagcccatctggtgtcattttcttactgtgatatagttttgctcctaccaaccttctctgcactgtttttgtcaaaaatattaaatttctatatattataaactcactaatataatgatacacatatttttgtgcaatttgtcctttaaatcagtttagagaagaaaggggaatgaatattcaattacactgtctttcttactgacctacatcattacctttattagcactctttcttttctcgtgcagattcaaattattctctggtgtggtttgcttttagtcttaaaaactctctttagtatttcttgtaagggggttaacaaacagcatttgtgtatctcagaatgtttttattttgccttcatttttcaaagataattttggtagattcttgttgaccttttttactttttagcacttcaaatatgtcataccattgcctccaatatttctaataagaagacaattgttaatctttttgagattcccttgcaagtggtgagtcatttctttcttgctgttttctccttctacattttgactataatgtgtccgagcgtgaatttctttgtatttctcctacttggagtttattgagcttcttgactctgtagaaaaatgcttttcatcatatttaggaatttttcagacattgtttccttgaatatttttttctgctcctttctctttctcttctccttctggcacttctattatgcataaactggtacactgaatggtgttccactctattctttcaggcactgtttatttttcctcattcttttttttctcttttggattacataatctctactgatcttcttcaaggtcagtttctttcttctaccagctcagactgtctctcgagaccctttagtcattgttttatttatatttttgtacttttcaaattcagaattttcatttggtacctttaaaaataatttctcttttactggcattttctatttgattagatattgttatcatacattttctttaattctttagacatgatctcattcagttctctgaacttatttaaaatgtgtgatgtcattgtctgctaagtcaattatttaggctccttcaaaagcagtttctattccctgcctttcttctgtctgtgtatctactatgagctgaatatgttatgggatgaagtgtttctccccaaaattcacagattgaagtcctaacctccaatatctcagaatgtgactgtatttggagacagggcctttcaaagaggtaattaggtaaaatgaggtcatatgagtgggccctaatggaataccactggtgtccttccaaaaagaggagattagatacacacacaaagggaagatcacgtgaagacagcatgtgaagaccacgtggagggaggtggccatctacaagttaaggagagagggctcaaaagaaaccaacactgcttacatcttgatcttagacttctagcatccagaattttgagaaaataaatttctattgtttaagccacatagtctgtagtactttgttatggtgtccctagcaaattaatacagggtcacattttcctatttctttgcatgtcttgtaattgtttcattgaaaactggaacttttgcataatacattgtagcaacactgcttattgattgcccctcctccaccccagggggttgatgttgttgtcttggccaatttatttacgctttgatgacttaaactctatttcccacacagtgtgcagcctcgtgtttatatctttgagcctggctatgtagagatttctccgggtcagcataaaatcactggtcatagattgtgcttaagaccgcttagccagttctacttttactctttaccttggatgtgtttgtggcttggaggctgctattgcaatttaaataattatgtgtttgccttcacattttgtgacggactactagcttggatttttcttctcccatcactctggagaaggcacagtcttgggtgtgtacagggactttcaggctgccagggatcagcatggtttttcttcttaagcctgctttcctaggagttgcctctgggtcagttcagccagctgtggtgaagtttgtgcttaagcctctagtgccagtgaggcttctgccctttgtggattattccgtatgtggtttagtggtgttttcaaatctgcccacatctagctctgattgcttctgactattgctaggtacagccttgcactgcacacagccttcatgaccgccagggttatgtggcatcccaggagggttcttcttggtggtctttccattgtaccctgttacacttctgattgctctgccattttgcatgtggtagcttgcaccatggagctatgagtgccttctgaattgctctccaacaagatgctcattgcttttgacaatgtccttaagcatggaattctccacgctccattccaaataaagccagcccctgcaggccgagctgtggagttcttcgtccctgagatctgcctctttggcctgcctcttcctgagcagcacttctgttccactgcacaagagctgggggtagaacccactcttgtcccagagtgacatcctgctccgccagcaggtacggagtgtgtgtggcctgtaccttcctggcttgcctttccttgtatggagcctcagccttagaagtgagctgggatgaaggtgatcagggcctcactattctctcctagctatgcctggggaaaagcttcagtcctacgaatagaagttaggtggaggaaaggaatcctgggcctcttagtcacccccgcctacaatggaatttctgtaaaatggggctggaagatgagaaactctgtcagcccattcctcccatggtgaaactgtagccccaggctggggagctggggagctggggtggtggtgggaagagtctcattttcttggttgcatctccctggattagagctcctcaatcagtttccctaagcttggggtggaaggtaagggtcatgactgaaatgccacagacccctgtcttaatgagatttagctgattttctcattttcttgaatgaatattaccctatttactttaggataattctctttaaaaaactatgtttttaaaaaatgctttcctcctgataaatggatgtttactggggagagattctgagggactcttcactcttctctggagtcatctttccctttgcgttataaataattcaaataacacaaataacgactcctacctttgggtatacattttttcacaacgaaaattttctcttctattacttctctatatgttttatatactaatacccttatctcagtattttattttattttttttgagatggggtctcactttgtggtccaggctagagtgcagtggcatgatcacagtacactatagcctcgaacttctgggctcaagtgatcctcccgcctcagcctcccctgcagctgggactataggcatgtgccaccatgtctggttaattttccttttctttttgtagagatgggttctcactatgtctcacgggctcttcttgaactcctgggctcaggcaatcctccctcctcagccttccaaagtgctgggattacaggtgtgagccactgcactcagcctatctcagtattttaaataacagagccaccaataattagtgcactgcaggacagagcaaagagctaatcctcactcagatcgatctgcatttgaacagcactctattgtttcacaatgctattgaaatgataatagcactttgtcctcattgggaagtgactggaatgtgtttagcaatacggaatacggtgaggatgacagccgaaggcacacaggttgttctggcagagctaggactagaatcagggctccagacttccaactcttccaagctaaaaagagtgaattagacaaaagcactctttaaaaaaaaatctgcttattttatgtctggagtaggagcttatctacccacaaagatgtggatcactattaatctggaaattttctgtttctatattttaatttagtaacaatgcgatgaaacttgtgcttttgataagatttcctatgaaatgagacatcatttggatacataaatattctcactggcaaaattacttgacataggcacctatttatttgatacaatgactgaattttaagtatctctttgaggtttaaaaaaagccattgaaagtgaaaaagagaaacaaccttttaacagcagagggggctggctgaattaataaaagggactgctgaattacaatttatcatttaactgaaggattcttttcaatacaatcactactttgaaaatgaatatttattatgactgaaaattagtgaagattaattataatgctatttattaggagacctttaaaaaccatcccttgtttgaaaaacacttataaagctcctagttgttcagacatttatgttagcaactgttaaaaaaagcagtgagctgctactaaatatatcagagtgcccaattaaatttctacaggtcatcagatggcgtcactgactggtggaaaggctgaagttaaatccttcatcctaaaggaaacaatcagacaacatgagttctgtatctaatccgcagcatgacagaaagccaataggaaaaagtgaattgcacatcactcgtggcttttcataaccattgtccacagtttgatcttgatgtgaaccactgagacatagcttgtaatcataaaatctgcaatgtcagtgaagcaatgatagacaggtaagaacgagattggtgctcaaagcagctagggaggtctataggtttcgcctgacaagagaacagatcaaaatatggcagagtaattgcccaccatttccactgtttctttttcttctaaattaaaagtactcagtcatgcaaacaaaccgattgtaatgtctgcctttccttctttccttccttcccttccttcccttctccctccctccgtcctgccatcctcctccctttctctttctctctctccctctccctccctccttctctcctctttctttttctttcttttattaattcaccaaatatttaccgaatgcctacagtaggctaggcacttcgttactaggctagatactgggctaggctagctacagggatatagcagagaacaaggtagacacagaccctgttctcagtacccacattctcatggtggtggttggaggaggtgggcacagacagtgaatgcataaacaaatgcaagatgagttctggttatggtggctgttaggcaagacggacactggttcacgtgacagaacttgtctagagtgggggtgcaagttggggtgtgtgaggtgggatagagattgggccatgccagttaggccattaggaaagacctgttttaagacctgagagtgagaaggaactgactgtgagaagaacattccagacagaggaaacagcaagagcagaatccctgagacaggaaagggtgtgcaggaactcaaggatagattgatgtagaggaggtaatgctgtggaagtcaggatgggcaagaggatgaagggacaaagcatctttggttggccagactttatgtaggcttctgaaccttctcctaggcccatccaggcacttccttgtaaaatctacttttagcaaagaaccctgctaagtcactttggcaagaacccctcaccccccgtcctcaacatctgatcactctcgattctgatcaggttcctcatcctccaccatcccccaggtgatgtctggttatcctggcctgccttcatcaagaatcctgttaggtcaatttagccagaatcccccttactcctgatgtttcttcctagcaatttcccatccactgacccctaccctgccccttgactgctaattcccacttgctcatgccatactcagagttgtgcccaatctctctcccctactgcaagaccctgttgcagtggtccctgtacccatcgtgatagtcctgaataaaattttccttatcatgctttaacaagtaccattgaataattttttctttaacagtaggaatataatgatgaccaacatttactgagagtttgctgtgtgtcagctcctctaagaaactaacatgtattatctcatttaatacccatgacaaacttagaaagtaggtattagtattatcttctttttaaaggtgaggaaactaaatcctaagtcaggcaaaactgggagttgaaccaaggttgtctgactccagcatctgtgagtttaaatactatgctttagtattagagggaatgcaatcatgtggaagtgagcaggctagacaagggctctatcatgatccaaaaatatgtatggcaaaccctatgcctgtgatggtgtagtagcagctccatagagaaagttgcatagacacaacctttgctttcagtgtatttataaccaggaaaagacaaatgttatagcaggaggggttataggaggggaaaaatattaaaccaaaaagcaaatgcatggttacagttcagtcatcacatgcaggcgaaaacttaaatgatagttcactttagtccttagctaagtagttgtgtccatttcagactgaaatcttattctgtaattcccaagaaaggccttttccgccacgattactgtgttttcgctttcttattttgagggggtgatgcgggagaaatacatgaagctattgttccagaacaggttagtcatgaggtctaacctcaagctggcaagtccctgtggaactgtagtgaaaatgtttttacgttttttgcactgttaggactttctaaactaattgtactaaattctaggacctgagctaaaaggcaagcctgccagttaaatgatgattgattagatggtaagagaccatccagagagatctacctccctggaggtaagtatttgtattttcatttcaaggggagaatgagacctgagaccatggagacatcctaaggttgtaaagctggagaggcgagactttgtctactccttggagagatttatttgcattccaaaggctaagaataggaactcaggatccttgccaaagagcaaaggttctcccttctctttcaggagggaaggggagatggctgtccctctcctatataactacccaggttcatctttgggggatttcttgcctacagtggaccctatttgcttctcactccattgccccaagggtaagaactggggctaaagggatctggagtggaaattattgtataagtagtgataattaatctgttctgcttcagaaaccttgtgtttgcattcagggtagtattagtaaatatagaattggaaacttagtatccttccagctctttctccctcatgggcatcaacggacaagatgggaggagggaagcaccagcctatgtaggtgggtggtgggaaggaggggtggagtcaggggagttttagtgaccagggagcctggactctgggccagttcacttcctgcattccaggtgcaggaaaggagaaagggggatcagtttgactgctaagttaaatgtaggccgaggaaactgtttccagtaggtagaactgggacaatatacactctcagggccataggagaccctccataattacatgcataaggatgcacagaggagagggagggaggaagaaaggaagggcccaataaagtctactcgtggaaatatactcggactgtgggacagaaacaatgttcaggaacataaaaagtgaccatcttaagtaatgcttacctaatatgactaaatgaccctacatgcccagctgggcagaacaattagaaatgctgatctactcttcaatcaagagggaagtcactggagctgctgaacgaacagagcataacccatgagttgtggaaactgcaatggaacggcgccagcaattgccctgcgaatacaaaaagcggagggccctcctctcccttcctcagggtcttaatctacactcaacttctcagggactttgggcaaaacagaatactgtttataaggcgggtttctggtaacaatgtgtgggttggttttgcccctggaggggttaaaatgcactattctggcatattcaccatttaagtcaatgccacatgaacatcagcaggtgtgaaaagatcactctgagattcttggtgtttcttaaaagcagaaggtgaaattcccatgttaaagatgcgctcctagaggaagcaatattcttatcatcaaggatggaaagtcaatcgcaagagaattctgaacagatattgctgaactaactcctgtccactaaggctccccacataatttggttgttttcttcacaactgactgctctttgtccaatctgacatatgagtatctgacattgcttcttggggtcttcatttcttcctgagagctcctgtgccaagaaaaacttgtaatatgctttctcctatgaatctatgttatgtcaatttcactctcaaactcagccaggaccctagaaggatggaggtggaatttctccacccctacacctccaaaatgaatattaccagaatttaatattattgggaaaaaatgttcgaataatcctcatgcctctaaaagtcattatatctctcaccaactgtaaatagcttagaatgttgaattttggagtagatgaagaaagaaagatctcagcagtttgggctcagaatctagacacataatgacaggccagggcctctggctcgtaagatacggaacagctttggcctcaagcagagcttgggtctccactgacactatcagctcaatttgaaacaatggccttgttttcagaaatccttcaccataaaatattttgctatttcattagtcaccattaaaagtgttaaaaatgattcattcaatactttgtattttctattaaggaggaataaaagtattgactcattcaatactttttattttcctattaaggaggaaggtttacatgcttggtgttttctctccagggttcagagttcatgagaatcacattctcttgatatgggctatttcctagcctgaaacagagaaaggccatgcatacatcccaggattttagccattgttaccagcagtagaaactttgacaggccttcctggagaccatccaccactagccagagttcatgggcaagactaggtaccccggaatcagggcctcgagcatggcaagcaagcatggggtccaggttggtgggcaaatgtcatagcctcagtatgacaatggccagcaaaggccagtgatagagttggatgaagcttaggtatcagtatataggagcaaggcaaggggtcacttattgtagacttagtgcatagaaacatttaaaaagcacagtaccaggcattatgccaggcactgggaggcacacagatgagtgaagaggggtgcttatgggtgatggatatgtaaatggacaattacaatacacagcagtgcatatgtttgaaatgtgcacaggtcatcatgagggcacagtgaaagggcctccagcccagcctagcagtaggaagtgggggggctacaggaggaggccagagaaggctccctggagaatggatgcctgagctgagtcataacagatgcagagcaattcaccagacaaaggagagaagcattcccatcattagggacaacaggctggcctcacattgtgttgctgtggattgcagactcaagcaatattggcaaaaagccccagactcagtgtctatctgtgtagacatagggctggaatagtggagactcaagaggcaggtctgcatgagacatggtcagggccagggaagtgtggtaaccccaggaaggctgagctgtgcacttaaaacaaacaaacaaaaacaaacaaacgaaaaacaaaaacaaatccaggaaggtgtgtattaggacaaagggcacaaactctaatcacaggggaaagtaacggacgttgaagaaactagattgaagttgacaaagcagtgaaactagatacacctggacctgtttcttggccagagatttactgtttttatgtcttggtctcaggccaaaaatttgtcctaaaattagagcagggcactgggttcacaggtggctgctacgaacatttccagggccagagtgactggagccacaggaacagggaatcacagagaaacaaaaaactaagggcacaagccgcagtgggtgagacttgatgagcaaggcagttttctgacctagttcaggcttcccctttactttcctgtgtggcaggaatcaatcccagcacagctggactcaggctcatagatggaagcttgcaatttgaagcacctggccaaggcagcctgcaccgagcagggacacagctgtagctttttgtaagtgagtcctctcatgggtaggggtagggggatcacattaaaaaataaataaaagctactgcaaagatggatatagcagacctctctatattattaaacactttgtctcagagctgattttatattgcccttaagtgcagagatagcaatagtcaactcagcagtgcaccaactcattcgctcaaaattacaaagggacaacttctaagatcacatctctcaggaaaatacaaagcttgtttgccatctagcccgaattaacctgttcaatatcatgcacaaatgcacagtttaaaatacttgcccagcacatttttaaacatctctatacctatttgctttatatcgttgtataaatggagtatgcatacatgtgtgtatgtgtcacatatacacacatacagggtaaatatatgtttatatgcaggtagatatattagccctgcatttatagttctaaagaaatgagaatgctttttttcttggaagaaccctttagaaatttataggtgcttagcatcataaaatggcttttcccctgacctgccacaagtctgtggtgcaacctcacagcagcaatctcattactctaacagtggttacatatggtgcttcaagatttttatttttaaatcacagaaacccaaaaacgtagatatcaaagacacttttcaaaggcaacttctaaaaaggataaaacctcttcagacagctgtcccagattaatgaaacctttctccctcaagggaaatgagaacatcctacaggaaatagcaaaaggtggcatgacagtatctccagaagatgaatttccttcacttcatttatagcactaacccttcagttctgccttaagatcagatttgcataatcatattttgtatccctgatcatttggcttatgacactgtaatatcagttgaaaatttccaagaataactatatcatttcagaagaggaactggaagcagccaccagagttgaacctgtaagcaaggtggcagttctgaacatcagcaggagctactatgcatgatttgagattattcaaaagccagcatgcaccttcacacccttctcaaagtagggtgtggtaccggctggctgagaaaatagattagcagtcaataatacacttttaaaagaataactatttttccaaaggggaaaaaacatgatttagtctcttttttccaccctatcagggtattgactacttgcattttttggtaatcattagtcattttactgcaaaaatgaagaggtacaaaaatacaatgtaggaaagagagaagagaaaagaaaaggaagatttcaaattcagaagaatacatctggaagcatttatttagttgatccattgatgaaagaaaaaagtcaattgatttcacaaggcaaaattggggctactttactagtgtatttcccagcagttgacttgataatgatttttcaaaataaaatatattatctgaaaaacataactcagcataattgtaagaatcatacatttgctacaaaatagaaaaacatactaaaatactattttattgctaatttgtcatctaatgtaatggtgaattaagacctcagaaaataaggcctgaaacacaggaaatttaaaaatatttgtcccaggtatgccacaaactgtgtgaagctttcatatgtaatttcttggcttattcaattaaattatccaatcactgtgaaaagaaacacatgtaaaacattcattttacatggttcaacactatgcaacaggttcatgtgtcaaaagaaatcactgactacaatagtccacagtaagactgagctttttcaaaaagcattttgagtttgacataaatcttgttttttatgggatatttcttcctttgttagttacacaatatttcccctcaataacagcactaagttcagtaacagcattctatgtcactagagaaaatcatggttggtccttcatatctgtgggttcaacatccgtggatacaatcaactaccaattaaaaacattcaggaaaaaaattgcatctgtactgaccagatacagacttttttttcttgttattattctctaaacaatacagtataacaattacttacataagatttacattgtactatgtactataagtaatctagagatgatttaaagtataccggggggatgtgagtaggctatatgcaaatactacatcattttatacaagagacttgagcatctgtggattttgggatccaaggccatgcttgttgccaattcccctctgataccaaggaatgactgcatgtatctcctgcaactgctgattccacacgtgaaaatgtgattatattacttgacatttatgtgtcactttttgttttctaaatgctttacaatttcctatgggattcaaatgagcagaaaagaaagcccccagtacacaggaaggcatgaaccatggaaacatctccaactgctaagttcctacagagagacacgggtccttacaaagtaatactggcctgaagaagcaggaccaaggagcatgctatcagcgaggatccaagttaataccccagacctccaaggctggaccacatttaccaatggagagaaaaatacatgcccaagatgagagtgaacgacagaagccaacacaagatctcctgactttccatatgacattttgcatcactgaagattacgctactctgaagaccttgactgaacaactaactgctggtaaacaccggcattttttttttaacttgtagttttcctgaaatgcctggaaattttccttctaaaggttgtgctcagtattcgagaataagttaaggctaagttcataacaataacaaaggctatagagtgaacagaagtttttttggtttggtaaggaagggaggggcaaggggcatttgcagtcaaaggccatctataagtacaattgtattatttacacctaattattaaaatcataatagaggggctaccgaaatgtgacagctaaattagtgctcactgcatgaagcacaagaaaataaaagaatccttttgataaattccacagagagaaaaactaacgtaatgatatttggcaatgaagacgggtagcacctttaaagattaagagaaacccataaggagcttccaatttccaatctaaattcaagtattacacacacatataatagtttgggcaagcatatggctgtccggactacactatggtaatgcagtatctcagcattgtcttttcattaaaaattgtattgggccacatcaggcagctcctctatctttccttcatcatgaaggagagggtgggaaatcgtggtgcgtcatagaatgaaacttgtcagaagcactggttcatcatcctcacaggccaatctgctttcttgtagatatgtgcttttctaagactacaaggaacactgcgacttttcctgaggctttgggttactggaagatgaggaaggataaatgtgaagttgtggactgttttaaattccacctgaccattctgctttcctgagcaacctacccacgccaatttagtactggctttcttcagagcattaggacaatgggattctgtctacagctgtgccatgaacggactctgattccttaggcaaagaatctcttcttgctaaaatagttaatttgaaggaataacaggaatatataaaataatgtctcaaagtgttttggtcacctggtaaagaactagatttcacatgaatgcaacataatcagtactatccttagctattgatgacatatctaaatgggacattctgggcattgtccggagcatgctgaacagaagcattatattttcttagaaaaacttaatggtgccctcatttgaccagcttttcaccatgtccaaaccttccagaacattgtgatttaaatgatcatagtctgttcaatttcactgcaagaacatcattacatgttttattataagaacattaaatattttccttccgtgttggtttttcaagctgttcttgttctagagtaaaagtttcatgtactctaacaaaaccttttcagttatacagacaggtaactatctcctatttcccaaattttcagaatgagtaaattccagaggcactgatgataccaatatactcatattacctcaagtgaagaaagaaaggaacacacgaacacagatagtacctggaatagtgattatttaatagtaagtgatggattagtaagtgaatgtgtaagtgacatcagcaaaattgagtgaagatcccagtgacatctagatgtgattagaaactcttaccatttcaacacttgtaagttcaggacattcatttattttatatttatttattgaatcacttgtcatttatgtgccactttctgttttctaaatgctttacaatattagaatctaggaagacagtggtgaggaagacagattcagtccttgttcttgtgaagtttacattccagtagaaggggcaggaccacaccctcccatcgcacacacatacacacagaacatgaacacggaccacaagagagcggcacattgcgactaatgtcagggtcatcacagagaaagagccgagggagccgttacaggtaagggaaggctgttctgagaaggtgacattttggcaaagatcttttaatggaggacagaggaggcaggaaaacaaccagagaatgcctagcaagaagttggcctgttgcaaaaactgtgagaaaatcatccactctgattggcgaggatgtggccagcagggggaattgcaggaaaatatgacaaggatttacccaagaagggactatttgcatataattgtattaaaaaaaccagagccataaacacatgtaatattgataaacaatgtcttttatgatcacaaacagcattacagtgtcttttttttcagaaatatattatgcaactatttatatcccaagataactgcagacattcagacattcacagaaagaaacaaagaccgttattgtctccagtttatgagcttcaggaaaaaaacgtgggcgtgtgtgtgtgtgtgcgtgcaagcacgtgtaagagagagagcaagaacagttaattactaaacattagaagaaagtcaaaccatgtgtgggctcatgtcattcaggccatcacaatcattttattccacatgacaaatggaataagaaatagtgatatttaaaagtaaaacatgcgaagaactgtaatactttaaagcacaggttagaaagctttttctcaaagggccagagagtaaatggctctaagggccatacttcctctgttgccagtaccctacttggcttttctagaacaaaagcagccacagacaatacataagagaacaggtgtggctgtgtctcagtaaagctttatttacagtaacaggagatgggccagatttgatccacgagatgaggtccgctgactcctgctttagaggactagaggacaatgctcaataatatctagaagaatcactccaaaatatcaagccaatttctcaaacgtgggcaagagaaagagccaggaaagggtgacaagaaactgctggattggattagctagaggttatcgtattttactagccataggcacaaatttaagtgatagcgtaaagaaatctataactgtttctattgactgtgcaaatgttaaaagaacattgtcaaagatcttatttttaaaatgttgtatgaatgcttctggcatgaggtacgcagctggcacagatgattccaaagttcccatccaactctaaaattctaagtttccaaaatttaaattataatacaattactagtatctggcagaatttcaaaagcggttgaaatggtgttttatgacttttttttttcctggcttaacatttttgtaaattctagaatgctaattcttgaagcttggcagctaaaacaataattgactatttcctagtcactttgcaattggtttcttttaattgaggatgaattggtacagcatgtaaaatctgaaaactaaaaatggatgctttagacaattcattcttttcactgaaatgattcaaccatactaagccatatatctacttttatatatcatttagtgaagaccctgactaagcactcacattgtataatcactaagtacacattcattgaccatctattacagggtaaattcatgattggcctatattagggcataaaacgcttattaattgagtgaatgaacataaactctaaactatggtgtctatgggttcaaattatagctctgccactttctagctgtgtgaccctaggggaaattacttaacctttctgtgtctttcttggtcattggtaaaatggggagaaaataatacctatattataaggtattgtgagaataaaagttgacaaccctatttccacctgcactttcattctgccaggtacaatagttgtctaacatataagcatcatatcatcctacaaaagaaatggtcttccaagagagcctggtgtcctgctgatttctggcaaaagagttcccacttaaaattctactctaaagtatcgtattcaaaatgaaaagaggaaaacaacagaaaatgaaaatctgttaaaggaatcaagtaatttcatttgctgcgtgccatacatgttgctgggtattacgaaagcttcaaaagcataattcctgttatccaggagctttaataaaataaaacatactaacaggtaaaggtaattaaatgtacttgttacacatttattgagcatttgcaagttaccagcattggtaatgcaaggatacttcagatacaatctagagaggcaagtcacatcaactctgtgagacttactttcttcatctttgaaatgggggtagaactgtttcagcaagattttgtgagaatcactgcacaacgggctgcaacatgacaggcttgcaacaccctaagcgctttgagtagaggctgcatgagtgtggaggagagactcagcctcccccaggaaggtgacaatagagaagtgccttgaaggaggtttgggagacagagaaatccagtaagaacatgccatgaggagagcacagcacatgctaagtcaagggcttccaacagggctcatgagtgccaacgattcactgccccaacaccagaggtacaagggttgcctcagattcaagtccatctaatccattcaccatttgcctatcagaactatttagtaaaataaaatctgatcatgtgcctgtttctccagtccctgcttaaaagccttgaataaatgttggtccattgggtgaaattaatgggatcttttacaaccctgatcctaatttacccagctttatctcctggagtctggtcaccatcgtctcttttatacatggccacaggaagtattatgccacagtggctaagggctctggttttggagttagacacacttttctacttagttgcttgggtgagttattcagactctctagagatcaatttgctcatttgcaaagtgtaaaatgggttataggaattaaatgaaatagcacacttagcatagtgtctggtacggaaggattcaacaaatactattaaaaacatgtcagaaacagtattttgggcttgcttgcaaaatggaattttggagtgaagttcgtgggtgaggcactaacagtgaggtcctgcgtgaggatggtggctggtcgagaggatgttaggaaggcagggatttaaaaggacttggggaaaaacaaccaagacctagtgagaggctggacaagtagaggagaaagaataaatcgaggatgacccaaagattttgacattgagataatagtggtcctaaaaaaaaaaggagaagtcaggtaggtgagatgggatgattgaatttataatttcatgatgcataattatacaaatttataaaatagatgccatattcaaaagatagaaatttctagatttaaaattatgacattaccatgttaacgaaatttcctagtctgaatcctgttaacattattaatacttttagccttcatgccaagaaacacccgtgttctcctgtctctctttgcatcctccccagctaattccttcttctcctgccccctaaagaacagccttccctggatttcaagccacaatccttctctttttctattaactgcctccctggggcgggaggttggggggacttggttaatcttactcttaagattctattggactttaggtctccagtttacctgcaccttcccctatattcaaactaggcagaattttccatacctagaaataaatttgagtgaaaaataatgataatacaaatgtcagtaacaaagcaggaatttcaaagtcgaggcagagataattcattcaagcttttaataccaatgcatatgttatttaccagtaatttttcttaaataaaaatggatcaaaatgtgagaaaccctccttgtgtccctcaggaaatgttttctcatgtgtaacatttagagcttgttgattcccaaaggagattaaaatgcccagttaaaccccacaataaatattaggttgaaacatttgaatttcttattaccgaagacccaggaagccttttattaggaaagctgccttgccaggacatgattttttttccccaggggacataattaaagagggcgatactgctgagagcatgtgcaccaacacgctgtatttgtcaacacacacaatgccttcctagagaggaaaagcagcccagctgttctacagtggatcttccaagaatgtattcaggctcaacaccaaaaccgccaccaagaaaatgcaaaaagccccacagaattttacataggaatttgaatagtgtggccggaaactgaaacacagtagaaactaccagcagagtacgtagtgtttgatctccaaactctctctgactataaccatatgacaaattgggcattaaaatattacggttaatgtggtacttcattcaagaaatgtattcaagtttatcacaggtaaggggtgaaggagatttcatagatgactcccaggttcctaacttatgcaactgggtgggtgggtagaggtgccatagactgagacagcaaacagtagaagaggggggagcagatgaaagggggtgtttttgtgttgttttggaaataaagggtttgatgtgaccaggaagtactagtagatgccctcctatttaatacataggccctaaacatggtcaataagtcaggtctgagttatgaatgggaattaatttaaggcagtaattcagactatgtaattcttgctttgcctttgctatttaaacatttagtaactgcttaaatcttctaacttttggcttgaattattttcttctaagtttagcttgatagtgttattcattttatctaactatatttttgcacccattaactatctctcatcctccactccccactacacttcccagccactggtaaccattgttctactctctatctccattagttcagttgtcttaatctatagttcccacaaataagtgagaatatgtgaagtttgtgtttctgtgcttggcttatttcacttaacacaatgacctccagttctatccatgttgttgtaaatgagagaatctgattctttttttttttttttttacggctgaatagtattccataatgtatacctaccacattttcttttattattattcttcttattattttttattattatactttaagttctagggtacatgtgcacaacatgcaggtttgttacatatgtatacctgtgccatgttggtgtgctgcacccattaactggtcatttacattaggtatatctcctaatgctatccctccccctccccccacctcatgacaggcccgatgtgtgatgttccccatcctgtgtcgaagtgttctcattgttcaatgtccacctatgagtgagaacatgcgacataccacattttctttatccgtttgtctgttgatggacaattaggtagattccaaatcttggttattgtgagtagtgctgcaaaaaacttgagagtgcagacaactcttcaatatactgatttattttcttttggatatatacctagcagtgagattgtgggattgtatgatagctctattttcagttttttgaagaacctccaaactgttctccacagtggttgtacgaatgtacattccctccagcactggtttcccttttccccacatcctcaccagcatttgttattatctgtcttttggataaaagcagttttaactagggtaagatggtatctcattatagctttgatttgcatttctctaatgatcaatgatggtgagcaccttctcatatatctgtttggtatttgtatgtcttgttttaagaagtgtctattcagatattttgcatatttttaaattgcattattagatattttcctatagatttgcttgagctccttatatattcttgttattaattccttgtccaatggatagttgcaaacattttctcccattctgtgggttgtctcttcactttgttgattgtctcctttgctgtacagcagctttttaacttgatatgtcctattttttcatttttgctttggttacctgtatttgtggcatattacacaagaaatatttgctcagcccaatattctagagagtttccccaagcttttcgcagtagctttatagtttgaggtcttatatttcagtttttattcaattttgatgtggtttttttattatactttaagttttagggtacatgtgcacaacgtgcaggttagttacatatgtatacatgtgccatgttggtgtgctgcacccattaactcgtcatttaacattaggtatatctcctaatgctatccctccccccttcccccactccacaacaggccccagtgtgtgatgttccccttcctgtgtccatgtgttctcattgttgaattcccacctatgagtgagaacatgcggtgtttggtttttcgtccttgcgatagtttgctgagaatgatggtttccagtttcatccatgtacctacaaaggacatgaactcatcattttttatggctgcatagtattccatggtgtatatgtgccacattttcttaatccagtctttgtatatgccaagaggtaggggtcttgttttattcttctgcatatggatatccagttttcccagcaccatttattgaagagactgttctatctccaatatatgttcttggtacctttgttttaaggtatgaattcactgttgataagtggatttgttttgtgggttccccattctgttccattggtctatgtgtctgtttttatgccagtaaaatgctgttttggttactgtagctttgttgtaaaatttgaagtcaggtaatgtgattcctccagctttgttctttttgctcaagacagctttggtattctgggtcttttgtgatttcatataaattttaggattgtttcttctatttctgtgaagaatatctttggtattttgataaggattgcactgagtccgtagattgctttggatagtatggacattttaataatgttgattcttccatcctatgaacatggaatattcttgcattgttttgtattctcctaaattctttcatcagtgttttataggtttcatcatagagatctaaaaattcattggttatttcctaggtgtttactgtcacttgcaacagggattacttttctgatttctttttcagattgtttgctgttggcatatagaaatgctacggattttttatgttgattttgtaccctgcaacgttactgaatttatcagttgtaatagttttttggaggagtctttaggctttcccacatataagatcatatgatctgcaaacatagataatttgacttctttctttccaatttggatgtcctttatttccttctcttgtctgactgctttagctaggacttccagtaatatgttgaataacggtggtgaaaagtgggcatcctattcttgcttcagatcttaaaggaaaggcttttcctttttcctcattcagtataatactaggtgtgggtctgtcgtacacaccttttattgtgttgaggtatgttccttctacacccacttttttgaaggtttttcttttttaatcgcaaagtgatgttagattttatcaaaagctttttcagcatcagttgaaatgatcataaggtttttgtccttaattctctttatattaagacactatttgggcaaatatttctattgatatgttgactgattcatctgcatatgttgaagcatccctggaataaatctcactcagtcatgataaatgatctttttcatgtttttgagtttggattgctagcatttcagtgaggatttttgtattagtatttataagggatattgaccagtagtttccttttctttgatgtgtccttgtctggttttggtatcagagtaatactggccttgtagaatgaatttagacatatttgttcttcctctatttttcagcagagtttcagtaagattggtattagttcttctttgtatgtttgttaaaattcatcagtgaaaccactgggtcttgggcttttcatttctaggagaatttttattacagctttgatctcattagttgttattggtctggttcaggttttgaaattcttcatggttcaatattagtaggttgtatgtgtctagaaatgtatccatgtcttctaggttttccaatttattgacatacagttgctcatagtagtctctaacgatcctttaaatttctgctgtattggttgtaatgtatttttccatctctgattctatttatttgggtcttctctcttttattcttagtctagctaaatgtttattgattttgtttatatttttataaaagcaactttcctttcattggtattttgtattgttttgtttcaatttatttctgctttgatctttattatttcttttcttatactaatcttgggtttggtttgctctcacttttctagttttttaagctgcatcattaggttatttgtagttttttctactttttaatgtaggcatttatagctataaactttccttttagcgctgctttcgctgtatcacataggctttcatacgttgtgtttccattatcatttgtttcacgacatatttaaattttcttctcaatttcttcatgacccactggtcattcgggggcatatattggaatttacatgtctttgcatagtttccaaagttcctcgttattgatttctagttttacgcaactgtggtgagaggatacttgatataatttcaattttcttgatgttttaagacttgctttgtggcttaacaaatggtctatccttgataatgatccatgtgctgaggaggagaatgtttattctgccagccattggatgaaatgttctataaatatctattaggtccaattagtctacacaacagattaagtccaatgtttctttgtagattttctgtctgaatgatctgtccaatgctgaaagtggggtgctgaaatctccagttattattttattggattccatctctctctttaataatatttactttatacatgggtgctccagtgttgggtgtaagtgtatttataatcattacatcctcttgctgaattgaaccctttatgattaaataataaccttctttatttctttttagagctttttgtcttgaaagctattttgatataactatagctactcctgtacttttttagattccatttgcatggaatatcttttcccatccctttattttagtctatgtgtgtctttagaggtgaaatattttcttagtaggcaacagataatgggtcttgtcttttatccattcagccactctgtcttttgactggcaagttaaatccatttactttcaatgttattattgataagtaaggacttactcttgccattttgttacctgtgttctgggtgttttgtgatcatttcttgcttctttctttttttcctgtcttcctttcagtgaaggtgaatttctctggtgttattttttattttttaatttcttgctttttattttgtgtatttgttgtatgctttttgttttgaggttaccatgaggcttgcaaatatcttgtaacccattattttaaactgatgacaacttaacactgattgtataaacaaagaatcttacaaataagcaaagagaaaatgaataaaaactctacactttaactttgtccccccacttttaaattttcttgtttctatttatatcttattctactgtctatatcttgaaaagttgttgtagtggttattttttgattggttcatctcttagtctttctagtcaagatacgaatagtttatacaccacaatttacaacaccacagtgttgtaatattctgtgtttttctgtgtacttacttttactggtgagttttgcaccttcaggtgatttattgttgctcatcaaagtccttttcttttggattaaagtactccctttagcatttcttgtaagacaggtctggtgataaaatcctttgtcttctgttgttctcgaaaagtatttctccttcatatttgaaggatatttttgctggacatattattctagaataaaaatatttttccttcagcactttaaatatgtcatgccactctctcctggcctataaggtttccactgagaagtctgctgccagatatattggagatccattgcatgttatttgtttttttctcttggggcttttaggatcctttcattatccttgacctttggaagtttgactactaaaggtcttgaggtagtcttctttggattaaatctgcttggtgttctatatgcttcttgtactcgaatatttatacctttctctatgtttgggaagttctctgttattatccctttgaataaactttcgaccttgatttctatatctgtcttctctttaaggctgataactcttagattttcttttttgaggctattttctagatcttgtaggtatacttcattcttttttattcagtttttcccaagatttcaaatgaataatttattaggtgaaaataaggttacagagactaagtaggcacaccaaagatggctaataaggacatgtagaagttctgaaaatgatctgagataacctttgaaaatgaatttgtttatagcccaaacctactactttagaaaaccctggaaaacagaagaatacacaagcatgcattccacttttacatgacatcattccatgtcatgtagcctctggaaaactccactaggtgctcattaagtatgaaagttttggcaaatgaagtcttaaagtcttaatattataaaaacagttttgaccttctggactccctgaaaaatcttggagatctccatgaaaccatactttgagtactggtatcaccacacttttaggtgtttaaacatcacctgcattcatttttcttttgtcctttctgactgtctattttcaaatagcctgtcctcaatctcactaattctttcttctgcttgatcaattctgctggtaagagactctgatgcattcttcagtatgtcaattgcacttttcaactccagaatttctgtttgattctcttttaatgatttcagtctctttgttaaatgtatctgatggtattctaaattccttctctgttttatcttgaaatttgttgagtttcctcaaaacagctattttgaattctctgtttgaaaggtcacatatctctgtatctctaggattggtccctggtgacttatttagttcattcagtgctgtcatgtattcctggatggtcttgatgtttgtggttgttccttggtgtctgagcattgaagaattaagtacttattgtagtcttcacagtccttttttaaaataattcttgtcaagttgcatctttttattgcatagtcaaatgttgtccttggacattcttaccatttaaacaaatactcaaaaattgtaagtcataataaactctattatactattgtaatctgttttctaaggaaattattctatcatccaaaaataacatttatgcttctttcagagagtagttaaaatgttattttattaaaaatgccaatattagtaataatggcccatgaagaaataactcttctattgtgaaggcctgggtagtccaattaacaacattaccacccaacacaatatatctacatatctatatctgtctgtatctcataaggcttgagacagcctcatctgtaagattctcatcttgatagtgataggtctctgagacatgaaaaataaacacgtattccacaaatagattttagtatcttacagatgtctgaaaaattcaagttatcaaatagcaatagaagtttctagcttctaaattatttctgacataaaaagtatagaacggcaaaatagttaagatttatctcagaacacactaacttgagaagatttatagaatattaaaatagaaaaatagccaacaggattaaaaggcttgtttgtacctgtcctttggaatgctctccaggtattggtattcataaatttgagtattatgatctaagtttttctgtcactatgggcatatctgtattaggcggtaccccaagcccagcaatgctgtgaggtgattctgctcttgcagaatcacagaggtgctgccttggtggtctcggagaagatcgggaaaaattttctagattgccaggcaaagactcttgttctcctctcttactttctcccaaacaaacagagtctttctctgtgctgagctgcctggagctgggagagaggtgacacaagctcacctgtggccgccaccaccactgggactgtgctgggtcagacctgaagccagcatggtactgggtctcacccaaggcccgcactaaccactgcctggctaccacgtatatttgctcaaggccctagggctctacaatcaggaggcagcaaagccagctaggctcatatcctacccttcaggatggcaagttcccctttgtcctggggaggtctagggacacaatccaggagccagggcctggagtcagatactttagaaatcaacctgatgccctattgtactgcagctgagctggtactcacaagtcaaagtccttcccactgttccctcccttttccacaagcagaagaacctctctccatggccaccactgcccaaggcccgtgatgagtactgccagggtactgctggtggtcactcaaggtccaagggctcttgagttagcttgtggtgagtgctgccaggcctgggactcactcttcagggcagcaggttcccctctggcccagggaaggtccagaaatgccagtcaagagacaaggcctggtactgggtaccccaagcctgcttggtgctctactccactgtgagcaagctagtacctatggtgcaagacaaagtccactttactttcccctctcattttcacaagcagaaatggtctctacccctagtcacccaaactggggatgtattgggtcacatgtgcatccagcatggctctgagtcacaaccaaggcccatggcaagtgctgcctggctgtgacggttgaatattcagggctcaaaggctctttactcatcaagtgatgaatcctgccaggactgggtccttcccttcaaggcagtgggttcctttctggcccaagttttctctagacatgtcatgcagtagctagatcctcaggactctatctggtgtcctagcctactgtggttgtgctggtatctaagatgcaagacaaagtcctctttactcttccttctcctctcctcaagcagagggaagaagtctctcttagggtgtgagctgtgttgcctggtactgggggaggggtggcataagcactttcttagctgtgtcagctggtgtccgactagatcgtgagcacgccaaccccactggctccgagtccagcacagcaccaggacttgccccagaattgcagtccttgtggcctagactagcatttaagtttatttagaaccccagagcactttagcccacagtggtgaggcttgccagaattagagttctgactgctgggacagacaattcccctctggctaggactagtctaagtgctgccttcatgagtgctggctaagttctgtcccacattgctttccactgtgagagggcagcactgagttcctatacaaaaagtcccacaatcactgtgttctccctccccccaggcacaccgatttcctctctgagccacagggcccctgctgggagacagggaaggggtgctgtaggcaattcaacactgtttttcagtgcctcttttagtgatatgaagttaacaccaggtactgtgaccactcacctgatttttagttcttataaaggtgatttttttttgtgcagatagtcgcttaatgtggtgatcctgcagagaggatgatagtggaggcatctatccagctatcttgctccacctcccttactatgcaattttgctaatgtctattttttaacacggtatcattgtttctctaaacatagcctttaaataaataagacaggtaaaaattttaggtgaaaatgtctagcatatgataagaatatgcaaaaggaaaataaatccagtcaatgtgccttttcttccaagttgcacctttttactgcatagtcaaatgttgtccttgaacattcttacagtataaacaaatactcaaatatgtgatttgtaataaactctattatactcttattttacgaagaaagtatttcatcatctaaaaataacatttacgtttctttcagagagtacttaatcggtcattttattaaaaatgccaatgtcagtaataattgcctataacttttctattgtgaaggtcttggttgcccaattaacaatatcaccacccccacaatatgtctatatatttaaatatctatacctatatctcataaggtttgagacagcctcatcagtatgattatcatcctgatagtgatagaactctgagacatgacaaataaacacagtattctacaatcaggttttctatcttacagatgtctgaaaaaatcaaggtatcaaatagcaatagcagtttttagtttctaaattatttctgacataaaaactatagaatagtgaaatagtaagatttatctcagaacacattaacttgagaggatttatagaatattaaaatagaaaaatagccaacaggattaaatcctgggctaagattgatgaaatattccagcaaaactttattgatctactcctgttaagtaggcagctttgaatttctgctgacaagtgctggggtaaccaatatcaaaatgacaactgaaactaaaaaacacataaaacagaacagaaaagtattcaatatctgcatgaatctcttagtaaacgaatcttctattgaccaaaaatttgatttcttttgcctctgggtataaagctgcatctggcaaattggctatgaaaataattttttggagaacgagaagaaaaaaatgaataattttagtcattctgaaatcagttaaaaattgagaccatatgaacatttattcaggttaaacttttgccttgaagaatctttattttagtttctccccaagctagattacaaggcagaaaacaaaacgtaatttgcaaacttcatgcttgacactgaggaatcactcttgatgaaaaaggcctgacttgacacatgaaaccatcagcaatgtatagaaccagagctatcccgtgtagataaaaaaaaatgctgaatttttccactagcctttcagtctcagatgactaaattatggatacattttctaaagtgtgttcatcttttaaagtcctaaataaaagtttcttactcttgtagaattatattggaaaagaagagtatacagtaacctccattaacctccaaaaccgtggtgggattctggtcagcttctagctatgtatgttcagctcctaccagatgccggatttattttatacactacctctggtctttaaagtgacctttcaggtaataacacggcccccattttacagatgaagatactaaagtacatagagtggttcagtccattcgccacgttcacacagttaataaatgaaagagccgagttttgaattcaagtctttctgaatcccaaatcctgccttttcaactctattttcaaatatgtgcccttagtggactgattgactcactcataattttgtgtcggattttaggtaggatttcatatgatctgtaccttgaaattgcaagataaggcactagaatggattccaggggttatttgtcctaaacccttctttttataatggaggtaactgaagcctagggactagccaagaacatacagcaaggtaataacaaagttggggctaggacatttatgttttaattaatatttaagctttactattaggcaaaccacaacataaaatgaaaattttaattttctgttacaaaagtgaattatgagatacattaaaaaaacgaattttcaagcattcatattatcatctgttgttgttatttatgctaatatatgattacaggctttttcatgagtgcgttctgaggttgactgcactacagaatacataacaaaaaaataagtggaaacttggtttaaaaacatacaaaataaattccacactgagctctaaaagtaggcattgagcccaatttctggaataaatcaaagagtaggcagaaaacagacagaaggaacagttattttagcaagaaaagtaggaaaaatttaccaagccaatcatgggatgatgcatgcagataaaagatgtagagagaaaatgtgcaacactgacacatgaacacatttgaatgcaagaaagcaaaaaaaccagaaagcataattgtcctaaatgtgaataaacattcaaattatgctgcagctgcaaaatttaaactcaaggaaaagacatttgcaaaggaatttattaaatagatgtgatttgctggtttcacacaaccagcggctctttcacaaactaaaatgtacaatttatcttgatataaatgacatttccccggttgtactcaatcaagtagcaaaaagtctttcgtgagagaccctgtttattaaagagcacaatacccggatattgatacccagatgcttgggctttaactatgtagtgttatttcatctaataaaaggtcttatatattgagtatgggcttatataataaggtttctgtgtgaaggaaaaccacctttctctatagcacaagccagagtagtttttttgtaagaagttaagtttcatgttgaaaccagttcttggttgctaaacctgttcatccattcttccatccatccatccatccatccatccatccatccatccatccatccatccatccatcctttatccatccaacagatatttatgggtttccaaagtctgtgacacagtaaaggatataaaaatgcatcaaaaatcttactgttgggaattttatgatattaagatggtaactgaccagaagactcagagcttgttattaaactaacacacctactcacaatggtgatgttggcaaggaagacctttcattgtgatcagtctttgactcaaactgtaacgcagaaattgtagtgccagcctggatcatttagtttacagagtggttctccaagttaaggtctcatggaacagatcagcatcatctgggaacatgttagaaatgtgcattcttgggcctcactccagaacaggggtgtccgagggagagaatacagttatgtgttcttagtttctgtttctggttgggcacggaaaaagccccatccttgtctctcttttccatttatcactagagacagaaactaaaagccatggcttcaggctgctaaaagcctaaaaggaaacaaaacaaaacagagcaacaacaacaacaaaataaagcgggctagataagcttgctctagaccaatctgtgtttgaaaaccacaaagccttaaaatcacttggaaggcttgaaaaaaatcacagcccttacatttctacacaatgggctaggccactggtaagtgaggtcaaagaataaaaatagtaagtctaacaacttagagtggcatgctttaaatgtctgcttaagaaatttagataatgatgaattggtaaatcagagaacattttctgagcaaaaagcagacatgatcagaattgtgattctggaagactttggagccaaaggagaccagggagcagtaaactaatgaggggcaattacactgttcaggtgagaagacacagtaatttttctttggttattcaggaggatgtccagcctcaaatgaactggggcccttcactcagtttgcatgtcgtggatcctcttcatccctagtttgattctgtctgctctttttggtatttctgcctagcatctgctacgactttcctggtttccctgcactaccattctctgctgccctttctcctgtcccctccactttaatttccttcacgaggaaatctgcatgcaaatgcacatcactttaaatgtttgttgttgtctgttttatttttaatagctgctccttagagagtttatcaattatattcttcctctgagcatatgatcttctaggtcacaacacaaccacaggctttatccaactttattttcaatctgtttaatgtcctcatgtcaaaacaaaacaaagaagccctgattcaccttaatgtactaaatctgttttgccagctgaccattcatctaacattatgcccagataatatatatataatttcagtcttgcatttcacacaaacagggttgtttccaaataggaaagacaaaaattaaatttttgtgtatacacggacaccttcttgtaaatgaaacaatataaagcgagtaacaaatacagctataattaaatgttgttatattaattctgactattccaacatgttggtcatactttggatctcatataatgtctcaaatatacatggggactcagatgcatttctcacttagctgacactatgccatctactgaagacggacaatttattcatgaagaagttagtgtcgaaacagaattcactcggattccatgatatttaggtataattatttaatgtctttaaaacacaaaacttttttttttcttggagatacttcatttaggagaaaaatgctgatttagaataaagtaaaaggagctgcaacagatgcggctggctccctgcattatgtcccggggttcactttggatgtcaaccacagctgcaggggagtctccttgcctttgcagggatccctaacccccaggtcatagaccagtactggttcctggtaggaactgggctgcacagcaggaagtgagcagtgggccagcgtgcattacggcctgagctctgcctcttgtgagatcagtggcggcattaaattctcataggagcatgatccctgttgtgaactgtccacgtgaggaatctaggtatgtgctccttatgagaatctcattcctgatgatttgaggtggaacagttttatcccgaaaccatctccccacctccccaccctgtccgtggaaaaattgtcttccacgaaaccggtccctggaccactgccttacagtgtacacctcaagtgacaactaagtgtctttctgctttctacccatgcatggctggcacagcccagcattgtgagggaattcatgctccttggggaaatccaaaaccaaggagaaaaagtcagtcagtaaacctcctgctgcacatctttctaacggaaatttgggcatctgtacccctcctgggaggaaccaagttcccattgcctgcagtggtagacttgctaacccacccataatttggcctgcgcttcttccctgattcactcttcctgcttccaactcttgatctttggatcagctccctaataaattgccatacccaagtcactgtctcaagcaagtaacgcagacaaagacaatagcttattattcagcaatatgaatctccttctgatctgacaccacttctgtagtatatttgatttatatgtggtaagacccttctttttttctccctccaaaaactacataatgaaaggagtggagatgatagcaaggactcaagggttttcattgcctttcttttgttttcttttctttttttttgagatggagtctctctctgtcaccctggctggagtgcagtggtgcaatctcggctcactgcaacctgtgccttccaggttcaagcgattctcctgccttagtctccccagtagctgggattacaggcacctgccactgcctcagtctccccagtagctgggattacaggcacctgccaccacacccagctaatttttgtatttttagtggagatggggtttcaccatattggccaggctggtctcaaactcctgacctcaggtgatctgcccacctcggtctcccaaagtgctggaattacaggcgtgagccaccacgccctgcctttcattgcctttcttagcacacttacatcatgttgaacatgtctgtgtggataaatgcaaatttgttcaatatgctaagaaaagctaacactatgccatttacttccataatttcatacctaacctaccttatgtacaatatttgggtccacagatttataaaaatggcatgtgcccaatatgccgttccagattaacaacaacaatgaagattaaatatataaaatacatctggcctagattctgtacaggtagctaggaagttaaaaaacacaggctttaaattcaacagactgttaatatgtctggaaagtgtatgccaggaatatttttgttcaaatataccatgctattaaaaaatgtttcatataggatagctgaagaggaagctgttatttaagaaactgcttcctatacaagtaagggggaaagggggcagttttacctttgattatcaattgtccattttccttgcttccgagtcaggaaaagatccaaattgcaggcttttttttaacctgatgtcactctgggtatctgatgttcaactgctctgaaacataacaatgcaataattagatgtaataactagcctgaaacaaaaagacacttaaaaatgatctcataagaactattctgacacacattatattcaatgctgttaagaagagagtttcatagaaaatctacatggccgtgttcttgcatgatgtcacactttgtatttttatgcttttcagaaaataaaatcaatcacccagaaaaaaaacaatgttgctgtaataaataggcttgatattctacaatatacatttcctatcatttattttctttaaaaagcaataaaatgcaagcatcaatgatccaattctgtaagacataatatacatatgcgattgtattcacttcctgagcgttatttgttttctcaacagtacaactaagccagtgtgactttaaaaagggctaaaatgtatcatttttttccagagtggttcttttcattctggaaaaaagccacaggaggatgccattcatggcataatattcccaagtgtgctactagagacttgctggtgcctaagtcaagccactatccttaattaggacaaatacctaatgcatgcgggtcttaaaacctagatgatgggttgatgggtgcagcaaaccaccatggcacatgtatacctatgtaacaaacctgcaagttctgtacatgtatcccagaacttaaagtaaaataataataatattaaaaaaatagtttcttaggaaagtgacaaaatggaacatataactggacccacacttatgaaggaggtaactattccagatcatatcacatgctatatggctgagctatgagtttcctttctgaaaagtgacatagaaaaggacctgggtcacacagaaaactgatctgatgtcgaaaagtgtaaatacctgtaaaggtctgtttctatttttttgtaagcaatgtattcttttggatctaggtagcatattaaaatattgtcagaagggaatgagaaaaataataaatctaagtaataagcagaaatgtagtgatattcagaattgagaatataatttgtatttttttaacctcctaattataagaattatagtgcttaaatgagtgtggaattcattttacagaagaggaagtagatgtcagaggaggtgatatggctcgatcaattttatgcagtgaataggcacagaggcagaggcagaattacgtcccagatgctctgtctggaagttcagtctctttagaaactcacatcttgtttccaaaaagaacactggactttcaaaaagttcagggctagtacaattctctgcagaatttgttagagcaatattttgagactggcaaagctgacaggtatgaaagtgttgtgggtggtaaaaggcaagaacaacagaaacacaacagcctcaggcatgataataatacacaggaggaacacttgactttcacacatacctctttatccatgacatagaagacaaaaatgagacgccatcatcaaaagcttttagtcatactttaaagattatgagccctgatttatatactagtatcctgctaagtattttcaatattccattaaaccagacaagctctgagtggactttcttccccacatatatgaggactaagtaactcaggagataatgaaaaattgttaatttctaaaaatatatagaactgatcatttatccgttcatgactatttattgagaatttattgtctgctagatagtactcttaattttctttggaaacaaagtggaaagattatgtaatttctgaaaaagacacccaaaacacaagaagaaattcattttattataattggttttataagttagataattgttaggtaaacaaatatattaatcactaggagaggtcttaaatgtcatctagtgtaatggttgccaaatgcagttgatcatcagagtcatctggaaatttgcattaaaatacaattatagaatttcatgcaagatcgtttaaatcagaatattcatgggtaaggcaggggaatctgcattttgaaaatgatcccagctaattctcctgatgaagcaggttgggaaacctaccaattctgtctgatttactcattatatagagaagggcattgaaaccagagaattgacttgcccagggcatttgcttcttggtgacagcactgagattaaaatgcagaactcctgattctccattttcttttcttttccttaccccaagtgtccctctttttaacttttttcttcctgttcttttttttaaccaccacataatcaagatttagcatctatatctgagaaagaacaagagtaaaagaacaagtacactataattatttgagtatcagaagattcaggtacgttttctcattagcaacaatttacacagatgaaaggtgaaaaacaggaatttggacttcagctgtttgattcaatcatgtgcttcctactcttccactgtctttttctagaatcagctacttgggagttgcctgctgagtccctttctttggggtctgcccagcactctccatcctgcagttgtcaaaggggtcctcgttcctggacatccctgattggaccaggagaggtgtttttcccaaaccaggcccataactgggactgtgagactatagctttgtccaggttaaagagtgatgggtaaaccatggagaaggaagaatggaagagacacacatggaaggtggaacaagaactctctcaactcatctgcctcctgctccctctttttcattcttttctgtggctttcatgggctcatgtatccgtaagagataaagagacggaatcttgctctgtcatccaggctggagtgcagtggtgcgatcatagctcactgcagcctcaaactcctgggctcaagtgttcctcctgcctcagcctccagagtagctgggactagatgtgcaccaccacacccggctatttttttttttttttttaatttctcgtagagatagagtctctccatgttgctcaggctggtctcaaactctggcctcaagtgatcctcctgccttggcctccgcctttttttttaaataaaaaaaattaaattactaatttttaaattaatttttttggcttaagctaactcaagttagtttgtttctgtaactctgcagccagagtcaagatgaatacacctcatatcattcattttatgtgtgttactctataagccagtcactttagttacggtattccaagaggcttatttaaaaactattggctgagagtgcggagaaggaagaatacacactacaaaggtattgcattttatggaacacctatattttcatcaaatacatgttttgaagtgtgataaagtggagaaggtcccgatcaggaagtcctcttttcatctcagatctgactcttacaaagtttctgacttgtgaaagttacctagcctctctcagttttaatgtccttatttgtaaaatacctcctggctaactttagccaggttagtatgaggaacaagggaaagcactcattcattctctcattcattcattcgccccaccgttctgcaaagatttagcgagcatctatcatatgccaagcactatctaggggatgagaatacattagtgaacatttcattttagtgaagacaaataaacagaaagtaaataataaatgtaaaacagtaaattatagagcagttcagaaggtgaaacatgctatagatgtgagaaaaacagaccaaggtaagaggtatcagaagtgcataggtagggaggtgtagggaggagaagggattccaccaagaaagtgagatttgatcaaaaacttgagagatgtgagggagtgagtcccatgccagagaagggtgttccaggcagagggactgcagggttatagtgctaaggtgggagtgttcctggttggtcttgggattgcaataaagtcatgggatggagtgaagtgagggaggagattagtaagtatgtgcacaatttacttctacaaatctgctgcccattgtgaaccatgtgggaactgatgaaaataagtcgcaacaatttgctttatttgggcactctacggttcacaccatgcttatatgtggatttgcccaccctgctacttggaacacattttcctccctgggtcttttaaggcactgtgaggaatagtagtaggtacagataatacaaggtagttcaactaggattgctaacctcatagacttttctcccacagttgctgtttagtatattttctgaatgtaaagatgtgtatatttttccttccaaagtagtgaataaggaattcattaagagcaaactacactactgaaaagtgggtatatgtatattaaaagatatatgtccagcaattcagtacttagacaagcttatgagcaaagatgagctgttatgaatttgtaacattaaacatggtgggctggtggggtgctgtggggaagtggaagaaggagtggatcaaggatggctcatggcttttcagcttttactctgagagtgaaaagggggccatggcaggagtttgagcttacagtcgacatggcttatgtttcaaaacctcatcctggctgctggtttggaacagtacataggagaggtcaggatgcaggtagctggaaagcttgtgaaccacctggagacaggcaacatttgctccgactcgggtggggctgaggagcagtcagatccatgctgaacttgttctgaagcaagagttgacaggaccttttgatggattgggtgattagggtgagaaaataaagagacaacaatgaccccaagatttctggcctaagcaactggaagagtgacctcgacgtcgctggagatgagaaaggctgagtctagagcaggctttttagggaaagctgatacgttcagtctggccatattgattgaattatcagtgccaactggacttgccacataggtggctggatatacaacaccggaatgtgggagagaagtctgggctggagtttgtgttagaagctttctggtatagcataggtgattggtagtattcctatttccaccaccacagatgattatataaggattaaataaaataatatatgtaatgcacagtacctggtatgtaacaggaatgcaacatattttaattcccttctgtttcctgccgttatttaaaaatgtatctttttctactgactatattataagattatgttatctttctgtgaaaaaccaatcaatttctgcaagacaccatatcatactttacattttggcagtcctttttaaaacaaagggaaataatctcctgataaaatgttgataatcatactcagtaagtcataaaagagaatttccaggaagcaaggtaaatttttgtttggataggagatgaaaggtctaaagagaaagtgaaaactgaacagatatgaatctatagacctaaaaaaaccctaaacttatctcagatctccctggattattttggacacagatcttgctttttttactttatcttctagcacttaagaatttttttttgagcaatgattaatagtcctataagatgaagaagatgcagaaatatgagaaagatgatcatggccatagggccgagtgcacagctgaggaggaacatttctgaaaggcatggatggctgagaaactctggaagctctagggtgaaatctttaaagtctacagttgtatctttaaaatgagtttcttgatttataaatgcctctttcacagaacaaattttaaactagaaaccatctatgtttaaatcctgttttagacgtgaagtttatgaaaactagacggggacatgtcttgtctgagatcatggaccaccaagatcagaggtgggaccgggccgtcagctcacttaactctgggtgcttgtctttgcactcaaatagtttccttaagttgttttacccaactccctgttttatgtaacaagcatcatttgttttaaatctcacattttatcttaaattttaccttatagtccataaactattatgtaggtttgaaaacaatggtaaactatctatgtgcttcactccagtggatcgtagaaataaattccagaatgaggtctgcatttattctgtgactttccacgtgtctgagacagcattagttcacataataaaagaaggaagactagtcagtttccactttctttgcaaatcactttgctaattggttcctcatttgtgtataagagatttcaaggcaggctggattcatgggtgtgtgactcatgcagcttcagagggaagaccccatgctcagaaaagccctgtgctttgttcagtgattttagtagttgaaccagtgttttgtgggcaaagtccaataggacagtgagcatcaagggagcaggggctgtctgcacactgtgcacatgctcagccattctgcgctgcctcattcatacgtgatgttcataatggtgaattctgggggatgcacaattcatgggagtctggtgagtttcaacatgagagcacgagtaagtgtgctatgtctgtgagtaagtggggaagctggcagccccaagacgccatgctcgccactggaaccagaacttccttcaaccttagcaagaaggcaaagggttttaagaaacacagatgaccacgggagcctattgcatcctttcttccttgaataattccctgtatcagccaactgtttatgctgaaaatgaagacatacaaagagagagaaagaaagagcaaaccacaggtctttttcttgcaatccttccttactcatgagtaagtcaaagggagagagtgtatccagaaatgaaatataaagttatttaaatcttgtatatcatttccactgtttgggtaaggatgacatacatatgtacgatctatgaaatacctaatttttgctgattgtgcatgcaaagcaactattcttatagttgcattgcacaatacaaagtgaatggtaaaatttgtgctaagtttatatttttgttttttatttacttggaataacatgaaatatcaaataaaaactagtagaaaaagtcaagaggggaatggcagaaggaaggacagttttatacattatcacctttaatggccctttgttcctgctttccgaataagggacctgcattttcactttgccctgggccctgcaaattatgtagccattaacattcaccctgatgttatgaactggcacacaactagcattattaacttacagcttaagtatcatatagagaactttggaaatagaacaccttcttttgaaaatcctagtacaactgcaaactgaattaatctgctctctgttctcctcaacgtcttctctcattttccgactgacttcttggacacttgaccaaagttcctaattcaaattaatccttctcagaagtcccccagctcttaatttaatttgatttctaatttaattcaattttaatattccatttgaaatgccactgccctcaaggtcaaatactcagctggggaagagagaaaagtcagtgataaaagaaatttagtctaaggtgtgaatgatgaaaataattgatactttagagggatattaaggtaagcatatgtccaaactcatcagattgcatatattgagtatgtacagctttttgcaatcagtcatacctcaataaagctgttttaaaaaaagaaccacttgttaggcctaaatgaccttaattagtaagaaacaatattttaaaggaagaaaacttcatattactttctgctaagaaggcccttctaccctaatccatttgaaagaatgagcagttgcctatttctgaacaattgcacattatttctttaaagatgacataatgtgcacatagtaccttgctgcccagctggtttcctgtcttcaactctcctctcccatccattctccaagtagctgccagagagtccttctaaaatactatacagtgtgaaactgatcggcttaaactcaattgcttgcagggtctgatacaatctccttggttaggaagtcagtgcccttcatgatctggccctgaaactctgctttccttctccaatactgtaaactccaacagaaccaaactgctttcttgaactcaacctccggcttttgaatcattgtccatggaccaagcctttgaatctttgctggtctcttctttgcccggcaaactcctactcatccttcatgaccccaccaaaaattaagcttcttctctgtagccctttcttcactcttttcctatttatctgtttttctcagtaaaatgaaagctccccacggaatgaacctgtgttgttcatctgatatctttggcacctaaactcaagtttggtacattgtaggtactatacaaatgtgggttgaatgtaaaaaaaaatgaagtaatgtgtactcaaacataaccaggtattttccagttaattgaaaagggccttacaatcacgaaatacataggcttatttcatttctttaaagttcaccaaaaagaaaagcactttaaaataggtagtgctagttggaaacttagtctccattctcttgtttgtacttttttttggtctgcgttcttctctcttatccttatatctcagtccgcctgtggaagcttggcagcttcaggaatttggctaaaggactctgctgaaatgttaaggtactgcctcccacaccaactcacttcttcgcaaataagatgattttgggatcctccatgaacagaaagtgcgtaatgactcattgtgatatcacaactgttgtcttgttacaaaaagatttacaatttatttacaactaagatattgcactatttggtaatatcttataatctgtgtgcagaagaataaaaatccttttccctaaggtagaattcttggctaaaaggaggtttatcaaacaagcattgggataaactggagattttgatatttgttgtcaatcacttatgtgggaactctccatgtcttacatttgcaaggcatttttttcttaaaatctctgagagtaaaattcactagactattataatctgtttgtccctactgaactcccattactttctctccatccactgggctgactgcctttcacatctctttcagtttttccccctctgtataagcttaacttctgttataagaaaagctacaatttattgagtacattctatatgccagactcttttgtaaagcatattattaatgcatcgattatttcatttaaaattcacaataagcctaatgaggtaggttcaatgattattaccattttgttcaatgattattatccctcagaagactgagatgcagagatattaagaaactcatcttaacattagagatgttaagaaatcaaaatattacacctgtaagtggatgtatcactatacagacctaggcagtctggtctcaatttcacctctcagtgtttgcctcaagtcaaatgtgcagatttattttttatgaattaatttcccccttcttatttaattccttaatataagcctgtctgtaaggctttcaaagtttcccatgttccgggaactttaaatacattacttcatttagatattattatcattatcccattctacagataccaaaattgaggcactaagagattacgttacttagccaatgagatctcacagaaaattctggaaccaagatttaaatctagttctttttgtcattatgctacattgtactcttctgtgtcagattttgttttccttatgcttttttttttttttaatggctgaacaatacattccacagtttatttttttcttcaacttttaagttccggggtacatgtgcaggatgtgcaggtttgttacatagataaacatgtgccatggtgctttgctgcacagatcaacccactacctaggtagtaagcccagtatccattagctattcttcctgatgctctccctcccgccacctttccccaggacagacaccagtgtgtgttgtttccccgaccaaccccacgtgtccatgtgttctcattgttcaactcccacttatgaatgaaaacatgtggtgtttggttttatgttcctgcattagtttgctgaggataatgccttccagctctatccatgtccctgtaaaggacatgatctcatttcttttcatggctgcatagtattccatggtatatatgtaccacattttctttatccagtctaccattgatgagtatttgggttgattccatgtctttgctattgtgaatagtgctgcaatgaacataagttttccctgttcttataaataaattttctatgccaaagtatagaagagccttattttttaaaaaatcaggttggtgactagttcatttgttagagccaaatttttagctgccaaagagaccaaaatcttacttccgagcctgtgtatgccagttggcaatgctggttccactgccacaaaatgtaactctgttcccagacagccacttggaaaatgcatgctgctaatcatgaagcagagaattacgtacctttaaaggttgatggaagtttatcatgcctcagatctaatataatcatttcatatataagaaaagcacagagagattaagtggcacacctaagatgacacagtaaattcatagcaagcttgggacagtcattgagattttctgacactaaatctgaggtcttcatcccatacaacaaaagcagtctctgcagccattttgtcattgtgtcttaaaaaaatgtattcatacattcaacaaatactgagtggttacctgtgccagacaatgttctagatgctggagatagagtagtaaacaaaaaagaaagattcctgcacccctggagctttacatcctggcattgtaatggcagaatggaacaaactgttatggaaataaggatgatccaaagcgataatgtctcataggcagaagagcttattagtagagttacagttttgtgcatatactcaaaagcctactagttacattgaaaggattattggtatcaataaataggaatggtgtgggttatgtggtaccaatggagagatgataagatagggtctctctgctctcaaggagcttaaggatgaagtatgtcatgtagattaaaggaaatgttttactttccaattaaaatttttaaagaaaattttgtcacattaaaaattatcttttaccttaacagataaaaatcattgtgtgcacctactaatccaagtcaattataactacaaggaagtaaataatctgaaatccaaaaattccacctaaattttctgagattaatccatttgaagtctttgaaaaggttctatacctgattttatatgaccatgtccagtgtcagagaaataactacaataaagtattaaatttgcctctaagtcaacatatatcttcttcttgccaataattattgtaataaagtggcaaaattgagctcctggtcacaaggtgtggtgacatgtgctattagtctgaatagaaacagccaccctaaagctattcaataatggaaaacagaaagctgtgcaatttaaagtgctctactaagcctgttccttaattacaatattttgcaatgtcaacgcacaccattatctgaaataatcagagtttttttttaaaaaaaaacataatatcattctgttttgagctagtcgcaaagtactctttgttgtcttccatgatgttaaatgcttgagtctgactcgcccactgctaagagtgttgagtaggtatagctgatattctgtccccattgtaggccagcactaagacatctttactaatgtccagcaatagaaagacatctaaacccaagatatagtttaatgttacaaattcataaccactcatctttgctcataagcttgtctatgggctgaattgctggacatatatcttctaatatacatatacccactcttcagtagtgtacttttgtctttaatgaattccttattcactactttggaagggcaattatacacaactttacattcagaaaatatactaaatggtaactgtgggagaaaagtctatgagcttagcaatcgtagttgaacaacgttgtatatctgtacgcactactattctttacagtgccttagacggcccagtgaggaaaaggtgttccaggtagcagagtgagctaatccacacgaaagtgtgatatgaactgtagagtgcccaaataatgcagtttattgtaacttattttcattagttcccacatggttcacaatgggcacagatctgtagaagtaaattgtgcacatacttcccactgccaatgtcatcacaataaaatgtctgctaaaatagagggcagtaattctgttgatataataattagctaagacagtccattcccgaagcaaaaacagtgaacagaaatgctgggagcctctttttatttcctttgcttccatcatggattgaaagtttgtagggccatctctggaaaatgccgtgagagagttacattttcttccatacttttctgtgtcccttttctgcacctctcttttccattttgatgttttctttttcagatattattattcaaatttcccttcattaaaattataattctccacaagaagtggtccagcccaagaagtctccttgtccctgtagatctaagatgctcctccctcactgagagacatccaggggcttggccagtgaaaattcactcagctcactcatgtagtactagcacgggtgagtggaaactctggcagcaccagatgaatccagcagaccaaaatagcaatggaaagcactgaaaactaaactgccattggaaccatggtccatagaagtaggccagaacctgcacgctaaacataacagtgtgagtcctcactaaaatcaaagatttaaacaagacccagagtccctaatttaacggataaaaggcccaagataccattaaaaaaagaaaaatcacctgtcatacaaaaatcaaggaaacaacaacttgaatgagaaaggacaatcaactgacaccaatattgagatgaaccagatggttaaattatctgatgggtttaaaacagctatcataagactgtttaaacgatcagacactgccggggctgggtgtggtggctcacgcctgtaatcccagcactttgggaggcgaagatgggtgatcacctgaggtcaggagtttgagaccagcctggccaacatggtgaaaccccgtccctactaaaaatacaaaaattagctggctgtggtcatgggcgcctgtaatcccagctacttgggaggctgaggcaggagaattgcttgaacctgggaggcgaaggttgcagtgagccaagatcgcaccactgctccccagcctgggcagcagagaaagactctgtctcaaaaaaacaaaacaaaacaaaacaaagcaacaacaacaacaaccaaaaaacaaatgcaagtgctcttggaacaaatgaaaaaatagagaatttcagcaaagaaacagaaattataaaaaaggaccaaatggaaagtctagaactaaaaaatagaaaaacataattatttttaaaaaaagaaccttggtagatggactcaaaagcagagtgaagataacagaacacagaatcgatgaacctaaggatagatgaattgaattcacacaatctcatcaacagagggaaaatacaatattaacaaaatgaacagagtcttcaggggcctttaggaagattacaaaaatccaaattcatatccttaaaaagaatggagagagggtggggctgaaagaatattcaaggaaataatgattgaacacttcccaaatttggtgaaatacacatattcacagagtcaagaaaactccaaacaagataaaccccaaaaagtgtagactaattaaaattaaactgaaaagaaaggcagagaaaatattttgaaaggagtcagagaaaaataatgcctgtctctagggaggcagcaatttgaataacagcagattttgcatatgaaaccatgaaggccagaagaaagtggcaaaacggttttcaagtgataaaacaaaaatgttgtcaacagcaaattctacattcagcaaaactgtcttcaggaaagaagagaaaataaaggcattcttatgtaaaggaaaattagaaaagtctgtcactacccaacctaactttaaaacttggctaaaggaagttcttcaaacagaaagaaaataataaaagaatctagaagcaaaagaaaaacaggaacaagtaaaagagcagaaatatgggtatattgtgagtttcataaaatatatttgatgactgaaaaaaatattaaaatgcaatctgatacttaagacaatcatatctaaaagtggggaaggtaaagacacctgaatggaagtggggctcccacactttacttaaaaaggtaaaatgctggtaccagtagactgtgaaaagtcacatatgtatattgaaatatccagagcaaccactacaaaaaccatacaaggagatccactcaaaaccattatagagaaaatatttgcaaacatatgtctggtaagggactaatatccaaaatacagagagaacatcaagctaggtacagtgactcatgcttgtaatcttaacactttgggaggctaaggtgagaggatggcttgaggacagaagttcaagaccagccctgaacaatgtagtgagaccctgtctatataaaaaatcaaaaaaattagccaggcatggtggcatgtgcctgcagtactagccactcaggagcctgaggtagaaagatcacttgagttcaggaatttgaggttgcagtgagctatgatcatgccactgcacttcagtctgggtaacagagtgagatcctgtatctaaaacaaacaaataaacaataaccacaaaatccaattaaataatgaacaaaggacttgaatagacactactccaaagaatatatacaaatgaccaatagcacatgaaaagatgctcaatatcactaaacactagggaaatgaaaatcaaaaccacaatgagttactacttcatacccattaggttggctgttataaaatatatatatataagattatgagtgttgacaaggatgtgaagaaattggaacctttgtgcattgctggtgggaatgtaaaatagtgcagctgctatggaggctgaggcaggagaattgcttgaacatgggagacgaaggtcgttcctcaacaaattaaacagaattatcacatgatctggcaattcctcttctgggtatatacccaagaatcgaaagcataggcttaaacagatatttgtatactactgttcacagcagcattaattcaccgtagccaaaaggtagaaacaccatccacgtgttcatgaacagataaatgaatgaacaatgtggtatattcgtatgaagaaatattatccagccttatgaaattctgacacatgctgcaacattgatgaactaagtgaaataaaccaaacacacaaaaagataaatattgtatgtttccatttacacaaggttcctaaaataggcaaattcagagagacaaaaagtagaatagtcattagcatgggcttggagaaggaggaaatgttcttgcttgttggatacagagtttcagtttggaatgatgaaaaatatctgaagatagataatgtttgcataataatgtgaatgtacttcataccagtgaattgtacacttaatgatggttaaaatgataaaccttacattatgtatattttaccataataaatagacactacaaattaatcaagacagactccaaaaaatgttcaaataacaggaaagcaagtaaagagaaagagaaaaaagaaccagaggaaataaacaaaacaagtaattaaatggccaacttatatgccgacatttcaataattatcttaaatataaattatctaaatacaccaattaaaagataattattgatagagtaaataaaaacatggccctactatatgctgtttggaggagatttatttcaaattcaatagaaaaaatatatcatgcaaacactaattaaaaaataggtgtggctatgttaatgtcagataaagtagacatcagaacaagagaaattactagagaaagagagggacatatcacaatataggattagctagaaagatataacccctgaatcttaaatatgtatgtaccaaatgaaacttgaaagaaatttcacctaagagggtacatgccactatcctatatgtgaagcagaaactgataaaactgcaaggtgaagtagctctataatcatagttggggacttcaacaaccttctcttagaaaccagtaaaactgctagccaggatattagcaagtatatagaagagctgaacaacacagtgaaataacagattctaactgacatatgcagaactatatccaacaatagcagagtacataagtgatttcagcgatgttgctggatacaagaccaatagacaaagatcaatcatatttctacatactaacagtgaacatgtggaaacaaattgaaagcacagtataatttcaaatgctgcaaagaaaatgaagtacctaggtacacaaaaatatatgtacagaatctgtatgttgaacattataaaattctgatgaagaaataaaagaagattgaaataaatggaaagacatattgcattcatggattggaagactcaacatactaaagatatcacttctacccaaactgatctataggcttaatgcaattcctatcaaaatcttgtcaaggtcctatgtagacatggagaagcttttaaaaaaatgtatatggaaataaacaggcgctggaatagctaaaataatcttgacaatgaagtatagaaatggagaactcaatctacttatattcaggcttgataagtagctgtagtaatcaagacagtacggtattggtggagaaacagacattcaattctatgaaacagaacaggaaacccagaaataggtcctcaaaaatatgttcaactggtttttgacaatggcacaaaagcaattcaatggaacaagggaatttttcagcaaatattgctgaagcaattaaccatctataagcaaaaaagatgaacctcaaactaaacatcatgcctcatacaaaatttaactcacaattacattctaagtacattaaaaatgttgtacagtcaccaccactatctatattcacagctttttcaccttcccaaactaaaactttatacccattaaaccataactccacattccccccttctccctagtccttggtaaccactattctacttttcgtttctattaatttgtctactctagggacctcataaaagtggaaacacaatatttgtcctcctctgactagtttatttcactcagaacaatgtcttcaaggttcatccatatttaaacatgtatcagaatttcattccttttaagtaaatgattaatttatttattttaaagatgggggtcttactatgttggccaggctgaactcgaacctctgggctccagtgatcctaccacctcagccttccaagtagctggaactactggtgtacaccactatgtctggctctcatttcttttaaaggcaggataatattcctttgtatggatatattttgtttatccattcatcctcttatagacacatgggttgtttccaccttttggctattgtgaattaatattgctatgagcattagtatacaaatatctctttgagtctctgcttttagttcttttgagtatgtttctagagtgcaattgctggatcatgcagtaattctatgtgtaattttttttgaggaaaaaccatattgttttccaatgaggctacactatttaaattaccacttgcaatgcacaagactttgaattttccaaatccttgttagtatttgttatattctgttttatatgtataaactaatgggtgtgaagtggtatctcactataccacttatggccaaactaatggatgtgaagtggtacctcactgtaattttcttaatgtatatttccctaatgaggataataatttttgaaaaagttaagtgtgaaaagaacacaacttgtactaccctttatgatcagaaaagtaaattattttgaatcttatgtaataaatgtccatgtattagttatactattcaagggagataacctaacaaaatacatatggcaaattaaaagtatctgttggttaagttgctatcattaacacatactttttgttagaaatctgcttaaaaacatcccagctccctcaatgctccgatctcaaccatcataggaaagtttcatgtttcccagtagaatcaactagagctcagcttgctgaagtcccaggagtattttcatttcaaagtgttattagtcaaaataaatacatctttaacgttctacttgtataaattatgccacacgtgcatgggcagagcaccgagtctagttccaatctgtgtttctcttcttcatagttgtgccattgtaaagtagtgacttaaccctttataagactcagttgtctcaggtaaagaaagcatgagcttaggaatcagagcctgagtcaaatccttgctccatcattcatagctaaacttccagagtctcagggcccttattgtaaaatgtgaaaataatccactcactctacattacactcagctctgtcagaattaaatgaggcaatgcagtgagggatgggcggggacagactgttagggactatttaagagacacatgatgatggaaggttgtttccacgatgatggaaggttgtttccaccttccatcatcaagtgatgatggtttagaggaagccagtagcagagcagataggtaggaagagtaagattctaaatatgttttcaatgccaagtcaacaggatttgcttttttattgaacgttgggcatgaaagaggagtagaggaagaattcaagatttttagctttagaatgggattaatggagttccatttactttgatgaagactgaggttgaaaactttccagtggtaggtaagctcaagtgttaggtcggacatgttaagttttaaaatgtctattagacatcctaataaggatgataagtagggaggcctgatttatattatggaaaaatccctgaagacaggtgagaatggggagtgaggtcaggtgaaagccactgatataatttaagcaagaatacagtagggcctgaaaaaaataagagatttaacggagtttagcagaaactgaggataaactggatatgagatataagagatagggaagactcatgaatgaccccaggacatctgacttgggacactacataagagttaccacggtgtgggagaagcagcaaatctgagtggggaaaaaggagtgaagctatctattaatagcttaatctaatctaatctaatctttatataataataaccttacttatttaaataagaataaaattacttattgtcttccacaacaaaggataattccagttatttttcataactgaaaaagagtattagtgttcatttagattttacctttatttgtttgtttgcttttgatgggggttatatacaactgggagaggaggaccagcttgagaaccacatatgcatgtgtctgttcttgcacctcagtgaactctgttttttaacatatcagaattttaaggcttaaatttgcatgagtatatgcgctcatatatgtgtgtaaatatcataaataggatattattcatatttttaaatcctccagtaatcattttctatatagaatgaaaaaacttttaaccaacaatacaacgtctgcatttatttgtccatatatatcactagtctgaaaagtacgatataaataatttcttaaaatcaatgttaaatggtggtttctgcaagccaaatgcataaggcctctttaattgttaaagatagaaagtattttgccaggcgcggtggctcacacctgtaatcccagcactttgggaggccacggcaggcagatcacgaggtcaggagattgagaccatcttgactaacatggtgaaaccccgtctctactaaaaatacaaaaaattagcccatctctactaaaaatacaaaaaatcagccaggcgaggtggcaggcgcctgtagtcccagctactcgggaggctgaggcaggagaatggcgtgaactcggaaggcgaagcttgcagtgagccgagatcgcaccactgcactccagcctggaagacagagcgagactccatctcaaaaaaaaaaaaagaaaaaaaagaaagtatctttaggaggcgaattattgagatgaaaagcccactcagcagttgagaatacatgatttcaggaaatgattcaaagttattttctaaaataaattttattatagaaatgtcaaattcactcataaacctagctttcagtgttctctaatatcgaagagcacaaatgtcatagaaaaaataattacaaaatatggttattatgtacttctaagtagtaaaatcttgattccccagtattaagccaacttacatccttttcacaagttcacttctgagtgtatattggaaaaaaattacaaactgcgtcttgtcctgtttaaatagactagtgactaagcaaccagggcacagagcctcctggatcttttttttccaaagatttttccttctagcacttgagataaagaagatcagatggaagacaatcattatgataatgagttttttccttccttttcaaagagtttcagatttgggttttgtaattctctgaaatactcaataacatcatcatatttcagaggcaaagacagctgattagaaagttgatccaatggtagagaacctttgcctcagatacatatgtcttaatgttcctgtaaaagtacagcagaaaactgcatttttggagaatgaaccataaatagaagttattgtgttaattttgacagctgtcactgaagttgacaggatgtggccacctccaatttgaaataatttttctgttcaagataactacataaatgccaatgttcgtcccttttaatttctctgagtctcatgacttaagagtcacatgtcttgtacacaggcaactttctaaatatatcaccatttagtcttgcatgcgcgtgaatacatgcatgattcctatacataccacttgaattctgagtaagttttctcttctaaggagagaaatggtgggattcctttatatctaattccagttatttcaaagctgatcaacattattgagcctacccatcaaattaaaataaaatagaatgattcaacatagaaaaatgtcaactggtgaacataagggtgctgaaataaccaatcacagtttggcaaacacccaagccatcccccatagcaacagagctgatggcatagcaaccgcagctgcttcaacccagaaaaattagaagaaatattcttgggaaaaaagcataatccatgttaaagtcagacatgacattttttctgcaacaaaagaaactgtaagcatgaatgtattaaacgatacaattccttagcagctgtaaatgctctagtgcaggctgaaagccactttgattacaatactcaaggccaagtgctttgaagctaaaacttcctaggttgttctcatccaaactgttacgtttcttgcaatgttagagaacaatcttttcttcaaccatttattttgctatgatagaaggttttccacaattttttaaaaggatcatttgagagaaagatttactggttagaaatccacataatcagtacttgagaaatattaaaatctaaaaggaaatatattgattaaagtggtgatgatgtcatcctgagggatccaggaagcatgaggatgaaacattagctgaagaaccaagagcctaataatatttggatgtaccctcatagtagtttgacctgcagggaattcaaggttttctgcagagccccaatctcaggctttagctagatatatagactttctttactattccatgctggtttctctagaagcccatacaattacaatcagtcaaggtagacttctgaacttgttgctgaaggctgaaaggtggggtcaaattctttatgatcggtagagacgatgtaaccatacaatgcctctctcctcagggatattagacatttgctttattaagtgtagaaagtgggatgatgttcaactgatttcagacattggttattttaatcaactcatttctcatggtttctatttgaaaattaaaaaaaaaatcctaggctctacttattaaaattcaaggttttggacttcacatgggaagcatgacactgcagcctagcccagtcgtagactgcaaagtctcagtaaaaaggaggaagagaaatgcacatatgaatccagccagactctgagccagggaaaccttccgtgatttggtgaaaaataagacagtgaagtaaacagacctgatggaagctcaatatatgtaatggctgctgagagcttgtcccctgacaaaggggcaatttcaaatatatggtccttttcctcctttgacccattattgcacccggttggatccactcatggtttctacctggctctcgggacatctccagttcctttatcctcagaggaatgacctgtatcactatttacataagttccaccttctgcacccctacctggcctccctttccctcacctcccacgctaaaaattaaacatcagtgattctccttgacctaggattcactcaacctccaccctctttctccagttttctggaatgctaattggacattttattcagtgcttcagggcattagtcctaggtgcctgggaatattccccaaacacagcactcccaattacctgaattctaaccacaccgaatcccaacccagaggcccaagaaggagcttcccatctgtggtagaattccagtccttaagtcaggggataacacctgccctgagctgcctgtggacatactgattaacttcattgtttttattttattttattttttattattattttttcgagacggagtcttgctctgtcacccaggctggaatgcagtggcacgatctcggctcactgcaacctccgccccccgggttcaagcaattctcctgcctcagtctcccaagtagctgggattacaggcgcccaccaccacgcccggctaatttttgtatttttagtagagttggggtttcaccatcttggtcaggctgatcttgaactcctgatctcatgatccaccctcctcggcctcccaaagtgctgggattacaggcatgagccaccgcacccaaccttattttactttattttattttactttaagttctgggatacaagtgcagaacatgctggtttgttacataggtatacacgtgccatgatggtttgctgcatctattgacctgtcatctaagtttcctcacctgccaccccccaactggccctggtgtgtgtgttgttgccctccctgtgtccatgtgttctcattgttcaactctcacttatgagtaagaacatgcagtgtttggttttctgttttgtgttggtttgctgaggatgatggcttccagcttcatccatgtccctgtgaaggacatgatctcatttttttatggctctgtagttttccacagtgtatatgtaccaccttttctttatccagtctatcacaatggttgaactaatttactttctcaccaacagtgtaaaagcattcctattcctccacagcctcaccagcatctattatttcttgactttttaatagctgccattctgactggtgtgagatggtatctcattgaggttttgatttgcatttctctaatgaccagtgatgatgagctttttttcatacatttcttgcacacaatgtcttcttttgagaagtgtctgttcatatcctttgccccctttttgatggggttgttttttttcttggaaatttgtttagattccctgtaaattctggatattcgacctttgtcagatgggtagattgcaaaaattttctcccattctgtaggttgtctgttgactctgatgataatttcttttgctgtgcagaagctcttcagtttaattagatcccatttgtcaattttgacatttgttgcaattcctttcggcatttatgtcatgaaatctttgcccatgcctatgtcctgaatggtattgcctaggtttttttctagggtttttatggtttttgctattacatttaagtctttaatccatcttgagttaatttttgtataacgtgtaaggaaggggtccagtttcagttttatgcatatgacttgccagttttcccagcaccatttattgaataggagatcctttccccattgcttgtttttgtcaggtttgtcaaagaccggatgtttatagatgtgtggtgttatttctgaggcctctgttctgttccattggtctatatcttttttgatactatgcttaaaacagtaccgtgctgttttggttactgtaaccttgtagtataatttgaagtcgggtagtgtgatgcctctagctttgttctttttgcttaggattgtcttggctgtatggggtgttctttgattccatatgaaatttaaagtagttttctctaattctgcgaagaaagtcagtggtaggttgattgtaatagtatttaatctataaattactttgggcagtatggccattttcatgatattgattcttcttatccatgagaatggaatgtttttccacttgttggtgtcctctcttatttccttgagcagttgtttatagttctccttggagaggtccttcacatcccttgctagcttggtattttattctctttatagtgattcacactgattaatttcatcagtcccttcatataggtcagaagtttacccttttctcactacatgttgtaaatggacagtgactaatcatcatttccaagtgaatgacttccaaatctctgtgtctagtgttccagcccttcatttccagatatttattgtatatcctcttcactagtcatacagcacctccacacatctaaaaccaagtttatttctatttcaaaccagcagccattcgtgtggtgtatatttttaatggaccaaccattcatattatgtgagttcaaagccccagagctaactcctacttcttaagctaccctatctgctccatctaggaggagccttcttcatttccactggtcttacccttattcagatctttcttataatctcctgcaacactacagaagtctcctttcccctccttcccagctctgccctgtttgtagcctacaggttgctgatattaatactattactaatgcatagcactggtcaagctcttggtcatttatgtcaacttggtgaagtctagaaactacttttcctggaaccctctgcttctctattgttctgagataagttggccaagacaggactttgtgtgagaattggaagaaggaatggagcggatgccattgttcatggaagtttatcatggtaaatgatggtgataaaagatgcagaggtgcccgtcaggatccagcttgttcttgctctcatgcactgtgtgcccagcatattttcctacctgttggccccaacatcagccccaggctcacagctggatcttggatgcagaccctcagagacaggtgctgccccaggtcagcagcttcaccaggattggcagttccatccatctttctgaacttgtcactgaaggcatagaggtgggtcgagctcctctttaacagacacatgccagtggcagattgtgcgaggctccctgggttccttgcaggctacaccctaatgtggtctagctagtgactgtttgattcttcagtatatgccccttgcaaatcttccctttctcactttgtcccacaattgtgcagagtggatggaattctcatattaaatacttgatttacgcaatacttagagtggctgttttcatgattaaaacttgactaatacatatgccttgactttctttgaacacacacacacacacacacacacacacacacacacacacacacacttccttggcttgctgctgcttccaagtttggtttcaactctttagttagagactctggttctttttttgttttaacttttattttaggttcagggatgcatttgcaggtttgttatataggtaagttgcatgtcataagtgtttggtgtacagataatttcatcacctaggtaataagcatagcaccaatagatagtttttccatccttaccttcctccctccatccaccctcatgtaggccctggtgtctgctgctcccttctttgtgtctatgtatactccatgtgttgctcccacttataagtgagaacatgcagtatttgtttttttgttactgtgttagtttgtttaggataagggcctctagcttcatccactttgctgcaaaggacattatcttgttcttttctatggctgtgtagcattccgtcatgaatatgtaccacattttcttcatccagtcctaccattgatgagcatttaggttgattccatgtctttgctattgtgaatagtgctgcaataaacatacaggtgcatgtgtctttatggagactaattattttacctttaactttccagacatacatccctaccacttccattcaaaccctcatccaatcctattccattcaaatcctattctttctattcaaatccacaccatccacgtgacttccactcaaatctttattgaattccattcaagtattatctacttctgagattcagactatcccactatagggtcttactctctcttccttatctctacctgtagaaatcctacgggtcctggaataaacacacacacacacacacacacacacacacacacacacacacacacacacacattagagataggggtctccatatgttgcccaagctgaactcaaacttctcagcctaagggatcctcctgcctcggcctccctagatggaactataagcacacaccactatatatttttttttatctctgcttacttgattctaaaacatgttttagaacacatcatagtttgttttataattttttgcatacttttcttagtttccagtatgaataatcttaaggtcagacactaaaccttatttatctttgtgtatctcatagtgactagtatggtgcttcagaaatagaataaggtgctctttaaatgtctgtttagtatatggttcagtaaatattttttcatacccatttctttgcatattaaccaatgacactcactagagtttagaatgatattattttatactgactgtaaaggacatgctttttatagtcatattttatattatgaaaacattccaagagctttttccaagaatcttaaaatatacagagcttgataaatctcatgtaacttaaataataaatagtaagtatatattaaggtcaatgtactttcatattacattttagagtatgaacatattgttataaagagtatgcaatatagaaatgtctaaactaatatctactgaaaatgattacatatatgatgctagattatcttgaaatagaacattattcataacatttttatttataataaacccacccattgcaaggaaaattatgtgtttagtgtaaaaatcacagtatgctaggaacatgattcctatcctaaaacaataaaacatttacatgttgagagcaatttgtgtaaaggtagctccttcgcaggacaacaaagcagagattaaaatgcaactctgccctttaagcttaagacaaagaaatacggtttttatttattggataagtctgtacctcttttttttgtaaccttcaaactgatgaggattatgaaacatcaaaatgtcaccacgtgataagtgaaagtcaccattgttcataggaatcatctgagggtgccctgcattctgctaaatgacaccggcaactgtaacagctgtcaaaagtaaaggccctaatgatgctcataggcagaaatgctccctattcaataaaatagagctagtttctgcttacatttaagttcctaacttaagaccatttcctttcaacattaaaatagtcatgatgccttttgttattattgttcttattgattcagtgcctattgagtaccacgcactgtgataagtgtcttacattaattataagacatactatcatcattctatgagatgaggaaactgagacacagagtaacttattcaaggtcacacagctggttatgagaagtatgttatcctagactctcacatttaggcccaaattgtagcctcttaaagcctcacacatatcctatgtgctttagtgtctcaataagtttatttgtaataaaatgaaaagaaagctctttcttctattttaagtacatgaatcctagaatcaaaacttctggcaacttgaaatcttctcccagtaacctcactcaacacttatcgagccattaaatctcggctgcgtcccttggggaaggcactttacctctctgatcttcagtgtctgtatttttcaaattgggcataatggcatgaactttatcagttgttttggggtgagtgaaagtcatttatattgccctggatacatggtagtccttataaataagtcttctattctgagctaaggaatttggactttactgacaggcaatggaaatcctcaaataacacagcaacatggatctccctcgtgatctccctctcttcacaatcatgcgtgcatcaaagatgaattttctttgaacacaacttacacttttcataatacgactctctccctttgtagttgaaagggcttatcaggtttcctacttcacacagaatgaaacagaggtgttcttgtttggattgttccccagcactcctgacactagtgtttggcttcagttacactcatccagcagagtcccacaaaggagggtgactaactcatctgggtttgtctgggactttactacttttactcagtcccaaacaaaatgggagaggtggccagtcaccccaaagacattacactttcccaaaattccacacatttgacattgccctttgtgttgctctatcaggaactgcacatcttgcaaggcttaatttagagccaataccatcatcacctggggtaactggagcaggtggcaccgatgggagaattattattgagtttaataaactgggatctgatgttgaaggtttttaaaaagtagtttgaaataaatattaaatacaaaaagtttcaatactagtacaaagaatatgcatacaactttcacccaggctcacctagtattaacatttcaccactttgctctatcatttgtgttccgtttctcacacacatataatattctttagatggggaaggtttacaaaattttatcatatgctcagaggtagggaaaatcacttctaaccaggaggaagtaatggagaaactggctttcagtaaagatttgctgggaagtcaaatgttcagagctctgcttgtggaagatgacaactacaagggtgtccagtgaagtctagaaagaaggccaggctggagacagagggatcagtcaggaagctgctcagaggtccaggcaccaaggacttctactaatggacagagatactgatgggtttgagcaaaaataaaataatattcttttagtgcccaagttagataagagtgtctcacattttcttgactatttgacctaacttagtaaggtgatttacgtctaggatttttcacatctcttttataaaatagagtcctttgatcacatccatcttctcatcttggttgtttataaatgaaatgttaaaatgaaagattatgggaagaattagactcctgttatttcatgtgatgaactcatttcttggcagagttacactggatgagttaagatgtaactgaaaatatgcttccctcctgaaacttggaatcttgcttttaattatcattgaaatgtcaccagagatacatttaaacagtttttgataagacatggactaacaaaccgaatccaactgctacagggacattttttaatttcacaggtggttgaaatatatactgcggcagtataaaggagaaaatgcagcaggagctacccgtgataggagtcaatacctctgtgaacaaggagaagcactactatcttggttgaaaacactcttattcgtaacaaaaccgaaagctcctgtgtctgatcttttaatagactttcaaggacacattttcaagtaagtaccactatatctggacgacaatcaacctttaatttctttcctttattgttcctttaagtgtctttggatttcttcttttttttttaaagtgtctggtattttgacattctcacttctcacatgggctgtatttatgtatggtactcatcaacaaacacatctacagctttcggtagataatgttttgtttgctccaaaaaaagaaattaggggagcccttactgagaaagtaatagcagtactactaataaatatgggagctgttttcttccattagaagaaacaccagtagcaacatatgtattccaatctgtagcactaagtgcactcaattaaagagaagatgatagcgatttgcagatccccctgctccagcctatttttcagttggcatggtggggactggctagggagaccatacccatctttccaaagcaggagtcgggaaagacttgctggtagcttgaagctagccgtggaaaaagtgcatgcactgcagaaactggcaaatattaccaaccttttttctgacagcaggtatgggaaaccagaatacgctacacccaaatgtgcctctttggcagaagtctgattgggctgaaggaattaagaacaagcagaagcaggaaggctctttgccctctctctatttgcctaaaattgggatgtaaatttacaaagacaaaagctatttcacctcccctctctgaaagaacaaaggttaaccactgaagagagtttttcacccttacgggccggaagatggcaccagaggaaactacgttagcaagctttgcaaaccagcctttctctgccagttattttccttcccccaccttgtggcccctagagatacaaagtctttttattttttattttttttgtcttgtcacttctctaagcattgactgttctttgtagaagatcccacataagttggaattcaagccacctctttgaaaattactcattccctaggtatcttccatgcgtgtattaaataaacatattaataaacttctgtttgtttttctctttttaaagtgtcttttgctatggggtccattccaacttaaaacttatcagggttgagataataattattcttcttcccctacactggttattaaatgttgccaccacactagcacctacaaaggatagttgggttttagaaatgctggaccatggacaggtagaatcaagtgaaataataatgtgctgcccttaatgaagctgttgtctgtcaatagttgataacaccgaattcacttcataagggtagagaggaagaaaacaatgtttgcaggagattgtgaacaaggaaggaacacatttcagataagggtaatcatagctgggctccttaaaatggcaattataaacatgtccctattatttcaaaggtaggccaatgactgatggttacagaaacatgagctaccaaaacagaccatcagaaaccaaaagaaaaaatatgtgaacaaaacagctttttaggaagaaaatacattaaatcaaattcttggcattttgaatatgcaagaaaattaaatatacaagtcatactgaaaactgtcagtcctttttgtgcatagcttgatgactaccaggcaaaccattttccctaattgagatttaagaaaaatagacgagtttaactctagtgcaaaataaaatgacttaactgacaatgtgagaggctaactgaagaaataagaaatatttagaaagaagagagatataccaggatttcatagattacatgagaagaagcagactaaagggaacatttcattgtatattatttctctctatatatgtctatcaaaagtaggcatttcaaaaaatcaaaaaattatttgaaggtacaagccactttattgacaaaattaccttttgcactataatttaactttcttaaacttttgaccttgtttcttgacctttgtacattttccttttcttttttaaattatgtggctcctttgagtcatccatttcctctttcctctggaaagggaagagtcatggattccaacctttctgctagaagctacgaagaattaattgccatgtaggtttccttggaagacgtcagataatctttacctgggtttcatgcacaatcatttctttaacaagactgagcattagtcatacctataaattaattctccctcttggtctaaaactaacatctgaaaatactgtacttttccttcacatcaaatatggcctaagtagccttttcattttatttttccagaaagctttcccagtaaaaagacagacccgagggtattttctcatcttgttgcagagagtgatggtacagaatgtgcataatgcccacgcaggaaagttaataatattctacaagcagtctatttttagattaatagagccagtttacgcaaagcaaatctgtactgcagaaagaagagcgttaaatatttgaaaaaattctggataaactttaagaaaaaaggaaacattttcttttcctacattgggtctaacataattaaatgaattcaaaggcttagccacttttgcaaaggcttaattgcttgtattgatcgtgacctaaatttgcttctgcacagtttatagagctacatttggcactggaaccaaaaccccttgggacgaaaagccatagccatcctgacattaccaaatggtagaataattatttacatttattaacatggagataaagatcattttgttggttgaccagataactaggtctttcctggctaatgctgcattaaaatacatagtctcaacagtcaagaattctcctagtgggctttggtagaccataattttagttaactcagagaagaaaaatccctcagtgtaaacactgggtcattattttaaatctattcaataaatcggtatcgtacataaccctcacagacatgccgatttcgttcaatggtatttctaatcaccgataagcctatatagagagtaaacacactacccaggatcctactacttggataaaaagccaacatcaccctgcctttccttcttttaagataaaagggaaatcaatgagtttttatttttattttttaggagtgcaatctacttattttgccatactaaactaaagttctgggatcccctgatacttgtgcaagttaccgcatacacatctctgatggatgaaggaatgtttcttccattctaagcaccctgcaaaagccatttatattctgaggcctgaactatatgcacctagtgtcctgcactgtcactcagagattctttctcttcttccaactactccctgactcctttgatgttctatgaacactttaatacgttagagatcacttaatgcagttgattttaatgatctgcacacatccctgtcttcccactagactggatactttcctagttatcttttcctcattcatctttttattcccagggccctcgacagtgtctgttaaatactatttaccttaatatttagtaaatttgcaaaaggtgtgagtgaatgctccttttttctaatattttatttttaaaattagctttaatattaaatacaataagacaagaataaaatttggtttctattttaaacaagattttcatgaagtatttgaggttttttttttttaacttttatttcaggttcaggggtccacgtgcaggtttcttacgtaggtaaacttgcgtcatgggggtttgttgtacagattatttcaccacccaggtacccaatagttattgtttctgatcctctctctcctccaaccctcgactcccaagtaggccccagtgtctttcattcgcctctgtatttatccatgtgttttcatcgtttagctcccacttataagtgagaacatgaggtatttcattttctgatcctgtgttagtttgctaatggcctttggctccatccatgttcctgtaaaggacttgatttctttcttttttatagctgcatagtattccatggtgtacatgtaccacattttggacatttgatggacatttaggttgatttcatttaggttgaatgccattgagggacatttaggttgatttcatgtctttgcaattgtgaatagtgctgcaatgaacgtttgcatgcgtgggtctttatggtagaacgatttgtattccattgggtatacactagcaatgggattgctggaacaaatggtagttctgtttttagctctttaaggaatcatcacactgcttttcacaatgattgaactagtttacactcccagcaacagtgtattagcattcccttttctctgcaacctcgccagcatttgttttttgactttttaataatagccattctgaccagtgtgagatagtatctctttatggttttgatttgcatttctttaatgatcagtgatattgagtttttttcatctgcttattggcctcatgtatgtcctcttttgaaaagtgtctgttcctgtcacttgcccactttttaatggtggtgttttttcttgtaaatttgtttaagttccgtatagatgctggattttagacctttttcggatgcatagtttccaaatattttctcccattctgtaggttgtctgtttactcttttgacagtttcttttgcagtgcagaagctgttaagtttaattagatctcatttgtcaacttctgcttttgttgagattgcttttagcatctttgtcatcaatctctgctagttcctatatccagaatggtattgctaggttgtcttccatggtttttatagttttggcttttacatttaagtctttaacctgtctttcattgatttttgtacatggtgtgaggaaggggtcaatattcaatcttctgcatatggctaaccagttatcccaacgccatttgttaaataagtaatcttttccccattgtttgtttttatcatctttgtcaaagatcagatggttatagatgtgtggtcttatttctgggctgtctattctattccattggtctatgtgtctttttttgtaccagtaccatactgttttggttactgtagccctgtgtaccatttgaagtcaggtaatgtgatgcgtccagctttgttctttttgcttaggattgccttggctactcagggtcttttttggtcaacatggattttaaaatagtttctgtgaagaatgtcattggtagtttaataggaatagtattgaatctgtaaattgctttggtcagtatggccattttaatgatattgattcttcctatccacaagcatgggatgtttttccatttgtttgtgtcttctgatttctttcaccagtgtcttgtatttctcattgtatcactcacacctcgctgattagctaggtattgtctttctttggtggcaattgtaaatgagattgtgttcctgatttggctcttggcttgactgttgttggtatataaaatgttagtgatttttgtacgttgattttgcatcctgaaattttgctgaaattgtttatcagcttaaagagcttttgggtcaaaagtatgaagttttctacatatagaaccatttcatcggcaaacagagatagtttggcttcttctcttcctatctggatgccctttatttctcttgtctgattgttctggccaggacttccaatactatgttgaataggagtggtgagacagagcatccttgtcttgtgccagttttcaagaagaatgtttccagcttttgcccagtgaacgctcctttaaacgttccaagatattgatcccccaaaatttgtatttaaagtgttaattttctctttgaagtgtcttaatattttatacatagattttaagtactgaaatattaagaactaaaacattttctacagaaacttgccttttcaattcttagtacattaatattgtgtgtataaatgcaaatttataaattcagttagatgaaaagcagagtatgattagtatcatccattttctgtattgttgctgtgagatctgggctatttctatgcaaagttatcttattgaaaatttgactaaagaaagtaatgtgggttgttaaataatattttaaattaaattgtcagctgggcgtggtggctcatgcctgtaatctcagcaatttgggaggctgaggtaggtggatcgcctgaggtcaggagtttgagatcagcctggtcaaatggtgaaactctgtctctattaaaaatacaaaaattagccaggtgtggtggtgtgcacctgtaatcccagctatttggaagtctgaggcacgagaattacttgaaccctgggaggcagaggttgcaatgagcagagatcgtgccactgcactccagcctaggagacagagtgagaccctgtctcaaaacaaaaacaaaaacaaaacaaacccattaaattgtcaatttaattttattgttttaagaaaaaattctataacaaatttaaatcaaaaggacattggcatctgattatctttccctccttgtttttggtgataaaatttcaaaaatttatgttaccaatttttgtatttccgtgctctaattggtttcatcttaaaactctgtcattacttttcttttatctctatttatttgataattcagtcgttctagaatccactcatttattcaatttcaaatatttactgaaaatatgttaggcaatattattttttaaaatttattttaagttccgggatacatgtgcagaatgtgcaggtttgttatataggtatacgttgtgccatggtggcttgctgcacctatcaacccgtcatcttaagccttgcatgcattaggtatttgtcctaatcctctccctccccttgcccctcacaccccgacaaggcccagtgtgtgttgtttccctctctgtgtctatgtgttctcattgttcaacttccacttatgagtgagaacatgtagtgtttggttttctgttcctgtgttagcttgctgagggtgatggtttccagcttcatccatgtccccgcaaaggacacgaactcattctttcttaaggctgcatagtattccatggtgtaggtgcgccacatttcctttatccagccagtcattgacgggcatttggattggttccaagtctttgccattgtagatagtgctgcaataaacatacgtgtgcatgtgtctttatagtagaatggtttactcattcatataagctatttcatattctctttgcaacatgcaaagcgtcacataaagtcattgacagattaaattaaatcaaataaatttacccagaagaccttttactcactggatttctttactggagatatttttgaatgatgttgtcatcaatgttttattattttgtatttaatcatattcaaagttcatctgtctcactgtaaaaactcttaaaaatgataattacttttttatgttcttttctgatttgtacgataatgaatgctgtaaacatctaagaataccatcagaaataagaatttcaattttgatgaacatcatctccataaaatgaatgctttataactagggcctgcttgttaccaatgagtatgtattatacatataaagataatggaataatattttttcttggtaatttccaattgttgttgatgtgatttttatttttatttcattaggtccttcccagatgttgcaactttttattttctttctgttttgattactggagactattatataagaacagttgtagcttaaaagtataagtcttaataaaactatatcatatttgggtttagaaattttaacttgcacaaccaacaggtcatctaagaagtgagcattgaaactacaaagctctgatgagaaaaatcaaagaaggtctaaataaactgaagacatattaagagggactcaacattcttaagatgccagtttccccagctcaatcaacagattcaatgcaatcccaatcaaaatcctagaaaattactatacagatataaacaaccaattcctaagtttatatggaaagacaaaagaaccagaacggtcaacaaaatattaaagaagaaggaagtcagaggactgacactatccgactaaaaacgtactgtgaaactacaatgattaagacagtacagtattcatgaatgaatacacaatacatcaatagaacagaatagagagcccagaaacttacccacacaaatacaatcaactgatttttgacaaggaagcaaaggcaattcaatggagaaaagatagactggacctccacatggaaaaaatgaatctagacacagaccttagaagcaacaggcgctcccatacattgttgatgggaatataaaatggtacagtcactttagaagacagcctagcagttttatgcaaaccttatcaaaggcttgtgataacatacagcaatcatactcctaggtatttactcaagtgagttacaagcttatgtccacacaaaaacctgcacacgaaagctacaagcaaccaagatatcctttaatagatgaaggaataaacaaactgtgatatattcatgcaaggagatattattcagtaatgtgaaaaaaagagctatcaagctactaaaagacatggaggaagttgaaatacatattatgaagtggaagaaggaagtcttaataagctacatggtatataatttcaactatatgatgttctggaaaaggcaaaactatagatacaatgaattgatcagtggttgccaggggttcagaaggttcaggggaaaggataaatggttgaagtacaagaaaactttagagcattgaaactttgaaactattctgtatgataatacgatggtagatgcatgacattatacactcgtcaaaatccacagggtatagaacacaaagagaactctaatgtaactatgaactttagtgaatatttatgtattaatattagctcatcaattgtaacaaacgtaccttactaatgcaagatactaataatgggagaaattgtgtgcagaaaggaagggattatatgggaactttgtactttctatacaacttttctgtaaatctaaaacttctctaaaaacaaagtctatttttaaaagtatatagttttgcttgcttaacccgttatgattttccaatgagttcttgtgtctaggtttggagctatgaataaatggcagtcagttttctgtccacataagttccaaggactataatatagtttttttctctttaaaatacaagtaaagttttaaatatttttccagaaatacaactcagttactcttcaagtttgaaaagttattttcattttgaaatatttccaagtataataatcttatgtgaaatacattaaataagaaactcatggcttaaaggagtcttttcattaatcccttaatttagaaagagaaagtatctagaaagacttcacttcacataaaccctcttaccaaaagttgcaaaaatttttttcattcatggacgtatacctgaaattgatttttttcctttaaacaatcattttgctacatctagcacatcaagatatgtttgccataacgacagatgaaaatgacatttttctcttcaggtttacattgattttgtttctacacatttcacaactgcatcatgaattttttgattactctataagtataagcatatttctaaatgttcctttaacctagtaattcataccaaagacttctttatatacattttcctttacatagagcctaaatactaaatgatgaaaaccacagatatgctattaattagaagtctgccagtcctctatagtacttccataagatttaattataactcaaaaatatatctactctttccattcgcaatacattatccaagctgtgactatctctttcatgggcaactgtaattccctcctaactgttctgttttcattttttctcctttctagtccattctctccagagtggccatagtgatctcacctaagcacaatctgatccatcacatttgtgtcaaaatcctccgaaggctctaagcatacagtttactcttttctcccctcctctgtggctaattgtcccccattcttcaggattcagcttcaatgtaactccttagggaggcacattctaagcctctgtagtgtaggtcaggacacctcttgcagtctcaggatgcggtgcatcctctagagcacttgtccaactgcaatgactcagtgatttgtgtaattacacatttgctgttcatttcttctaatggaatgagagttccatgggtgcacacaatgtatatctgtcctccaaacctaccacagggcccaccacatatatgcccaataattatttcttaaataactaaactaacaccaagagaaccctgaagcaacactaggactcatagtaaagatatgacaaaggggaaggtgtattcaaatttagataatataattaacataatgaagaaatgacttcatcaatatagttggtgtggcacatcctttttctcctgatcataaaaaacgcccttatttataacatttctcaagggtaagggaggagagtcctatttctcatgatacctctccttttatcctcagaaaagcatttaaataaaaaacacaaaaccattgtctgaatttctgttctgctttaaagtgcctgatgagccagttgagtaaaagaaagtagaatggcttatgatagaacaatgatggcttgtcaatgcacacctttcaaagaaagaatgagactatcataagcatgtcatttgataacgactgcaactcatccttcctccccaagcagccagcacttagaaatagtaatacaataaatttaatttaaccctaaaagcaaagctattattggaacgtacttatcctgtaaccccaactaacttgaagttcccctctaccctgctccgaaaggtatgccgccaaacacaattttatcagcctttgtaaatgtaacctcttttgatctttcctatttctatgacagtataacaatattatgtgcccctgagagggattaacattaaagtcaagaagaagcagccaagtgaagatctagaggaagcaaattccaggcaaataaaagaataaatgttccctaaggtagggcaatggaaccaaatgaggccaatgtggatctgcagactagaggtgaggttagagctgtaaggagatgccaaatcatgagctttgtaggctcggggggaatttaggatatgttctggatacagggttgacagaagttgttcacgttggaagagaggcaaagacaggaattaccttctcattgaagaaaggtactgataatccaaattccagaaaaagacatcttaatccacttaatcttgaagggtattgcaaaactacataatatagtagattttcatacctttctttatggacattcactttaagtttctaatgtttgtcatttgcgcaggctactgcctgcattgatgagtcagccactgaatagaactagaattcagtgttatcaagtgcattggtatagtccatgagatttgttaaggactcaaatgctaggacaataagtcttctcaggagcatgctgcagagaagagactcagctggacgtgggcctggcctggatttcagtactgatacacggccagctctggctagaattcatatttgatctcattttttatatgtttaccttatatattccaaattttgcatagattattgaaactaggtcaaaagtaaaatcatcagttaataatttatgacacttctgcaatttgtcccatccaaatagaacggcctagagaaactctgtggctgtatgaaagttgagccaacatcacaactctgtgaaactgcccaaaaacaacagctttgggggaaaaaaacagtcaaatgctaggctgccaccaatttccatcctggaatctacaaaaagactcatttaacaatataaaatgaaacaattttgtagtttttggttagaaaagacttgattacagaaacaagcatatcttgtagaattttataaatggatacattttttatggtatttggagaaaaatatgacttctgttagtgttttataaatattggctaaaaatgaaataatgaacttgagaagggaaatccagagaaagctaaaagctagagttttgcatattctcttctatactggcactttgctttttctgttttgaatatattttcaatgccccagtgaacttggtaacactgccaacaataaaaaaaattgtaaaggacttagatctttaatataacgtgaaaatctggaaattaaacagaataacagagatgaagaaattaattttcagattttttaaaaagatttttgctggcccctatttttctattataatttcaaaattttttttcaaattggtggctacatgtgcaggtttgttactcatcctgtaaccccaactgttatatgtatattgcctgatgctgaggtttggggtacaattaatcctctcacccaggtactgagcatagtagccaacagttggtttttcaactttgccccattcccttccgcaccagtagaccacagggactactgtcgtcacctttatgcccatgagtacccaatgtttagcttccacttataactgaaagcacgcagtatttgggtttctgttcctgcgttaatttctttaggataatgttggcctcattttcctaagattaaagctgaaattttgaaatatctcttggtattggtgaaaaatactgagataaaaagattaagatacacatttattgtccaatcattaaatcattagctttattacagataaaatattatatcgaattggattagtaaatttaaggccaaaccaattttgaaattgttcagaacttacatcaataaaggcttcccattaacaattttatatgtataactctacatatgtgtgagagtgtacgtatttttttcaaaacatagcctagtgtttttatttaatatttcctagacttataaattattttcagctaacatctatttagccatgaaaatacaataactacatagttattttgaattataattctggcttatttaacacaattcaaagttatataccagttttgaaattttaagataccttctatcatttaatagagtctataggtgtatttcactttttaaaataaatatttttgagtaacaaatcataactgtatacatttatgggacacaaagtcacggttttgatatatgtatacaacgtggaatgattaaatcaagccatttaacacagacctcacctccctcacctatcatttgtgtgtgcgtggtgagatgtttgaaatttattcttttactttgaaatatacaatacattattgttgactatggtcaccctgatgtgaaatagatctaaaaactttttcctcctgtctacctgaaactttgtaacttacaaatatcatttgaagaaaaaaaacccaaataccaaaatatttgaaattgccatcactaatgattactgttttaaatatttggagtgtagtttagaatactacagttttatctacatgaactctagaaaattttgtctctgtgcacttgaagccatccagattaagccattcccattcaagattcatgagacacagtacaatatatgagactttgaacttttttttttaacttcgtgagcaactatgcttggataaacaagccatttgaggaaacaatacgcatctttcacaactactaagcctacgaataggcataagtggagtaagctccagctgcagtagggactttgttgtctggttctagtcagccccaattgtcttgctctaaaaatgataaaagatgcgaaatttgcatgctactcaaaaggactggttttaaaattgccattcaactatcgggtgttattgtttttcacagatgactactttttatctatttattttttttttgagatggagtttcgctcttgttgcccaggctggagtgcaatggcacgatctcagctcacagcaacctctgcctcccgggttcaagagaatctcctgcctcagcctcctgagtagctgggattacagacatgcaccaccacacctggctaattttttgtatttttagtagagacagtgtttgtccatgttggtcaggctggtctcgaaatcccaatgtcaggtgactcacccaccttggcctcccaaagtgctgggattacaggcatgagccatcgcgcccggcctgactacttttttgaggaagaccctattctgcacaacagaggacatgtttgaagagggagtttacagataaaccttaggaataagaaaaacagggcacagataatccagtctgctgtgtctttgttattgtaatcatcagttggttagctggttctcatgcctgtgggtgctaagaagggtgagatcaaagaaaatccacatgggactggtgctccttcatccagtgcttcattcaatacttatcaatcatgcaccaaacactgctgagcatcaaaagtccatctaggcactgggttgtcattgtgaaagggacaggcagggtgtctactcttacggacattacagtaaaggagacataggagagctcactaaagtataaattgctacacactgaaaacaggccatggagaaacggtaggtaagagaacataagggtggaaactgaccttgcctgagtacaggcaatgcttccatgaacactatgtttaggaaatgaaatgaaagttctctgcttccaacttcaaaaaacaaaagcaaaaatgctgattgccatgtgggtgttatttgcaaagtttcacacagtattcatgtattattcatttataaaaacactgcttactacatgagcagtgcctactcaacacttttggcagtgtgaatgcgacagacgtccacttccaacacgcttactgattagctggacagaaagatttattactctgtacacagcaggatgtgctgagaactgatagaggagcaaagaaagccagaaacagcacaagagacatgtgaggacactcccagtgacaaagctactttgtgcggtgcatagattctgttgccattctttcttttaagtaaccttatttctggctttgttatgtgtatacatttatttcatttttctcacttctatctcatttaattacagagtgttgtatatgtacacatttttgtgacacatcttaaaacttttcacaaagagaagcacaattaaataaatattaaaagaaaattagaaaaataaaaataaaagaggctgggtggagtggctcacgcctataatcccagcactttgggaggccgaggtgggtggatcaccagaggtcaggagtttgagaccagcctggccaatgtggtgaaaccccacctctatttaaaatacaaaaatcagttcagtgtggtggtgggcgcctgtaattccagctacttgggaggctgaggcaggagaattgcttgaacctgggaggcagaggttgcagtgagctgagatcgtgccattgcactccagcctggggacaggagcgaaactctgtctcaaatttaaaaaaaagtaaaaaaaaaaaaaaaaaaaagaaaaaaaaagaaagaggcagcaacccttccagagaaaggcttcccaaatgagaactattcaaatatagaaaaaagtacagagataggaaatataaagaatctgatcgagaagaaggcatgttggtaaactggagtacaatgccctggggtgggtagtatatagggcataaatttagcaaaaattggttgatttcaaaatacagagcatctagaatggtagacaaaagagtttagatgtgagtgtctggcagtgttaggggagtgacgatcaagtctgtattggaggaagataacaatggtggcattgtgaagtggcagagcatgaccagattgataggatttgacaagggggacaagagagaagacaaatttaaagaagttccaaatgcttctagcctggactactgagaagacagtaatgttttaatgggatacaaaagagagtagggacaggtatggagcgggatgatgggtgccactccagacaagctgcccacagaatatctaggctggaatttccaaaagaggttaggatgcaaacctttaggaatcatttatctgcaggtgtcagctaaaaccccgtgaatgttagagatgaagtagggagaaattattgaatgagaagagtgggcatccagcacttatttcccagggccctcatagttgccacaataccatacatgggaagctgaaaagttttgtggaaaaagatgtttaaacctattcttgtggccaggcgcggtggctcacgcctgtaatcccagcactttgggaggctgaggcgggcggatcacgagatcaggagatcaagaccatcctggctaacccagtgaaaccccgtctctactaaaaaaatacaaaaaatcagccggggcgtggtggtgggcgcctgtactcccagctactctggaggctgaggcagaatggcgtgaatccagaaggtggagtttgcagtgagccgagatcgtgccactgcactccagcctgggcgacagagtgagactctgtctcaaaaaataaataaataaataaatgaaataaataataacaataataaaaacacctatcattggatttctaagagatggtcatggcctatttgagatttatctcccatctgtggaagaagccagaacccaagaggatctcaaataagggttttgtcaatgaaagcaatgagctctgtccccaaaggccatgataacttgtgtttctttttcttcatttaggtactgtaatgggtccacgaaacaattaatagatattattgagaacatatttgaataatgcacatttaacgcatcagacagttgtcaccctttctaatcctttaaaaatagtttaggatggtcatcgataatattatggaaactttttaatctcgaaaatgaaacccatatatttgataggatgaatgagttggcaagaatgtcagtaaattgcagttttcaaaattttatctttaacatcatttaatctgccagaaatttaacaagaataaggataagagattggcctcaaggtacaattcatctttctcctcatattccttgtaggtgcatatcaaatgatgtattacattctgcagtttttggagaatatatttaaaattaattaaggtagagtcactataatccttttaacaatgtcattcttattaacttgcattgcagtgggaggcaaatgccacaacctctgtggctcaaaagaaaagcaggcatcgtagtgagaggtgtgcattgtagtgggtggagggccagcaagaggctgctctgctgcaagtgctcatcagtcaaaatggagctgcagctggaaccttgtgtggttttacaagaaggagccctacccctcacctactctactttttattggcaatgaataatgagaggagcatttgcaagtgtgaaattggaaaagagcggaacatcagcctgaggctgtgtgcaagctgctcggggagccagcagagaagcactgctgatcctgcctggaccttctgtcctggaggagggtgggcctcccactcatgctggttgtaaacatctctgtcttcttgcttgccttcagacatcttctccagcgtggcgtaaagaaagagtgattgcaagcatattatatcaacgttttcattaattttagtatgcctttaaaaacatttcaacactatgaagaatacttataatcaacaacatgtcatcgtttaattggaaacatttttgtattctgactcattggtacatagtgtgtattttaccatggatgtcagatttggtgaattaagataactgtgaataatcctggtcatgccaatgagaggttgtcatccatgttaatatcttctggcatatgtgaactggggaaactgttctcccatttacccactgccttaatataacagccacatctacagggagactctgacttctggatccgcctttagaaattaagcatttttggaaaactatgtgatggggaaattactttaatgggttagctttaggaccatggaagagataagaagaatgcaaggtgttttgcttaattcttagaggcagttttccttcctgaaaatgttggcattcttgatgttataaaaagaatgtaagggtctccttatggttgaaaacaattcccccaagagctttacagaaaattgagcagcatagtgatagtttggctccccagataaataactgtgtccttcaaaatgtcctacatttcaatgtatttttcactgtcaaaattatgaaatcatggtctcatcatccaaatagaactcttagtattatggatgtatttccttccagtctgtttcatagccatattttacattgttattgtatgtatacacagttttttatcttgtgtctagtctgctacaattggattccaagtattttctgagtagtattcagtattcgtatgtttgtataatatttcctcctcaatatttctaatgtaatttggagatatttgtaaagatgtttttgaaatttttattaggattttaacaaatctgtcaaattatacagaattaaaatatctatactatgtaccactctttcagaaatatgccctcataatttcagttattcacatagattctttgtaagtcttactaaaatgattaccagatttttatatacttttgccaccataaataaaattattttctattttattttctaaaagaatgttcacaaaattacaattgcttatttataatattctaccttgtcaagttaccaacatcttattaattacaatttagttgatcccttttgatttataagatatgtaacatcactcacaaagaaggacatattttgctgttcctaatatttatacctaatatttagaggaataaatattaaatatttaatactttaaaatattaaaaaaaatattgtgaaaatattaaaattttttactacaatggccagaactttcaaaacaatgttaaataattagggtgatactaagcaccattatcatacatttattttaagacaaatgccaccaatacttcacagttgaattataattgactaaatttagtatatgctaaaactagggcaattcttgtccttaatttctacatgtaaatatttggtcacaatccttatagtgatgttacatcttgtaaactacatttccgtttatctgacataaaggatttatttcagaggtgggaaatatagggatcttgtaggccttcgacaaattatcagagtaacttcagttttatttccacaacttcacaacattgtaatgagaatctgctctgctcaactcctccactagactttaggtaaaatttgattagattctagatattagtcccttgtcagatgtatgctttgcaaataccttcttccattctataggttgtctttctgttgacgacttttttttgttgttcagaagctttttagtttagttcagtcccgtttatttattcttgcttttgaggcatttgcttttgggatttactcacaaattctttgcctaggccaatgtccagaagagtttttcctccagaagtttttatgattttaggtctttaatccatcttcagttagttttgtatatgttgagaaatagggatgcagttttattcttccacatgtggctatccaatttttccagcaccgtttattgaatagggggtcctttccccaatgtatgattttttcagctttgttgaagatcagttggttgtaggtatttggctttatttctgggttctctattctgttccattggtctgtgtgtctatttttgtacctgcaccacactgttttggtaactatatccttgtaatataatttgaagttgggtaatgggatacctccaactttgttctttttgcttaggattgctttggctacttgggctttcaaacaaatcaccaagaaaaaaaacaaagaataccattaaaaactatggaaaagatgtgaacagacatttctcaaaagaagattatacaaatggccaaaaaacatatgaaaacatgctcaacatcactaaccatcaggaaaatccaaattaaagtcacaatgagataccactttaccccagtcaaaatggccattattaaaaagtcaaaaaccaatagatgttggcatggatgcaatgaaaagcgaacagttatatactattaggggaatgtaaattagtacaacctctaaggaaaacagtataaaagatttctcaaaaaacggaaagtagatctaccatttgatccagcaactccactactgagtatctactcaaaggaaaataagtcattatgtcagagacccctgagcttttatgtttattgcagcataattcataattgcaaaaatatgaaatcaaccgaagtgcccattaagtgattagtagatatagaaactgtggtgtgtgcgtgtgtgtgtgtatacatacgcacacacacacacaccataggatactattcagccataaaaagaataaaagaatgttttttgcaggaacttggataaaactggagtccattttcctaagtgaagtaactcaggaatggaaaaacaaatactgtatgttctcacttataggtgtgagctaaactatgggtacaaagaggaatacatagtggtataatggacactggagcctcagaatgaggaagggagattccaaaattacctgttgggtacaatgtacactacttgcataatgggtaaatggccagacttcaccactattcaattcattcaagtaacccaaaaccccttgtacccctaaaactattgaaataaaaatgttttgattagaaagatagactatatccaatagaaagatcaaagctagttgaaatcaacagtgataaaaccaacacattatggcaagccaggaatatttctaaacatttaaaagaaaaaaatcaagtatggattttgtacttgatattaatgaaaagtaaaagatgcaacattacactaatgtcagcaactattcactctcagttttttcaatctacatggattcaggaatgtttaacaaaattcatggtattttataattttactctttttctggcagaaggaagacaggagtggttttacaataagattttaccacttctgactagaaagttttatcctatattattccaaaataaacattctacactaaataaatatcttttgacagtaaaatgataatttaaatcatgttacattctaggaagtacagataaacacaggcagattttctctctgaattagtccttaaatcacctgattaaaatatgatactcttggccaggtgccatggctcatgcctgtaatcctagcactttgggaggcagaggtgggcagatatctaaggtcaggagttcgagaccagcctggccatcatgatgaaacctgtctctactaaaaatacaaaaaattagctgggcgtggtggcgggtgcctgtagtcccagctacttgagaggctgaggcaggagacttgcttgaacccgggaggcggaggttgcagtgagatgagatcgcgccactgcactccagcctgggcaacagagagattaaaaaaaaaaaaaaaaagatactcttataaaagtgtgttattttaaagcataaatatagtataaaatactctctagttgcaagaatgcatccttgaaatattcattaaatattttctaagggcccacatttgtcatgaggaaatattttaagaacgggtagaatcgagttccatttttcaaatctttaatatagaagcagatatcaattaatcttttaaaaacacaattttgtttgccatgagcttttatttgggcttctactttgacacatgttttagctttaaggtatcttaaaacgtaggggcatttaagcttttagatctcataaaacttcctgagaacatgctctgactcagtcaggcccagaaaacaaccactctttcttccttttctccctccctgaaacatttcctgagggcctctctggttcatggtaacatgctaggctcaggggaacacaatgatgactaatacaacatggtacttggctttggaagttcataggtcagtggaaatgcagaaatatacacatctaattacagcacaactcagtaagttcagtaataaatgtatatgaacacagggtgctttgaggcacagaagagcagcttcctactcagcccgaggaggtcagaaagaactcagaagaggaggcactgaattaatgcttcagctgtttttcaaaatgctttcctggtagcatctccgcaaacacaagaagcttaggatttaccatgcttctagatttgactgtcaaataacacatggtccataattttaaatctggttgactacaaaactcttcattgtgaaaataggaagtaacagaaacccagtcattatgcattcatcttctataatatttaactcggcttaatcgccataattctttcaactgtctgtacataatagtgtcaataaaactagaagagtttgaataggtactaaggagcaaactcttttaagataatcttctttttaaaaaatggtactaacagcagcctcaaaaacacagcagattgcttcgctttccataaaatcaggacaagaaggttgttattcttttcattctccagtaagctcaaaaggtgggaatcttgccaagacaactcaatgggcaggaagtcattttctcaggaaatttcaaaaatatcattaattcactttgatcttttacaatgattataaaacattcataaggatggctgtatctagcagttttaactgacaggactgttgtggttttttttttgtttttgtttttttttctgaccgcagtgcatcacattaaaaacaccctccctcctcaccatcaatttcacagtggaaaatccaggcaaagtgttttattcttgcttaaccttgaaagatatatggtgtgctcaattgaaaaatctattacttaattagttttaagaggtttgacatcaaacaggaatacatttgaaatgtagatgaagtaagaggtaaaaaaaattcagtttagaattgtaaagggacatgttggatgttccatgaaggtcaaagtcaattcctttccttaagttccctcaaaagacttatatgcacggaagtattcagtggtggtaactgaggtgagccttttcccaatttttttttttttttgtggtttgttttctttcataatccatttgaactttggcttgactcttcttccccccaacatattaactatccatcatacataataattttgaaatctgctttctaactgattgcttaaggggaaaattaagattaaagataacagacaagaaaacaaataattaccagggagtactttcagtgcttcagtgcagaatatacaagttgctgtgggaaccctgaaaagcatgttgacagatgcctgaggaggtaataggaagcttttcagaagtcacatgtgaacatggcctttcaggatttgtagatgttctcgggaggttaagaggagaaagagtagtatcagaaaaaaccacatacaaaccagcacacatacacagtaggtgagaacaagtggtcctttaggagatctgaaggggtgccatggtggtgtgtgtctacggcatatggcactaagtggatgggataggagggggcgatgagaagctatggttggtctgtgaaggatcttgcaggttatgccaatgattgtagattgtatcctttggacctgcactatctgatatgatagccactatctacctgtggccatttacatttctttctttcctttctctttttgagacagggtctcattctgtcacgcaggccagcatgcagtggtgtgatcacagttcacagtaaagtcaaattcctgggcttcagtgatcctctggccttagcctcccaaactgctgggattataggcatgagccaccatgcccagccttaaatgtcaatgaaaaataaatacaccaattcagttcctcagaggcactagccacatttcaagtgctcaatagccacatgtgactcatggctatcataatggataacacagagaatgtttccatttcaccccaaatactaatagacagtgctgcttaaataaggagaagccacatacaatcgctaattgtaaagtaagagattgacttgatgaaaactgtgcttgatgaaagaagtaactcatgtagtgtgaaggatgggcgtgggggtagagggccggtgagaaggaaactgtttagcgattcacctgaaactttaactatggggaggtggagagagttgcctatttcagaagatttccagggatagaactgagagggctttgctaagtatctggtatagatgcctgggtggatggtaacactttgacgggaagacactagaggaaattatagtggactggagaaaggagattagtttattttttgacctgttgggttggaggtgcctgggacttagggacttaaagaggagctttaagtgaataggtctcaaaagtaatttccagtccttttcctttacaatccacttcctttctcaactgccccaaacaagcattgtgagtttctcatgattccggaagtttttaagctaggttaaacaagaaaggagagttgaggttgaagtttgcaaaaatgactgagtctgggtttaaggctttttcactccattttgctaccaaacctgcaaacaagcagtgcaaaggaactatgccagctgagggcaccgggaagtggctgctcttccctgatgtcaccctagttccaagatctgagggtcagtgatgcccatgggagggaaaactcctcaggccaggataaagaaaccgtgtcttccagtctttacactagtttggagagggcccacatcagcatgcatggctctgcctactgtcagataagggaattccttgcatacgacagttaaaagccatagtgttctatttcctccttctttatgccccttcacctctctttcacttttgactaagtcttccacatcacaaagaaaatagaggtaccctccacttctaaattctgttaccttcattcatctccatcaatttcctgcttgtttcacagaaagccatccccattcattccctggtttgcaaaaatgaagtcacaaaaggcatgcaatacaacagattaatgatggaggaagacatgaagctgagagaatttctttaggatggggagcaattgaatatgtttaaatattaatgtaaaagagatagtaaagaccaagacattgaagttacagaagagaaaggattgttggtaagtctcataagaagctggaggcgatgggatccaattgcagatggtgggtaagcactgaggtggaggaaagaccactcttccatcatcatagaagaaaaggaggtgtattagtctgttctcacgctgctaataaagacatacctgagactgggtaatttataaaggaaagaggtttaattgactcacaggtcagcatggctgtggaggcctcagggaacttacaacaatggcgaaaggtgaagcaaacacatccctcacatggtggcagggagaagaagaatgacagccaagcagagggggaagccccttataaaaccattagctcttgtgagtacttactaccacaagaacaggatgagggaaaatgtccccatgattcaattatctccacctggtctctcccatgacacctggggattaccggaactacaattcaagatgcgatttgggtggggacacagaaaaaccatattaagaggcaagaatgcagaccgcaaagaagataacatctaatttgaatcccaaaggcttcaacggaatttaccatctgaggtagtcacaagcccacctgcggtgtggctcagcttggccccctattcatgtagcttcacaggtatcttgacttctgggagggtttgggagcagcttctgcagccttgggagaggccaaacacagatctgcctctggatccacccgcttctccacatgagctgcttttagtccagctaaccaccaaagagccaaactgctatccaccactgcctgtttggggacccaaatcccagatttgtatttctgtccaggaatgtgtttatcttggtttgaattctaggtctgtcttttaagctttcttttttcccctattaaaaaatcatttatgtgtgtggagcagaataaatgcctcatattgtattatctactagaaatcatccgcatttttttgaaataatgaacctgttacttcttctaaatgataccaggtgtccattttagttcaaatacttacaatgttacctcaccctaagaatcctcatctgtataatatttttcactttcagtgaaagtacagctgcacggagaaaatttctacacaattaagtttaaaaatgaaaattgctctattcttgatacaacaatcagagaggaaataaaacataaaatctctgccattaagatctcctgtacaggctgcctccaccttaggagcaggttgtgttttggaagttcacttgtaaattttgtgtttggaacatctaaaataatttccatagaaaaaatattataaattgtaattgtttccagaccagctcataaaagcaaatttgatacacaatatacttgaaataccataaatttgcatgaaataataggaaacagcaaatgtaattatgatctgtttttcttttacacacattaaaacactctttgaaccaatgcaaagcccaatgacttgactaatttaatgctggagtctgagccataggtggagttgggaactcattttgatctatttccattatgccagtaacatatgttgttgaaatttagagtgaatggaacaatgagagtgggaagatgctgactgtagtttgggagtttcgcaatagggaaagatggctaaatgggtcttgagccaagaaataaatttttattttcaccagcttttgactcaaagtatttaagatgctccctctctcaccaacaccaagagggtgacagagagaaaaagagagagagaaagagaaagaacagagggagagggagaaagagagagggagagaggaaaagggagaaggagaggttgggggggtggagagagagagaatgaatgagagctgtgggaacaagccaactatttaactacctagacatgcactcaaatggaagacaaaatggcagctataataggcagagaactcattacctgcagaaagcagagagagctcccacgtgaccacaaccactgtcagtggcaattaaattttcaagtagtgggaaaagaagtaaataacggtaactgtcctcaggtgaggccgggtggaaagctgctcccttcattaaaaagaagggagggagggtgactccttaagagtcaactgatggtgctgagggtgaggctcatgtgggaataatgtagcttctacatctaccagcaacagaaggcaggggacctgagactcctttcactgtggtgctggagaagcaaggattggggttatggcggtggtgattctccaccaggcagcctgagagctgccaggaagactgaactggagccatgcaaagaggccaaaagagacaaactgaagttactctttccagaagacaaaagggccataaagagaaacaccattttcacttaatggacagtagcaagttatatatgtacgagtcaaagcctgctctttcaatcctgaatatctgataagcagatttaccttgattagtgtttcaaaatactcattttaataagtctttcaacttattgtttgagtcattgaaacggatacagctatcacgcatttgaggtatatactctcctgttttaatttagtaaaattaaaggagatcataggcctcatatttaaatatatttaatttgtttatatcaaatgtaaatccttttgaggggaacaagaacatgtataaacaaatatactataaagcaggatactacattacttaatacgtgtttgaattttaactatcatttataaaggttaattcatcatacaaaattttggggggtacaaattggtgccaagatctatgttaggtggagtgaatataatagtgtataagaaagacacagttcttgccctcttggaagataaggcatagcagaaataatagaaaagccaaagcaaggacacaaaatattcaatatctgtatttcctggcctgccgcctactccttcgttcattgcaatctgacttccactctactccaataatacttctcttcctgagccattatatggtttttcatgggacttgaacatgccctaattcagcttaaattatctttagcagttctgtttgggtttaaaattcacatccttagaaacttcccctaaccacacagaatgggtgaattacaccttccatttgttcccatggaatgctccacgtcctctctcatgaattgtaattttaaaaagtcaattcattgtctgagtccttccctggcctgttagctccctgaagggtggcaccagttatattcactatcaaattcactcccctatcaagagtatggtcattaaaaggtgttgtgtagtatctgatgaataaatgaatgaatacatgaatggaagaggcattatataataatcagaaatattaagttctaaacagagagtgatgggagatgaaggtggaaatgtactcagctcatagagagtcttggatatctttttgttgattgggacactactgatcggaaaagtagactcaagagttatcattaatgcctcatttatgctgagctaggaaaaggaaaagacgattccagtggaacagactttttcacatgattcttactgccttgattgattcaatatttactatatacatgatgtctctggggaaaatgagcaagaggaatggaaaactctgcagatgaaagaggacgatggcctctcggagaatagaaatggcagggatggagtgaacataaagtttatctgcagcagtggcttccagatagagaacagctatataaaaaccaaaatttagaagattcctgattccaatcccagaagactgtattatgtctggatggagactaaagatctattacaactcttcagacaatactgatgtgtaaagagaacgtctcatctagtttaaccctttcgtttacatgtaaggaagctgaagcccaggagaggttcagtgacattgtgcaggtcggtgagctaggactaaaattcctgtctcctgaccttgaggtcagggttcacagcattagctctaaagaggcaaaataattacccataagtttgaagaataaaattcaaagagaacaatgtagctttatctacttatactacctttttgaagttaaaggtagaaactagttttctcaacctgagttctgaagctcgagaatgagatgggtccacactgcacaatgtagccacctggtttaccgcattaagatcacagcaaacctacagaactaacagatttccaggcctgtgatgacaatgaatctgcagatggctggggggttttatgttgagggttgagttactaatggcatgaatcacgagcagcttgtagagaatgataaacacctgttcttcataacgcctaagtacagaagaaaaatgatggaccaacatgatagtgttactgacttgggctgaatatgtatgaactcttttcattagtaaatgttagaaagggttatcaagggagattgtttaattaccatttttggtaggtccttagtttgaatctggaaggcattagacctaatctttccaaatgacagagagtgataccaattgatgttgtattagagcccagtgagacctctgcctttaaatgtttcctcagtggaatatcctagggactctccaataagacgagtacatatgagcacagatcctaatgaaagggtttgatggtgagtcatgattccctgcatttcacccagaaagatcagcaatcactcaattagcttccacagagaaacaatggtcagcattttccttagtctctcgagacaaggataaagcagtacacccctatgtaaaatgaatgaatcactacaggcaagtgacaggtgctattcttgtgatgtcaacaaaagtcactgtagtaatgaagattttctgaattagattttagcttcattcttcaccccttctcctttttttgaccattcttttgcagcttgtttgccaaattcaggagagaatgcaagcagcttttcatatgttcagcagtcccaagaaactttttaaaaatacaaacatgtctgtgttttgtatgcgtttttgaaaatgtatgcatttaccacacttcatacatacagtttctttttgcagaaacaggtattcccaatagaaatacatttttcctgcagttttagaatctacacaggtcaaattgtacattacttaactctgtgacaggaaggaaggcaggcaggttgttgcccaatgcatagcactgacaggcagggcaaaggacactgaactccaaatgtcatcaaactcaatgactttgagatgagtcctgctggactataggtactgccagagctatctagtccttaaaacataccatatatgtcgcttattcccaaactgacagattctgctagtaatctggaaatgcaggaaaaggaaataaggtgatttaatttttaaaagggcgcactggctcacacctgtaatctcagcaatttgggaggctgaggtgggtggatcacttgaggtcaagagtttgagagcagcctggccaacatggtgaaaccatgtctctactaaagttaaaaaaaaaaaaaaaatccaggtgtggtggtgcgtgcctgtaatcccagctacttgggaggctgaggcaggagactgcactgctgcactccagcctgggtgacagagggagactccatctcaaaaaaaaaaaaaaaaggataataatgatacctcatcataggtcctttatgaaaattaaatagcttaattggtatacttttcataatatccctcataatacaaatattctggttaattgggaatcaatatacgtcacatagattataaatttttacacagtataaaaatatcccatcacataaatcatatttattataatttaccaattttaatcattcaaaaaatgtttcaggaaggcctgataaattggtattattatatgaacaattaaatttgtcataaataagagattctgtcatctaaagatgtaccaacaatctacagataataaagtggcaaataaattatatttacatcatttcataaggtactttctcacatattaaagcataattatagtacttattactttcatttgtttgcttattaattgagcaaacaggttttggggattaagtacaaagcatgaaattagactttgaaggtataaagattaatgagatacagtctctgccgttccttgaagcagatgccaaagcaaattggggcaaaaacatgagagttggtaccaagggatttcatctttactctgagggcgaagagaaccattgaagggtttggaggagcaaagtgatatgatcagcttcacatggagattctcttgggaaatgatttgagggaaccagttggaggagcatggcagaaactgaggcaagaaatgatgccaagttgacccctgaagtaacatcgagtcaggaggaagaatggaaaggagtagatgcattggagtgacagcaagagtataaaacccactagcttgagagttaattaggagaagattatttccaaactttaactggggtctctgggcagatatggtgccactcagagatgtagaactctggaagaatagcaggtttaaccttgggacacaatgagatcaaacttggacattttatatcagaaatgtcaatgggaaattttagtagaaatggtacccattgaagatcaggggagatatttcagtggaggctatagagatatatgcattaacagtgtcaaatagctgcagaagacaatggggacctcccccatatctcaaggaaagttttctgagagtaataagacaaatacaagaacaagtcttgggcttccaagatttaagtagtgacaagcctgacaagaagaatggagaatactcagatgagtaggaggaaaattaacatagtaagtggtgttaaagtccaggagccagcggtaaagaaagaggacctggctgagggcagcaggtgattcagagtccatgtaggaagtcttcttgatttggcaccaaagagtctcctgagactgtggcccgagaaatttcagtggacaccagagtgccctagattgaggagtcatcgctacagaagataaggtggagacatgaggtgaggacaatgcttccaagatgccgaaactcatcaagacggataaaggtcaaaagaggactttggactttatttgtttgaagatagacatgtctaaaccttacaagaaagagacagaagagaagggagtatcaaagacaaaaagaaagtgagggaaactgaggaacaggaaggtggcaggaggagatgggaaccggagtcgtggattacagactgatcagggcatacagatacaggttaaggaaacagattttttttttttggtggggggaaaaggattcagtataaaaccctgcgtttaactctgattttattcatagggtggcccatttttcctattcattcagcaagactcagtgaaggtttctctcatcctggaattgtgctaggcacacagaggatacagtggtaaatcaaacaaggtccctgcccacaagaaacccaccctgttggagctggggtggaggcagagggtacacacgtaaatttctaatccaaggcaatctgtggaaatcttagcattgatttacagtttgcagtggaaagccctgtatatctttctatctctcagacatgaaaaccaatattaaaatagttcaccctccttaacataattgcaaacagcaatcttttaaatgttgaccactatatagatacattagttataaatgtagccaggggactagaattaattaaccttagcagtgaattccatttgaacttagtctaatcagggcaattttctattctggagaacaaaattaattatctggttcatttaggaagagaatcccaccaaaagaaaacaaacaccagaattttttccttaattattaggatattaatacaattcttgatccagtgtcttccctctgataagaaaatgtacaataaaaagaacgacattttaggccaataaatagataaggaaagagataaagagttcaggttaacttatcgggaaagctgagatttattttactgtagtatcaaatttgttctctttattctcactttattgtattttgctccagtttcccttttcataatatgcaagataattttgtattatcaatatcttatataccatagagccaagaaagtgataaggtaaaatattttgaaatgatgccatctgcataaattatttttattgcattaatttaaattaaaaattatctagatatacatcaactcagaggtatcaccacgaagtatcttaaaataaaattatgaatgacaaaatgctattttatgcagcacttatgttgctaccaattatctttgtcaatatttaaagacaggccttacacaaattccaagattttcatgagaaatagtgaagatattaacaaataactaaggggacgagcagagtctcattctttgaacggcgtatctcatatgatccaggtttctgtcagccttgatgctgtgttttcaccgaatagatctaacaaatgaaccttaaaagtaaatactcttggaaggacagtaaccattccctgatactgcagtcagtatttctggttctatgtggccagtaagagggaaatttttttcccctttcattaaaacagatgggttcatttgctgtccaaaagcgaatcagcattaatttggggcatccttactatgccaaggatattggcagatttttaaaactcaagtaatggcttggtgtgtttttaaaacaagcagaaatgcaattttcatagcaaaggtaaaacatcacatctctggcagtgcatctcctcctgatgttggtggtccatttctcctgccaaaagtgggagcaggaacacatttgggtaggaagatgcagactgaaaattcactgaaagaaggttaaggattatactagggacatagacaaaaagggaatacacctgaagcaattttagaacacaaaaatgtattgcatcctttaaattcactgtctcctaaatgtattagtccattctcacgctgctaataaagacatacccgagactgggtaatttataaaggaaagaggtttaattgactaacagttcagcatggctgggaggcctcaggaaacttacaatcatggcacaaggggaagcaaacacgtccttctcatggcagcaacaaggagaagtgcagagtgaagctggagaaaagccccttagaagaccatcagatcttgtgagatctcagtcactatcatgagaacagcatgagtgtaaccgctctcgtgattaaattaccccccccccaccaggtccctcccatgacacatggggattatgggaactacaattcaatgagacttggctggtgacagagccaaaccatatcacctaccaactaattttaaatgttacactctttaattttctacctgtttattttcattcatgttcatagtcaaattttttaaacaccattttgaatgtttagaaaaatcatggacatgccatacacgaccacatgtacagacacattcacatcactttgctaagcatgagtaaatatatcctagcttaatgcaacaatgattgaatcgtagagttaccttgtactatctttgtaggattccattattaagacaagcacagaaggcttagaatagacaacttctatcttactccctcatagttaggattaaagagattatgactgaacttttaaattggtagaccttatttttagagcagttttgggtttacagaaaaactgaatgaaaagtatggcaagttctcataaaacctaacatcactcagtttcctctattagtagcatcttgcatgagtggggtacatttattgcaattgatgagccaatattaatatattattattaaccgaagtccataatttacatgaggattcaccgtttgtgttgtacagttcaaggaattttgacaaacaataatgttatgtatccattgttacagtatcatattgaatagtttcactgccctaaatatctcctgtgttccatatatccgtccgtctctccctctttctgaactcctgggaaccactgatcttttttctgcctgtattttcacctataccagaatgtgatatacttgagaagatgcagtatacagccttttctggctgcctcctttcacttagccgtatgtatgtaagggtccctgcacatctttttgaggtttggctgctcatttctttttagcattgaataatacttcactctatttttgtaccacagtttgtttaaatgttcacctaggatatcttggttgtttctaaggtttgacaaatatgaataatgctgatataaatattcatgttcaggttacagtgtggaaattagtttttaactgaattggataaataccaaggaatatgattgctagtacatgtggttatattttgtaagtgacactgttttccaaagtggctgtaccatttcacatttccaccagcaatgaatgaaagttcctgtttctctgcatccttgccagcatttggtactgcagttctttaatgacagatgatgttccgtgtattttcatatgcttacttaccgtctacacacacagacacacacgcacataatatatatatatatgtttggtgctatgactcagattgtatattgtttttggtgagatgtctgttcagacctttttcccatttccttggttagttgttttcttattgttgagttttaagatttctttgtgtactttggatacaaatgctttaccaaacacatattctgcaaatattttctccctgtctgtggcttgtctttctattatctttattgtgtcttttggaaaacagtatggagatccctcaataaaaccacagatgtataaaaaggttttttctgaaagtagtttttaattttaataaaatccaagttatcaatttttttctttcatgaattgtacttttggtattatatctaaacacattgctaaaactaaagtcatgtacgtttttccctcttatgttatcttctagaagttttacagttatgcaatttacatgtctgtctacgatttatttttatttaatttctgtgaaaggtgtaagatctgttagaattttttttttttttttgcatgtggaccatttgttgaaaagtctgtcctttcttcactgaactgcctttgcttctttgtcaaggatcagttggcaacatttgcatgagtctatttctgggctctctattctgctgtattgatctatttttctgtcttttcaccaatactatgctgtgttaattattgtagctttgtagttgttcctttttaaaccttttaagttgacaaatagtaattgtatatgtttgtaggggtgatatattgtgatattttgatatatatttacaatgtagaatgattaaattgagctaattagaaaattcatcacctcatataacttatctttttttgtgatgaaaacatttaaacctaatcttttagcaattttgcaatatataatacattattattgattatggtcactattctgtgcaatagatcactaaagcttattcctccgatctaaattaaattttataccttttgaccaacatctccttttcctcattcatgtcccaccccagcttctgatagtcatcattctactctatacgtctatgaattcaactttttaagattccacatataagtaaaactcagtatttgtctttctgtgtctggcttatttcacttagcataatatcctccaggttaaggctatgtgtctgttgtgtgtatatacttaagtgataaagaaaatgtgtatacatacatacacacacacacacacacacacacacaattttctttatccattaacccactgattgacacttaggttgattcacatcctagctattgtgaataatgctgcaataggcatgatagtgcagatatctctttgatatatttatttcatttcttttagatatataccaagtggaattgctgggtcttatgctagttctatctttgttttttttttttttttttttttttaaggagtctccaaattgttttccataatggctataataatttaaattcccatcaacagttcctttttctccacacccttgtcaacatgttatcttttgtctttttgttaatagccattcttacaggtataagatgatatctcattggggttttaatttgcgtttctctaatgattaggataataaacattttttcatatatctgttggccatttgtatgtcttcttttgagaagtgtctatttaggtccattgcccattttttttggactgggttatttgttttcttgccattgagttgtttgagttccttaaatattttgaatattagccccttatcagatatatggttggcacatattttctcccagtccatgcaatgtttcttcacactactgtttcctttgctctgcagaagctctttagtttgatgtaatcctatttgtttattttttattttgttgcctgtgcttttggggtcatatctaaaaaatcactgcccagaccaatgttacggagatttccattatgtgttcttctagttgctttatagtttcatgtctttagtctatttaatctttaatccatttttaagttgatttttgtgtatggtattaactaagcatctaattataatcttctgtttgtggatattcagttgtctcaatattattcattgaagaggctgtcccttctctattgtgagtttttggtacctttgtcaaaaatgaattgactataaatggctgggtttatttctggtgtttctatcctgttttattgttcactgtgtctgtttttatgccaggactatgctgttttgattaatacatctttgtaatagattctgaagtcaggtagtgtgattcctccagctttgttctttttgctcaagattgttttggctattctaggtcttttgtggttccatataaattttaggactgttttttctgtttctatgaaagatgacattggaattttgatagggattgcactgaatctgtacatcacattgggtagtgtgggcattttaacactaattcttctaatctgtgaacacagaatacctttccatttatttgtgttctctacagttttttcatcaatgctctatagttttcagtgtatttcacctccttgggtaaatttacccctaagtattttgtatgctgttttgaatgggatcgatttctttacatctgtgaacaaagacagtacataaaatctaaatctctctttccttctttttccagtttagattctatggctcataatttcattaagactcttgccaagaacttagtatcctttgttctcatttcttcacttccatctggcaaaatcccaactgtgcatgagtgcaactcaactgggttattttgcctccatttgtgcaagcacaggtggggaaatcagaagagggtggatggcgacactgtaaatttgtcatcaacaacatcaaatggccctcaggacggataagcaatttgactatatttttattttccactctctctagtttctcccatagtgattttttcaaaacgtttccatttgcctcaagcttggacaaattccttaatgttctccattgacatggtaaatttcttatgatctacttcacacaagaagaagccatcatatatatggaaattccatctagtattccctaacaaacctacaaatctatctagatgaactcttactctttttaaaaatgtttatttgatgagcagggaagaaattctttctatctaggtccagggcctcttcttacacagcaatgcaatatataatgatattttaggtcaacagtggaccacatatgtgacagtggtcttataagattataatatcatattttcactgtgctttttctatgtttagatatgtttagatacacaaatatttaccactatgttataattacctacagtattcagtacagtcatatgctatacaggtttgtagcctatgagcaataggctatatcatgtagtacatagtagtctctaccatctaggtttttgttgatgtttgcacaacaatgaacttgcttggcaatacatttctcagaacgtattctggttactgtgcaatgcaagactgtaacttgaatcctatgttttcgggaacctcaaaatagcaaccatccgctcttattcccacatattcaataattttcttacaattgaatcccttgcctgttataattaaacattatcaattatctccattaaaaaaattctctcaacttatatggcttcttgtttcccattttcctcatttacaataaaaataatcaaaagagctctctgtacatatgacagattatatatttaattaaaatattccctctctattgctgcctcactgacatcaggtttggttatgtgactttctctcatcaataaaatatatatgaaagttatgtgtgctgcttccaagaagcagcttttagagtaattgcatgcacctactcctttctctttttcttccatcataagaccaacgatgcctcagaataacacctgctgcttcaccctggtcctggaagatgcaggacatcagcagacgtgaagttgactgacagtacacggtagtttgagcacaaaatcaacccttgcaatagtgtgcctgctgaaattttaaaggtattttttactgcctcatactttactctatgttgacttgtacatgactttttgcctccattttctccctccccattactactcaacctgcttaaaatctgacttcagggttatctcttcgcatttacatgtcaataagttaaatggcgatttttcagtgtgactttagctgatctctctaagcagcatttcaaatagttgatcactaccttctttttgaaacagtcttttcagaagaatctcttgcatctttgaacacgaatattcctgattttttcccaaaaccttgttgttgcccctcagtccttctcattccccatttccttgagtattaaatatattagtttctcaattttctctcctaaaacatcatctcttttcattctatattctcttcttagacagcttcatcagatgattttattttctttctttacttaaataatgttcaaacatatgctttcagtccaaacttctctgaatttctgacacatatatccaattgcctactttatgtctctgcttacatgccttaaagtgatattcaatatgccccaaacataatgcttaaccatttgccctaaaccatgcttgtttctggtgtttattttgttttctctcatttccttctctcataaactccatgaggcagagcccgtgcccatttttgaatcttggagtacctgatatacaaggcaccaaaattcccagcatgataaatcaaacaattaacaattctgtacatcagggtaaaactgcagataaagatatgctcatttgcagtttgcttttcaggtgattcactatagttagacaactaattcttcagcaacaacaatggaagtcaggagttagtggagtaatataaaaactaaaagaaaatactatcaacttagaatagtatattgagtaaaaatatcttccaagaacaaggcagaattaaggactttttaatataaattaaaaaaaatgaagagtttgttttgccagtggtgtttccctatagggaattccaaaagatatgttttagacagaaaaaaaaaaatgatacaagatggaaggctgagatgcaagaataatgatagacaagaaagtggcaaaaatgtgggtaaactgatacaggcactcactgaataaaaccataataatgtctaatttgggggagttaaaatgtagaaagaaaataagaggacatagttaaaatattggaatgaccataaacagaaaagaaataaaagaaatgataaacacatattaaagatttttgctgggtatggtggtacaaatatgtagtctcagctactctggaggctgaggtacgagaagcacttatgtccaggagattaagaccatcgtactagcaacatagcaagacccctgtctctctaagaaaataaaataaaataaaatactgttattattttctttttaaacggtgtgtgaagcatttagtacatttttatactttataccctacagatgttttataaatattgctgacctttaaattaatatttaataaacatataaaaatacattttcttatctccagctgagtttgaaacatgtttatgcaggaataaaatgtataatttattagagagtgagactggcctagttcactgtttcttatattttccaaatggaagaagtattccaagaacagatccatgtttgaaaccttgtatttcagtgtgttagtctacaattatgtaccaaaatagttgcagccttttatatagcactttgaggtatcagtgggtactcacaacatttgaataagatgtgcaaagatcacagtatcatcgcatttgtttacaggaaataatctagtttacatagttagaaaagtgtggttagtgaggtcatgcagaatttcatcatttattttaataaatctcaagattatgtaacaacaatagatattaaaatggtcaccagatatgtaaaggcattactataattctgaatgctactctaaatgtttatatttccttgtcagaaatgcaaaattttcttgaaagtgtattagtggtgtcagactcacttttttcagaatccactactataacataaaatatcacccttcccagtctatacagagaacagagaagtagtccaaagagcatccttatggcacatatcattgccataggaaggtgaatgtctacattaaagagctaaatcattataacttaattcttagctgtaacctcatgacatttttatataaccagtcagataatagcttcaatcatttagatacaacttggaaaattctagttagagaaatgagaatgagcatagaacactgagcagagtcctgagacactcattccaggccctaactcctggttgacatttctagacaaaacctgggccagaagggaacctgttgccttgagtggaagaactcagtcctggcaggattcatcacgggctgactaaagagcttttggcctctgaataatcagcagcagtagccaggtagcacacactgtgggcaaccacactctctgggcattgggtgagactctgagatgtgctgacttcaggtgtgaccaactgtttcacagctgtcatggctatgaggagagaccccttcttcttgagaaaagcagaaacaagagtaaagaaaacagactaggtatcagtttggccataaggaggtagagtaccaagggggatcttggggtccgtgataccaggctaagctcttggacagcatttctagacctgccctgggccatatgggaacccacatccctgaagggtgagtttcaggcctgaccacatttgccataagctgactgaagagcccttgggccttgagtgaacactggcagtagcctggcaatacaacctgcaggcctgtggtggtggcagacacggaggaagacgcctctgcttgtggaaaggggagagaagagtgggaagaactgtcttgtgtttgggtgccagctcagccacagtggaatagagcaccaggtaggttccaaaggtatctgtctccaggtcttggctctgggcccatatctctggacccacctggggccagggggactcactacactgaagagaaggatacaagcctggctggtgttgccacctgcagattgtagagccctaaggccttgagaaaacataggaggtagcaagaaagtatttacagtaggcttttgggggacccagtgctgtgctggcttcaggtcttagtgcattcacagtggtgatgcccacaggaaggcttatgtcactgctcccccagcttcaggtacacacactcacacccccccacacacacatgcatgcacacacagatactctgtttctttgggagaaagtaagggaataaaacaagaggctctgcctggtaatccagaaaattcttttgtatctcatgcaatactaccaagaaccatgaaggtagcatttaaaccagctctagccagaggggaatcatccatttcagcggtcagatcttcaagcctctatgaggctggaagagtcacagcattacaaggatgggggtgccacttaatgcagttatggttgcagtgacctaaaacttagatcacaatacccacatcccatagatacctggaaaatcctcccaagacggacaggtacaaacaagcccagactgtgaaaactaccataaatacctaactcttctatgcccagacactgatgaacatctacaagcatcaagacgatccaggaaaacatgacctcaccaaatgaactaaatatggcaccagggaccaatcctggaaagacagagatataggacctttcagatagagaatttaaaatagcttttttgaggaaactcaatgaaattcaaggaaacgcagagaaggaattcaagatcctatcagataaatttaacaaaaatacttaaattattaaaagaaatcaagcagaaaaaagttgaaaatgcaaatgacatactgaagaatgtatcagtctcttaccagtagagctgatcaagcagaagaaagaattagtgagcttgaaaacagagtatttgtatatacacagaggagataaaagcaaaattaataaaaaagaatgaagcatacctacaagttctaaaaaatagcccccaaagggtaaatataagagttattggccttaaaaaggacagagagagagagatagaggtagaaggttcaaagggataataacacagaacttccccaacctaaagaaaggtagcaatattcaagtacaaaagggttatagaacatcaagcagattaacctaaagactacaaaatatttaataataaaactcccaaatgtcaagattaaagaaagagtcctaaaagcagcaagagaaaggaaccaaataacatacaatgaaactccgatgcacctggcagcagacttttcagtggaaaccttataggccaggagagagtggccttatatatatactgtgctgaaggagaaaaaaaccattgatcttagaataggatatccagcaaaaatattctttgaacatgaaggagaaataaagacatttcaagaccaacagaaaagctgaaatatttcatcaacaccagacctgtcctataagaaaagctaaagagagttcttcagtctaaaagaaaaggactttaatgaccaatatctgaaggtataaaaatcaatggtaacggtaaatgcacaggaaaacaaaatataataacattgtaactgtggtgggtaaacttttcatatcttgagtagaaagattaaaagataatctgattaaaaataataactacaaaaacttttcaaggcataggtggtataataagatataaatagaaataacaaaaagttaaaaagtgtggggacaaagttaaagtatagagtttttattagttttctctttgcttgttaatttgtttatataatcagtgttaagacattatctgtttaaactagtgtattataagatattatttgcaagactcatggtaaactcaaaaaaaaaaaaaaacagtgtatacacaaaaaaatagaaagcaataaatgaaaacagaccacaagagaaaatgaccttcactaaaaggaagccaggaaggaagaaaagaaggaaaagaagaccacaaaacaaccagaaaacaagtaacaaaatcacaagaataagtccttacttgtcagtaataccattgaatgtaaatggactaaactctcccatcaaaagacatagagtgactgaatagataaaattttttaaaaaaagacttgttgcctacaagaagggcacttcacctataaagaaatatatacactgaaaataaaagggatggaaaaagataatccatgcaaatggaaaccaaaaaagagcacggtagctatacttacatcataatagatttcagaacaaaaactataaaaaagagaaaaataaggtcattatataatgataacggggtcaattcaataagaggatataacaattgtaaatatatatgcacccaacattagaacaccctgatatttaaagcaaatgttagacttaaagagagaggtagacccctatacattaatagaagaagactttagcaccccactttcagccttggacagatgacccagacagaaaaatcaacaaaacattggacttaatctgcacctagaccaaatggacctaatagatatttacagaacatttcatccaacggctgcagaatacacattcttctccacagcacatgaatcattctctaaaacaaaccatatgtttggccagaaaactagtcttaagacattaaaaaaattgaaatatatcgaacatcttctcagaccacaatgtaataaaactagaaatcaataatgagaaatttttaaaactatgcaaacacatggaaattaaataatatgcccccaaatgattagtaagtgggtgaaaaaattaagagtgcaattaaaaaatttcttgaaacaaatgataatggaaacacaatatacaaaacctatgggatacagcaaaagcagtactaagaggacattttgtaactataagcgcctccaccaaaaatgtagaaaaacttcaaataaaaaaaaaaactaatggtgcatcttaaagaatcagacaagcaagagcaaaccaaacccaaaattattaaagaaaaagtaataataaaggttagagcaaaaattaatgaaaatgaaatgaagaaaacaatacaaaagatgactaaaatgaaaagtttgtttttaaaaagataaacaaaattgagaaaactcttgccagactaacaaaatacagagagagaagacccaaataaataaaattagaaatggaaaaggagactttcaacccaataccactgaaattcaaatgatcattagaggctactatgagtaactgtcaggcaataaattagaaaaactagaagaaatgaaaaaaaaaatgcctagtgagatgaagcctaccaagattgagccacgaaaaaatccaaaacctgaatggacaaataagaagtaaccagatcaaagctaccataaacagtatcctagcaaagataagcctgggacctgatggcttcactgctgaatgttaccaaacatttaaacatcctactcaaactgttctaaaaaacagaggaggagggaatacttccaacctcattctatgagatcagtattgtcctgataccaaaacaagacgaagacacatcaagaaaaagaaaactacaggccaatatccctgatgaacatggatcagaaatcctcaacaaaatactagcaaactgaatccaacaacacattaaaaacatcatccatcacggccaagtgagatttatcccaggaatacagagatggttcaacatatgcaaatccatcaacacatcatatcaacagaatgaaggataacaaccatgtgatcatttcaactgatgctgaaaaatcatttgataaaacttaacattgtttcatgataaaaaccctaaaaaaactgggtatagaaggaaaacaccagataaaagtcaataaaagtcaatatatgcagatccacagctaatgtcatatggaatggagaaaaactgaaagcctagcctctaagatctggtaagcaacaagcatgtacactttcagcacttttattcaacataatactggaattcctagctagggcagtcaacaaaaaaaattttaaaaaaagggcatccaaactggaaaagaagatgtcaaattatccttgtttgcaaattatgtaatcttatatttggaaaaacctaaggactccacaaaaattatttgataaacaaattcaataaagttgaaggatacaaaatcaacataaagcatcagtagcatttatatatgccaacagcaatcaacctgaaatagaaatcaagaaaataattccactgataattgctacacataaaattaaatacctagaaattaacttaaccaaagaagcgaaagatctataatgaaaactatgaaacattgatgaaagaaattagaggacacaaaaatggaaagacattctatgtttatagattggaagaataaatactcaaaatgtccatactacttacaacaatctacagatggaatacaatctctatcaaaatactcatgaaattcttcacagaaatagagaaacaatcttaaaatttatatggaaccaaaaaagacccagaatagccaaagctatcctgagcaaaaggaacaaaactggaagactagcattatctgacttcaaattatactgcagagctatagtaaccaaaacagcatgacactggcataaaaacagacacatagaccaatggaacaaaatagaggacctagaaacaaattcatacatcgacagtgaactcattatcaacaaagattccaggaacatattggagaaatgacagtctcttcaataaatggtgctaggagaactggacatccatatgaaggagaatgagtctagacccttgtctcttgccatattaagaaaagcaaaatggactaaatacttaaatctaagtcatcatattatgaaactactacaagaaaacatggggaagctcaatttgagttaatataccaaaagcacaggcaaccaaagccaaagtggacagatgggattacatcaatttaaaagttcctgcacagcaaagggaacaatcaacaaagtgaagacataaacccacagaaaatgtttgcaaactgcccatctgagaagagattaatgaccagaatatataaggagctcaaacaactccataggaagaaagtctaataatgcaactaaaaatgggcaaaatatctgaatagacatttctcaaaagaagacatacaaataacaaacgtatatgaaaaggtggtcaccatcattgatcatctatgaaatgcaaattaaaactacaatgctatagcaccccagttaaaatggcttttatctaaaagacagacaataacaaatgcagatgaggatgtggagaaaagggaaccctcatacactgttggtagcaatgtaaattagtacaaccacaatggaaaacagtttgccagtttctccaaatctaaaaatagagctattatatgacccagcaatctcactgctagatatattatgcaaagaaagtgaattcgtattatcgaagagatatctgcactctgcactcccgtgtttactgcagcactgttcacaatagacaaattttggaaacaacctcagtgtccatcaacagatgaatgaagaaaatgtggtatataaatacaatggagtactgttagccataaaaaatgagatcttgtcatttgcaacaacatagatggaactggaggtcattatgttaagtaaaatatcctggcacaaaaagacaaacttcacatgttctcacttatttgtaggagctaaaattaaaacacttgagctcatggagatagaaaatagaatgatggttgtcagatgctgggaagtggaaggtggggaggaaatggggatggttaatgggtacataaatagaaagaatgactaagatctagtatgtgaccgcaaaacagggtgactacagtcaataataattgtacattttaagataacttaaaaagtatgattggatggtttgtaacacaaaggataaatgcttgaggtgatggataccccacttaccctgatgtgattattactcattgcatgcctctatcaaaatatgtcatgtatgccataaatagatacacctactacatactccaaaattaaaaataaataatttgaaataaaacaaacaaacaaaaaacctaaaaagcagcgctgtggtagctgtccgtggtacttgtccacagtcctgaataggaatccactttggtttgtttcaatacttgctcaaatttatacaaattaatttcaagattacctaccaggtagtttttttccttcttatttattgtcagaaatattatctcttgagaagaaataaatgtcatattcaggaatattataattattcaacttatataaatatttacatgaaatctcaaacacgcataaatttttccttatatttaagcatatttaaaatatgacctggaaagacaaaatgcttgctgccaataaagcattttcttatggtgtttgctctccattagccccctttccaaaatcaattttcatacttctctgccctgctctggaagcctgggtggctgatctctaggacagcctgccaagctagctgggttttgattggattttgcctgtgggaagtaatggcagtaaagcaagagattatcagataggctgagagagaaactggggtatttcctccctgcaccttcactgctttggcaaaattactgtgaagcaattagatttttaaagactaccactcccactgtgtgatctctctgttagagctctagccctccctggggcttgcttcttcctttgttttcagttctattttttttttaataactcattcctaccatttctattctctggatcctcccatatcctctatttctttccttagtaaacaaattctttattttaaaaactttcttcatttaaatcatctgagtaaatcctctttccttccaggacaatgaatgattcagaaggtgtttaaatcaaagctaatgtatctaattgagaggaaagaatattcatagagaagaaatgaacattaaatgtctacaagatgcacacattagtagggaatatgctattgacactaagaatgaaattctgtggctattggtcgatgtgcaatccctaataggttaagcccattgtgtattaataataagtattaatacatagttgttcagttcatgtagaactgaataaattgaataataactatttcataattatttggagtttactaagaggtgagcttgaagtttaaaggtaaggtattattaaatcacggattcattttgtcacatttacacctattaattttacaaagagaaaacaatgagcataaaacctacaaactatcccaagaattcccgccatccaacaaagaaacagatgttggtggtcagaaaatgtaatgttcattatagcaaaaaattatgtgatctcttattctattgaggggtccttaaatttttttttaaaatcacatttgacagaagcttaacttgaatttaaatgtggctaaaggtattcttctttacataggagagaaattagtcagaagtcagtgcacactggagagaaattgtgagaaattataaatggttagacttgttttctcgataatgaactttttgcaactaaacagcaccttgaaatagtctaatggctgatgtaatgaatgtgtcattttatgaatgaaggtcttaaaattataaaagtgcaagagaatttataagacaatgttgttgtaatgtaaaagccatttttttgcagaaagaagtgcaagagcctaaaatttactatcaactttaaaatcagacattaagaacaaggaaacaaagctccagcataacaaatgtaagaaattttacactatctggtttgtggacctctggaatgtaactcaatccatggtcaaggaaaaatgcactagctcctctcatatgggacttagggcagcagaagggacctcaccgcatgaaagctagctttccctggagcaagcaactcaagagaccaaggtgaaaccgccagcaccttttgtgacctagccttagaaaccacagaccctcacttctgcagaaatcttgtacacaggtcagctctcaaaggaaaccacacaagtgtgggaacacagaagtcaagattatagggaccaccttgaagcttagctactgagtaatgaggagaatcatgactgctcatgaatttgttagttttaaaatgttttattttaaaattattttagatttataaaaggttgaaaaattggcacagtctcccatacctttcatccatcttcccctcatgttaacattctacatgatcaaatcacaatgatcaaaaactaggaaatgctggtacggagttatgacctaaactatagattttacttatttccccagtattcccacttatgttctatccctggccccgatctaagccagaaaacagattgaagtttgttattgtgtctccttagtctcttctaatctgtggcaattccttagtatttccttgtctttcatgaccttaaaaattgtacattttaaagcttactggtcagatgttttgcataaggtctttcagtttgagattgtctgatatttttctcactaataggctggagttatggatttagggggagattacctcagaggtgaggtgccttctcatcacataatatcacagggtacattatatcaacatgatttatcactgttattgttaacctcggcctggttacgatgttgtatgctggctctctctactgtaaagttactgtttctccttttccatgctttatttgttagaaggaagtcattaagtttggccaacactcaaagggaagggaattaagcttcacctcctggagggagtattatcaaggaatatgcgcatatgttaaaaccccctcagagatcaattagtttttaattggagataaaagatactttttgatggagatagaaagctgtataggaaacagataacatcacaggggatctgagaaagtatttcaactttattttgattattcacagtccattaccatttctttattcctatacttattttaatacaaataaacataatacaaatgtattctattttcctcctgtcatgctatactacatcatacgtttttaaaatattttgagaagcatgatttcaatatttaaatatcttaattttcacttctgactcagtttgagcaaaattccagtcatctataaaaaatgacaccaaagaactgtcctccaaacacaagccatgtaaagtttcttttttgctattttttttttttttttagtttcttggatggaaggtcaaatagacattaactataatggtccctaatgattactaataatggtaccaagaacatcttgacaaagtactggagaggttcccagatagcatatttttaagacagaaaattatgttagttgcactaaaactcaattttaattagccatgacacttacatacactttaaagctgatgaagtgctcttcagactaacaagtcttaataagctctgtttaaatttaatttctatttccatttgacagtaaccaagcaaaacttgtgattcactatgatgataacacagcagggttcaagtgctgtacattttcaatatgttcttagttatgcacccagccaatttaatttcaaatgtataaactcttctacccttccttctgagaacaataatttactttgaaagatttctttggatttttaacttttatagaaagaatatattaaatggaaaatattttatataatacaggccttttgttcttcaaattataaaaacaataacacttctttgaatcatattttagcaaatatataccactagaagaatgacaggtgaacaaatttagtgccactcagataactgtagtaattatatactatgtcaactctctacaagtctcagcatcaactctcactacacccatttcaactcacggcaatttggatagatgctgacgttctttttttcctgttttacttattcacgaaaacaaatctaaaagaatagtttaaaagaagtaaaagaaaggcatgtcataaaaaaaggatgtgcacgtgaaccctgaactttgtgtttaaatcttccttccttcctcccctcccttgttctccccttctctttcttgatatgggaagaaaaagaaaatttcagagatgactttacttcatttgtgaagcttcctgacttctgcccagtcagggttgttcccttttctgagcttacccacaatatttttgtctctcttcgaacaccctactcaaacctgttttccagcttattggaagcacatattcttctgtcccttggtgaagcactccttcaaattagaagaatgacacattcattttgtaccctcacgggcccaccacatagtggacacccattaaccacttattaagttgaattttagaaaaattgtttgattttaaaaattcaaaaagtgcatatattcaatggagaaaactggggaagcactgagcttgctgcactccctcccctcaaatgtgaggggtaactgggggccagaggagacatcgtgagagtaacatcatatgaaccacttgggaattgctcatgttggcctgtaaaatagcagttactctgcaaatcaagctataatccatgaaattatctaagctttgtttgaacctgctgtttttttaattcctagcaccatttggaataatgtgttacataaaaatttctttgttcatttgtttttgccagcactgcttaaatgaacactttctcttatttgattgaaaatacaacccattttcagtgttttgagaaataaaagataaacccaagttatgtctgtcaacatggtttacagttttataaatttcaatttcaatgtcttttttttttttttttttttttttgagacggagtctcactctgttgcccatgctggagtgcagtggcatgatcttggctcactgcaacctccgcctcccgggttcaagcaattctcctgcctcagcctccctagtagctgggattgcaggcatgcgccaccatgcctggctaatttttgtatttttagtagagacggggtttggccaagttggccaggctggtctctaatgcctgacctcaggtgatccgcctgccttagccttccaaagtgctgggattacaggcatgagccaccatgcctggcctcaatgttttttctctatcttcatgtagcaggaactttaggaccagattgcctgggttcaaatcttgcctcagccacttagttttctgacttgggcaagccatttaaagcctctgatccttgttaactttatctgtaaaatgaggataaaataatattacctgcctcataggattttgtgaggtttcaatcagtaagtacatgaaaatgaactcccacatggattacatacagtaaggactaaagcagtgttggacataattgtaatgattatcagtagaagtgccataattcctttagtcatttaacattcctttcgctgggtcttcatcaagtccattatgtctcttggaaggatagtgtgcaaactgcacctagtaaatgtgccactgaagcacggtgtggtagaaggagattgcaatcattttccttgtgcttttacacctcttcctcacaacgcttaggaatttgttcacttatgtgccactgccttatactgaaccaatatcttcaaacatcagtcaaaagtgacaccctaatttacaagctgcactttatagcttagactctttaagttttataaatatttttttccctcccttaaatgagttatcttaatgctttaatgcaatgttgtttattccccatgttgagctactttcactgatatttatcttaagcgaggtggcttctactagataaaataaaataataactgcgcaattgtcttttctagctgatttacaaacatgtaaggccatgtctctaccagtcgccagaatattgaataaccaattgtttgcatataggtcttctattcttattccttcattttaatttagcaaacatttattgagcagttaaagagatgtgcttcgtggcacaatttagcatgggaaaaacatataaacagttctcctacccttgaaaactaaataaatgagtcacgtctcccctgctccttctggttcaggcatattcaccctgacatagaacattaggggtttagtcaagactgtgctttctccactcttctcagagttcactgtctgaagctatcgagtagctcagtgttaggacagagggaagtcgggaaatgactgtgtgtgcctttctgttactaatcctgaactcgccaattaattaccacgctatctgaagcttcggtccttgcctatttgtgatctgaaggacaggatacacctgtagatcctgcactggaaactctaaatttatacttgttgttgtttgctagtaatattcattccctttctcagcagtatacctagttctttttggggaatttcccttcctccagtgggcgcagtcttggtatgatgataagtcctagaagctaacggagaccctgaagcctccttttgttaggattttcaactgagtggagaaatgaaagacagaaaaaacggtcagggttaatgccttgattctggggaaggacgggggttgagtggttcagccacactgttcctgccacccacagctctggaaagtccaggttcctgccttttctgagactgactctgcggccctctcttcaaatttgttagtttcctcaagatccttctaatacattcttgcttgcttatgttatccagagttagtttcttttttcagcaagaggccctaaaagactccatttataaagaaaaaaaaaaaggaagcaatttttgcctgagttatgagtagattaaattcaatatgtacaaatggctccagtgacagcgggaattattgaacttaaactaagttatgttaacatgaatcactttgtaattatttcatatcactgatcatgactactgccaaatgagttatgagttgtaaagctataataaaaatattatgatgcaatattatcatacatgccaagtgaaacattccgttaaatctcttacctgaagaaaaatctgtagatgccatatgccatttaaagtatttcaggtatagcatcctggttgagcatcccaaattcaaaaatctgaaatccataatgctccagtaagcatttcttttaagcatcctgttggtgcccaaaatgttttggattttggagcattttagatgtcagatttttggatttgggatgctcaatttgtatttctatttgtacaaggtaggcttcctctctgtttcatcaattataaaagataatgctattttcttcaaaatattgtgagttaaatgagatggtatctgtaaacgttcttagaagaacttctgtgaattatgaccccaatctaaatagacattccaaactattttctactgaaaacccaaggtcaggtttatatccctgatacatagaataaaaaagcctgatatctgaagttacttagatcatcagaaagcataaagctagctttttaatttaagtcaatttgacaacttcttgacaacattttgatgaattgtgttctcctttaattaaatagaagcagaaaagacgtctcagtgttgaaattttttaactatgtaaatacaccgtagaagttttgagaaataatacctctttttcactctcgatttttggtatccttccttcaaaaaacttactcagtaactacttgctgagaagttttattcagtaaatatgaacatgatgatacaagataatgagggattatatatgtatagcagcactattaattctaatcaaaatatgtaactaccctttcaggttactgaaagcaaatgagctggcaataggagctgctttcatattattagaaatgggtgccctttaggcaaagatctctccaagagtaatctgtggaccacctgcatccaaattacttggaattacttttcaataaggtgaatttgaaaaatgcccctctccaccccaaattattgaattataatgtctgaagaagtagaatacaggaaaaatcatcaataaaaacttttcacataatttgcatgaacatcaaaatttgagaactataactcagatcatctgtggtagactttatcactgagtaggcaatagtcaaagtgggccactatgtgatgctgggagtgttgtgcagtgcacaacttcagagagtgctgttggtatcacagtctataccgtacagcagctctgattgcaagatttaattcatatcttatggttgccaaggagaagttaccaaaatagcaactgagagaatctatcacatttgcacttttcaaatcttcagctttacaatgtcatcaagcatgagatgtgtgaaggactgtgttttgatctatctcctaaatcctaaagggataattgacatcatttaaaaaaaattagtttttttcatcatttatttgatgaattctaggttttttaaacaaaggaactgaagaaagaagaaaatcttttgtttagaagttttgggtcattaaagtattgaataagcaattttacctgctgagaatgatcagcttttagtctgcagttttttagttatgtactcagaaggtccctaaataaaaagaaaactataaaaattgatttcttctttttttcgtatggaagtggtaccaaatactgctttaaaaaatagtctcacattataaaaattagcccacattcatgtgatattcagggtaagtggctctggagccacaactaaattgtagcatctcaacacccgtttcctcaaatgagatgctaaacaaagtgtcttcgatttaaaatcaaactatacaggcctccttagttgcctgtgtgttgatggatattttcagaaacagaatctaaaataatatttatttggaaggtttacaaagagagattactacttttctcagtgcagattgtccaagttggtccaacttcaagagtatttttcaatctggatatgagtctgcaaatccacattgaatccattaggacctacttaatataatttcctccccatatcttttatcctccttttccatgccctgtttgtttatttaaacctcttttttcatcttcttagtctttcaagcatgtcaagttagtcctccaaagagacatttcctttgtcttgtaatttacttgttgtgttaggaattgtcaattaaccaaatagtcctttactgaaatgcaaactggttttcagattcaaatagttgtttttaataggccaggaaatcccagtgaataattactgtttacatagtttccacagtgtttatatgcattttttaaatttaaaaaaatgtgaagaattttcttacttgtagttttccttatagccttgataatgcatcttattacatctatatttatgcattaaaatctagtaggtataatttatcagtaagaatgaccactataatgccttaactttatttaccaaatacactgctagaggaaaatacaatcaaaataaagatattagaaagaaaatgagaaaaaagaagatgacatagattcctaagaaagtaagtcttttaataggtttctggaacatcaatatcagactaattataatctcttgaaatcagattttctggtgaaagtagaacttatgtaagaccagaatgaaaatgtcaaaaaagagattaaactctgcatcagttttcttttcctatacatagataactatgaaaatgaaacaaatagaataaaaatcataagtgtcctaacataattcacataatcagagccttttggataattccagttatgatccatagaaataatttcttcttttctgatgtgaactgagttgtgagagcactgaaatttggaaagtattttgttacaaattggcaaaagtttcaaatctcttccaatgcatgctgttgaaaagatcaacaaatgatgggcttctcaaaagttccatgtggttactatgcaatcatacgaacttacacaatttcattttggctaaatgatgatggaaaacaaatatagcacaagatgtgcccgctctttcatgtcagcattcataggcctatcattcactgttactttactccccagtttaatcgacgtactgagaactaaaggagaaaaatgttatctttttcatttcttttttggttaacttgagcaattcatttttggtttattaaaagccaaaacaataagttacccagggcttgagtcacatcttttatcactgcacaaaacttgcctgtgactggttatgtctgttagaatttatgtggatgagacacggcaatgtgtgattgaacaagtcctcctggggattccaatgccctgtggttcttaaaacactgattgctgaggtcactcctagagttcttgattcggtaagtctggagttaggcccctcagttcgcatttctgacaagttcccaggtgatgctgatgctattatctgagaaacacacttcgcttacagcattgataaatgaaccagtctgtgaattttcatagactgcctttcatttcctgtcagttatgataatgaaatctcactgtaagtccataaagtaacatcaaagctgtgtcagctatgaacacaactcttagaaaaaaaatggtcgcatatgaaatgcaaacatacgatagaaattacagagcacttattacaaagagataaatcttagttacatggatgaaggaggaaaaggaaataatataccatcattctgaaacaaatagaaatgcaaaatccaacagcactggctggaggatatgggatgccaccaataaaaagtattttaagtatttcttttacttttctaaaaattgtttttgtggactgccattagattcctacacattggtgttgtcctgaatattttggaaagaaacttaggcaatacttccattgactattgacaggccaatgatactgttctaagatttttttccttatcattagttttctaaacatttttaaatttatttttaattgataataaaaattgtatatatttatcatgtaccacatgttgttttgaaatatacatacattgtggaaagggtaaatcaagctatcccttatagtcatttatctgggatggtcatctgccattatatagaaaaatgatacattattttgcttccatcatgaaaaccatcaggcgccagacatatctgcttctcaaaagcagttccccttcatcctcaaagccctcgacctagtaatgtatgattctgattttttgtagaatgtgtcttttcattacaataaaatacactccatttctttgttttgggaagattatagctttctccccaggctttttaggggacaaagactattctccatatgacgaacctatcaagattcatcttgaaatattttatgcattctttttttaatccactggaattaattttgttcttggatcaccttttcaaggacacaatcagctctcgcagctgactgctccagtgggtgctagaaagtccgcccagaattctggcacatggatctgaaatgaaggagaacacaagcagccaggcattaaggaggatttggggtaaatctgctcttggaaatgcaaacttaggaaaaactttccacttcaaaaaaagagtcagaactttctttgggaagtggcagaacaaagggaccttgcatgctcattcaaaaattcttttcagaaacatttgcacacctgggaggaagaaagcgggaagggcaggcagtggcactaggaacccgatacctggtgggcctgtgatcgcatgggtaatacccacctgagggctagatcacacatgtagcatacctgtgagggctagatcatgcatgtaatacccatgatgagggctagattacaaatgcagtacacataaaggtgagatcatgcatgtagtacccatgtgagggctagatcacacacatagtaactcacaatgagggcaattacacatgtaatacccatgatgagggctaggtcacacatgtagtacccacgatgagggctaggtcacccaaagagtactcactatgagggctagagatgcactgacacaaagtggccatggagcagtcctcagtggccctcatcacactggtttggtgagaaagtgtcagaaagaaaggggagagtgctcagttgactcacctgccctctcaccgctcttagatggtgtgttgtgaggcttgtgccttgtgctgtagtgtttagtagaatcattcttggacacctaaaacaccagtttcttggaacacattatttaaaatctttctaatttctaatttccccatctgtaaaatcaatgcaataatagttccttaatagttcttttcggttaaaaagtgcctctgcggagtacagtgcctggaatataacaagtactccttacgtaaccgaaacaaaactcataagtctgattgctataatctctaaggcatttggaggtggactgaccacggatgggcacagtctgaggacagccttgtcctcagttttgcttttgtggacttcctgccagatcctcccaaggctctgcatttctggggctttatgagaagagaactcatccccttggcaagaagtattcttcatcaatgatctcatcatataacaagttattttgaggccactttatagtacatgtgttagagatttcagtaactaactcatgatgacacagacaaatttgaatacaaaacaaaacaatgtcacagcaacgtgatcttccgtgatatcctcatgtcccatgatgtttctttctaagagcacttacttcagtgataaatattatcattttgggatatctccttggcatcagaaatgtttactaattttgaaataaggaaagtgggatgtttcagtcaggtgtgtagttctgatttttggaaaaaaatgaaacccgcttatcttttttttaccctacactgtggctgaaaggtatacaatgtcaaaatggcatttaaaaattaaggtagctatattttggaacattttatccctacctttgaaaattcaaattgttcagaccttcagaaaaattaatagtaatgccacgaacacctgggtgcccatggtgtaacttcatcgattattattttgctttcttgctctttttttttctgtaccatctgaagttgtagacattgtgcatatcttaagaactcatatatcccacataatcacaagtccatcaaaaatatctcttatctaatacatagtccattctatcaagataataatttgaaatatattttcctggataagagtgtcagtaggaaatctggactaacaacggtcaccttcccccttcaagtcctacgtaggaggggaagatgcttaagacaaccacacacagatcagattactgtgaatttgttaagaatttaacaaatgactttagctttccatttaccaaaaattacatttaatatttaataacatcttttaatttctagactttttgagatgtttctagatttctgatagtaccataatatattaaattcactcttgaaaattaaaaaaactacctaatttacacaattcacctatttactcttatagaaattcatgcggtatatcttttggagtaaatactgcgttagttgcaacagagtaatgagaactatgagttgccaaatcagtgatgggggaaatggcaatgaaaataaaataaatactgctggtcattcttcgttgattctatatcaaaggttgttcccctcccgagcccaaatatttaagagacaatggatcagttacatgatctgtgtgtcattttcttcagccataaaataggtaggattatgtcaccatcaacatcacaaggatattaaaaggctaatggatataggatggaattgcttttagttcataggtgccggggcataacacaaatccaaactgtatgcatctcagtgatatccgctatcatccagtgtaacgaaatggttcttagccaagtacttagaatagcctatcatattagaacttttctcacaatgcagcaagtgtctattagtacattttctgaagagtttgtaagattctataaacagttctcccttattcttgttataaatatagcaagattaaatcacaggaaattgccattttataggttaaaagtgatcttatattagcaatttcacattgttcaacttagcaattgtgatagctgtggtctgctacgttgttagctgctactggtataactcagaacattgctccaatattcaaagtgtataagcttgtacatttgcttaggaaagtgctcggtacttgacattcaattcatgaggggtattatcagtataatagtattctgtaaaatccgaatattttcatattaattgctactgatgtttcaatattttgtgcacaacttttctttcatcagcattatgaaaacatatattgtgataagttacaattgtgacataaaatctgcaaaagacatatgtacttttttgggagcttatgttacaaagagattttcctgcacatttctttagtgaagtaagggatttcagaaaaaagacaaagcttgctgttttagcagctctattgctctgttttttaaatgaaacaaaacaaacattccaatccctcaaaagtattaatcttagcaaagctattattttttataagcaatagccctagactttcaaatgagcagcaagttccagactacagcagcacagagataacacagagtcccagagcaattcgttgaccttacagcaggaaataatgatgtatcatcagaatccgcttgggtggtatcgctttgccaagaagcattaggcttctttttcaagtaagatttgatttttctgctatttctagagaggctgggagcatttatatcaatgaaatgcaaagatactcttttattcacctaatatgatcacacctacaagctgaaaacaaagccaagggcttggggacagggccccgactcatcttggggacagggccccgactcatctgttttgcctgtgcaagtctccaagtcatcctcatggaatgggagaagcttttcataataaatcccttaaatatatattcaaacgttaccactgaaaacctgcaagtgtttcagtaccacttgctgatgggaaacaaaccttccctatacgtcttcatcttattatcactgaagagtgtgtgtgtttattcctattaaagtatgtgtgtgtatcttggggctatttgggggctgcatgtatgatatcccccagtaggagcagcatgacagaattataaaatgtggtaaaatgtaattaggttttatgaagttcttaacatagatgctgaggaaattttctaactgatatttttcacttcctgatttgataaaaaaaaggaaaaaaaatagccatggcagatgatatttcaggaaggccaaacaaattttatttagaatttctaggacaaagcatttatgtataacagttctgggtgaaaatggatgattttccagtaacataaaagtgcacactaactgtattgttagcatcaatctgggatatggtcacacctttgaaactctaacttctggggtgcagagaactcagcagggaacagaattggtcacaacctctcattgcagtgaggagtcagttatcctcccaagggccagtgctggcctggggacgcacagtgtcaaaccccagggtgaaaggtcaggggtgctttctgtgtctccccacacacccaccctctatccccagcatctctttcttgtttatcaggacttccgtctcgagggtaattgcttagaacagaaaacaaggttctgttaattcaccactggacaaaggaagaatggcaaaaaacgttgaagaaaagcaagaagggttgtccaagaagcactcaagtcagttagttgttggtttcttttcaatttgttgtgacatttgttagctcattttacctttatttcttccttcagaaaaagaaaagaaaaagcgagagagaatgggaataagataccaattctttcatcatcatatcttgtttcaagattgtaaagccccatgagagataagctctcttattttattcaatgataatggcttagaattctgctagtgtctaaaatgcttcggttatgtttggaatttcacctgaattggaggagtagtagtagttgtaataggacaaggaggagaaggaagggaaggaggaggagaaggatgaggaagagaaagaggaaaatggcagtaacaatagtattactatattactagcagtaatagtaatatttattataaatcattactgagtgcatccatgtgtttcacactgatgtaagtatttttcacgtattaagtcatttaatctttagaaccaccagctatattagacattatactcttattcccatttttcagatgaggaagttgaagcatacaaggttaagatacttggctgagttcacctggctagtaaggaagagaaccagaattcgaacccatgcggccttggcttcagcttccgtggttttcatagctacaatatactgccttatttctatgcctcttccctgtgaaaagtgtccttaaaaatgttatcccaggccgggtgcagtggctcacacctgtaatcccagcactttcggaggccgagccgagcggatcacctgaggtcaggagtttgagaccagtctgcccaacatggcaaaaccccgtctctactaaaaatacaaaaaattagccaggcgtggtggcaggcgcctgtaatcccagctactccagaggctgaggcaggagaatcacttaaacctgggagatggaggttgcagtgagcccatatcgcaccactgcactccagcccgggtgacagagcaagactccatcttaaaaaaaaagttatcccatatatttttcacagcaaggtttgggatgtaacgatattgcagtcaagaggattaaatgtcttttggaaggtcactaaatcatggcccttgggatttaacctaggttttcactcttatttctatttgatcttcaaattcccactatctgagaactcaggatatactgggatctaaaattcaatatgccagtgacaaagcaaaaccattttaattttgggagtattaatatggcatttggtgcgagagatgaaaaaaatatcgtgattttggtcaaagtcacccccaaatggtagcgttagacttggcacttgagttccctgggccttcactcgggtcttcactgcaaacccttgctgcctctccaaaagcctatcttggggttcctgtgcaactgcattaattagcttagtgggaaaataatgaggaaacaagcatgaatgctgactttaaagctcaaaggaaataattaacaataaccttcacggcgaaatgaagaacagagcaggagcccgaaccatactttcagttccttcaggatattgactcgttggagtctgtaacatttttgaagactttactgcatgaggatttctcttatcctgatgtacagctttcttttcttctttattattttccagcaaatcaggctcacaaatggctctctactttaactaactgcctaactgcctgttttaacattttcttatagagactgccgaatctgttcaattactcaaggggggaaaggggagacatttagacacgtggacttaccatgactgtagacaaagcgagctagaaatatcgatggagagctgccctgaactccagactcatctgccgcctagtcatctccacctggatgtctattaccattctcaagcttaaaaacgaccttccaatctctccctctcagactattctcagcacagcagcagagcaatcctgttaaaaagtcagtcgaatcacgttactcctttcttaaaaacctaccgaatggcttcctttgttcctcagagtaaggcctaagtcatcattgagtccctgcctgaccttcataccccgccggccacatccttgtccatcactcccactgcttcagggcactggttcacatgcagtgccttgaattggtcaggcaccctccggcctcccgcccatgtatgtgctgcctttgcctggaatgctcagatacccacatagggcacttgtgcatctatttatgtctctatgcaaatatgccttgctcagcgaggctgtacccttcactcccctattgaaaatcccgaggcactcccctccctttccctgctctatttctctccattgtactcctcaccatatcttatgccttatatgttgtaatcacttattttgttcattgctgtatactccctccagatgtgaactacatgaggacaaatttcagcctcttttgctcatgcttcatttccaatgcagagaacactgccgggcacaaagtaaaatgctcagtgtagagctcctgaattaatacatgaatgaaggatgtatggaattttgttttttaaaataaagagactagatgtgaaaaagagcaagagtgcacctggctacacgagagtactaaggatcccagcaagttaatggcctgacatggttgaatgttctggcaaaaaaaaaaaaaaaaaaaaagtgaatattggctatgcatattagatatgcttacccaaatgagtcaggcaacacttttactctatagaagtacagtaaccgttcagtaatgatggatttctgcatttgtttctcaagtttatttatttttttcttttgagacagggtctcactcaattgcctaggctggtgtgcagtggtgcaatcatagctcactgtagcctctatctccacggttcaagcaatcgtctcacctcagccttcccagcagctgggactataggcatgtgttaccattactggctaattattttgctttctgtagagacgggggtctcactatgctccccaggctggtctcaaactcctgggcttaagtgatcctcacgtctcagcctgccaaagtgctgggattatgggcgtgagccaccaagcgtgaccatgtaagtttcaatttctccatatccatatatttataaactcttctctctctgtcctattccactgtccacagttatgtctgatagcctttaagctcatatccttcagccatgcatctttgggtaggtaactacctctgttcctctttatagagcaaagggtttagatcccactaagcaaatcgcacttcggagttcagcagatgctggaagtttgttggaggcagggcagggcagggcttatagatgtttggggagactgcttttttctcttctgctccaagatactttctcttccttgggctcacaacagcaatttcaaaaaagaaatgatctctcaggtgaaacagaaggccttattaaccaagagggcaaaatatttaggtgagagaagttatcactacattacccttggtatttataatttgaggtgagctcacttctgctattaggtacaacactcacagctgtcacctccttgagtagttaacaggaacgaaaaataatgtcatcagctgctgtgtcacactgttcctctgtacctgagaaagtcctgatgccaacaattttgaagatcactattaaagattattttgctaccattttatacctcgtgtttcattaagttcctgaggagctaatttttatttccagctcaggaacatttgtttttgtaatgtggttcatatttagtggcattgtaccttctcatgcctgtcacctcatactttagcaagatttttgctaaaaagaaccaaagcatcttgatttcaaacatggagaaaagctgagtcttggtacctgttctatgcattaactttccactatggagtgaaaatatgtcccttccatttaatagactctagtgtgtggaagtgaacttataaaacaagatttcaaaaatgtcattcaattgcttcaatgacttattcaaaagcagacctacatgaagctgaaaaaagaaaataaaaccctaaagtatgaatttaggaagaatataaccatgtaacttaagtcagctactatattcaattaaaaaaaaaccccacaaaaaacagccacaaaaataaagaaacaaaactcatttctggttgaaagagatcacaaaaacacaagaagaatttacacaagtgaaatctataatgccccaggaaacagcgttaaactggagtattagagaattgaaaaccctagaaacacagaagtgacagagtctttaaagaaagggtctttaaatcctcctggccttcagaaaaatactctcacatgcatttgagagagggagagatagatagacagagagaaagacagatgggtgttatctttctccttaaaatcctcttagacataaatcttataaattgcttttctcttaagaaagttttccagacttgagattatataacttttaaagctggaaggtctgtcagagctcatttagtccaagaacttgactttacagatggaagcaccagggtcagaggaggtcagtgagttgcgggcaggcaaggttggaccacaggagtcctaacttctcaccctgatgcctgtctctagtaaccaatgtcagagacaacccacgtacaacaatctccttggagagttatgcagtttgctcagagtaaaaaaattcaatgtctcatttgacagatgaataagcagatgcccatgacagtttatctcatataaaatccagtgaaaatagagtatgtgtatcacaaacttttttctttgtaaaataggattacaatccctggtacaaatacaattgtatgtaacagccactattaaaaaacagtggaagctgagtttgtctaaagaagcagggggtggttcctgactcccactctatagtgagcctcaagagggaatcatgaacgcacaactgtgctacccctgcaggaggaagaatattggtatcattttcagcttacatgtctctaagacgacctgaacttctttatctatttctaagccattcatcatttatatggctctccttcccaagccctaacatttatttttggcagtgttgttgggatggggaggtaacacccagggattgagcatttgctctgttccaggcaccagtctggctctccgtgagctctggaaaggagtcaacagagttctggactaaacagcttaataagtgcccaggcacctgccaccaaaaagagtgtggccccaagtggagttggaatgagtcatctcaagccttgaatgaccttcagggagttggcccggtggcttgggtcacaggagaggcaacaccttcatggagggaggcttcggtctgcaaatcaggagagttttattctactgtgactaggaaggaaggtattctatggaattttgggctagtctcatttctcttttgcctcatttttgtaattctgaggttgtgagagtgtgaatgatatctattcacttagattactgtaaatagtagcctgatacatgagcaatttgggggaagggatatttttcagaaattaacaacaacctctttaagtattgatgggggaactgagaaaagtatttgaagttgaggtaggcaacagcttcactgcataaattggaaagaaagtttgtgcatacttacattgagagagtcagaaaagaaaaaagcagtgtttctatgcagtattatgctttagactcctttgctttgcacaaaacagcagtcatgactctcttacagcaaatggcttacaaaacagttgaactttccctttaaactagtagctaaagaaacgaaagccaaatattcaaaacaaaacaaaactgttaggtttcccttcaatttcgaccgtaataatttttgcagaattcaaatgcagccattgaagataaaacatttgctgattatgagacaagagaacattgccccagatgtcagattatttatcgccacagagctgaacatcagaaaccaattcacacatcacaatggctgtagcgccaatcatgagctaccttttctcttaaacaaagtcatattcttcttactttcatgaatttttgaagctgaatgctttcaaggcacttggagattgatcttccaatttaaagtaccatatcagctaaagatttttatctacaggcccagggccagtagctggcatttggaatccctgggagaagacaaacacaggcaattgctgcagtatgcggtgttacgtagctgtatatcagcatactcaccaactctctctgcttctggggaagtagcaaagaatcattcactccctcagtaaagtcacataaaggaaagaatcctaagaaacacactaatgcattacgcagtaggattttatggccaatcaactccattcatccagccctaactaaccccttgcaggatgctgtgttagatacaatgaagaattacaaaagaataagcagtggggttatgatttacccaaaagataagtttcagtgagaaaaggaaaataatattctgaaatatttgaacatagtaaacacaacagagatatttcttagaactatcttattttatttattttatatatgttttgaggcagagtctcactctgtcacccaggctggagtgcagtggcacaatctctgctcactgcaaccttcacttcctaggttcaaatgattttcatgcctcagcctcccaagtagctgggattacagatgcacaccaccatgacagctaatttttatatctttagtagagccagggtttcaccatgttgcccaggctgttcttgaactcctggcctcaagtgattcacctgcctcatcctcccaaagtgctgggattataggcgtgagtcactgtgcctggcagaactattattatcaagacactacccttttatccatggcgatcacaattaaggctctagatacaaatagttttggaacagaaaaacataaatacttacccaatccctggtagattttgcaagagacgagactcaattccactggaattcaactaaattccagtgattccctgatttatatttgtactttgtatgttgtttctactcgcttcagttctcaggtttggcagcctgagactgccaccttcatgtcagtcccttactttccccattcctttctgaaattttcatgcttcagtgaagtgtttccaccccttccacataacccatgatgcacaataactttgaagatcagcacgtttttattctcccacattgtactatgtcaggcagggattgtcaataggagtaagaacaagactcatccacggcacaagtttcacagaaggtaccttcctcttacgaatttggaatcctgatttctcgaagtgattgtcccctccaagtgccatgatatacaggtatcctattttgtatagagagctgcttctgttgatgatcctaatttttaacaattaaatggaaactgaaacttgggaactgaaaggttgattagagatggaccaaccggtccaatctgacttaaaggtaaggacagttatgcccaaagaaagtaagtatcatgctgatggttattcggcttgtaagcagaagctttatcactcaaaatgttaattctgagatagccggttgttcttaattgagtcaggtcgaatatctaggtcttattaaactcaatcaggacttctccaaaacatcacttttatctccaggtatatttgtcctgcatttgggagcactacccaaaatctaaaataatgctcagaaccatatcatctcatattatccagaggacagacattgagaccaaattctaaggtcaggaagcaagaaatatgcatgtttttgtgttctggtttatgaaaattggaaagagactaaagtgaacacatttccttcccatatgactctacttcctaattctcagagaaacacacaatgaatcaagaaaagctttggagttccctttgattctttgacagctgtagaaacacgaatgaataagacaggacctgaagtagcttccttgcagaggaaatactgacatacaaaaacatgaatcaagacagtctgtagtaaggtgctaaactgtatgcaacagaatggagttcaatggaacgtaatctaggaagacacgctgagccttgaagaggccaagggagaaagcataaaggaatgcacagaattagcatgatggactagtgaggaaaccagcctgggcaaagcagagccgagtgctggggcacagcaggaaataaggcaggaattagttttacgtacgcccgattaaaacctctgcacagagatttagacttgatgcattatggaaaagagcgcacagtcaagttcatctatcctttagattgccttctgccatgacttactgaactacttgagaagcagaggtggaaacaaggaagctgccaaatgaatatgaaaactcattttcattagtcctaagtggcagatttctgagctcttaattcttgtgtttattcaacagaatattgctgtccatcttttccccaagtaaactgtatttttcttctctccttttgtttcgactttcttttaaactgactctctctctatgttactctctctctttgcaactctatgtatatacagccaaaagagagatatacatatatatatatatttatatacagatgaaaaaaaaaatatatatatatacaattttctttccaactgtagtcattagtgaccactattttccctattcagtaaagtgccaattttaagcatggggaaaagagcaccaccaatgaaaccccgcatctttctgcacagttccatctatcctgaaatctgggctattgcttagaaatcatctccacatatgtcaggtctaacactgaagccaggagttgttactacctaaacctctaagtgaaatgataaaaactatacttttccccaaataaactaaatataaatttaatgttttttaacttttgaaagagaaaacatataaaaaagctatttttaacataaaatattagagatattttatctagaaaatttcaacaaatcctaaggaaattcaatatcaatcattatttggtttctttagtgagagaatgaaaggtccgattttaccaccctaaccaagtttcttttaatacttatgtgtaagaacaaggactgaagggaagcacagagggctctgacaactcaaggcagctaataaggatgtagatgctaattcaagctgaaccactgactctccacattactataagcaaatcattctgatgccctgctcttctggccagtcctggggccacagtgaatcaaaagcaatactatataatagaaatcatacttcttctgagatcagcttgggcaacaaaatgagatgccatctctacaacaaacacacacacaaacaaacaaaacattagctgggcatggtggctcacgcctgtgttcccagctactcaagaggcttaggtggaagtattgcttgagcccaggaggtcgaggttacagtgaactatgactgcattactgcattccagcctgggtgacacagtgagatcccctctataataaataaataaatacataaaataaaacaaaaatcatacctccgtatataagttctcctacttaaacagaatttcttttactccactgtgttttgtaaaatttactcagacttactcaacttagattccttagggggaaatatgtgggtatgtgtgcatgtgtatatattaaaatgtactcaactcaaggtccttctggggaaaatcatacatacgtgctgaagttttcattttcttgttacatgagttttttttaataatataatctttgataaaatatttcagattatactaatatgctagcttttactctctcctgagagaactttcagtagtgaaactgtataaatcactgggaatgcattttccttgaaaagcataatgtgctataaagacggtttcactctttttgctttttaatgccaggcttcctcgatagcctgagggtacaggaaatgtgacattaccaagaagaagggcgaagacagctggaaaggaggagaaggaccataactgctgggttcttccccagcacagagcacgtgtgaacagcactgtcaacactcacacagtgtgactctggcatagattctggctgagacgaacagcagagtgacacactgcccaggatgtgaatgttagcacgtgtactcacagtagaaaggaagaagaagcctacagaaagcagagtaagggagatagttatggttagttatgtttacactgataattgtgtaaaccactaataattccttgaaagtgtaggctacagaattgccagggtaagcagaaagctattgtgatctataataaggaagtgagagaaatattgagtgaaatgtccaaatggcatgtgggatgcctaaagcatcaacatggtaaaatttagaggctggaggagggcacttagtgaagtcttatagttcagaagggaaaatagagtctgatgtcaactggttacccggttaaatctacaatttggaatttataatatacagtgaatgtatatgttactccacttggcagtatctggctaaatagggttaaataaggaaattgttaaaatatttagattgtaacaaaaacttattttaaaaacttattcatcacagaaagttatacattatatcatttacatccctcaatgatctcctagaatttttataaactctggttgaagacctaaagctcttttaacaaattcatttttttctttttcttttcctttcttttttttttttgagatggagtgtcgctctgtcgcccaggctggagtgcagtggcacgatcttggctcactgcaacctccacctcccaggttcaagcaattctcctgcctcagcctcccgagtagctgagactatagatgcatgccactatgcctggctaatttctgtatttttagtagagaccaggtttcactatgttggccaggctggtctcaaactcctgacctcaagtgatccatctgcctcggcttcccaaagtgctgggattacaggcgtgagctactccgcccggcccagttcattttctagcaatcgttatggattacaacaagagttatacatatgtgtgtgtgtgtgtgtgtgtgtgtgtgtgtgtgtgtgcgcgcgcgcgcgtataacctatgttgaattctgtcagcaaaaagtaactttatttatttagcttggataagcatgggactcacccaggctggagtgcagtggcacgatcacagctcctggactcaagtgatcctcctgcctcagcttccctactagctaagactacagtcgtgcgccactacgcctggctaatttttaaattttttggtagagacaaggatgaggtctcgttgtgttgctcaggctggtctcgaattcctaggatcaactgtttgtcctgcctgggcctcccaaagtgctgagataacaggcttgagccaccacacccagcccaggatgcctgttttcaacatagccgtcaacaccacctcttgatgaatgcccattcctaaagtttccatttttgaaggacaaaatgttttgatcgggagtcacgttttgttttatatcccatttcccttacagccagtaagacttatcaagcatcacttttacatacgtgcttatgtgaaaaatacaaaaaaaaagcatgatataattgtgaacattttcctacacaaagaaaaatataaacaccaaagtgggaaaagtgaaaaaatatataatattaaaatattacacatggcaactaaattatgttgtgagttggataaaattaataacatttaattgatttcatttcaatagtttcttaactgatcatcgttcattacggcaatactgctccttattgtagtgcatttactcaaatagaaatgatcagcaaaataaaggagatgaaagtactaagtttctgaaactttgccttttcctactctttggtcatgaacaaaagccctgcatgatcttaaatcttgtggaacaataggaaccaagcagagactccttccaacccttcatcttcctacactcctaatgcaaatctcatagaatgtggaccttatagatcagttaggaatactgccaagcaaattctgcaatgcttttacattattttatattttattagtccccaaagcacctagatatatttgaatatattcgttgtacatacgtgcaggacatccgtgatttttgttttaaccgtgcctggtacataaatggattgaagcactcctagcaatcattcaccctccagatagtacgtagttaacaggtggggaaccactgcgataggtggttaggtcagatctagagacagcggaggtgaaaatggagggaagagaagaaagggaatctgagaaagccccggtgtcagtaagaggagcctagggtgtgtgggatggaatgtggaacaaactgaaagatgtaatacttcactgttttcatttgaaataactcctcaaaaagtcatttagaagacagtgaattagacttgtgcctaactcatacacagattggatactctgaggtagagaaggcacagataaattattcattaattcacacagtcaactttcctcctggcaaatggtagacagaagattgtgatctgaaatttttactgagattacatattcagcagttgtagtggcgaggcttagtttctgggtctgcatcactctgaatgaagggcaatgtgatctctagagataaaccagattgctaagaaatctaaataaccccttgagcttcactggcttgagtggttgaccaatgccattacatagtgtaacactcaatattcagcagcaaggttaatgtgttttgatagataatttaaattatagaaataatataaagaacaaaaataaaatagttagctaatttcaaggggtctattgtgcccttagagagaggatgagttgattaacgaagtagacatttccaaacgcaaaacatctaatgtccatcagaataatctctctgtgttaggtctactgctatcttttattattctattttatgcattaaattctctactactttctaaagattctagtctataatatggaccagacctcctttgaagatgaaaacaattttatataattaaaaggtcacaaccatgaaaatcaagtatattatgtataaactcagggtcatataagttgaaaacaagaagcacctattttatggttaaatatttaataatgtctccacctctgcctaacatgagaacaaaacaaattaacattatcttctttaggagaatgtggttcagtttatgtaaattgttaaatggtaaactgaggcacaatgacatgttaaaggcaactcgaaaccggaaatgggctggggactctgctgagggaacacaaaggcaaagctttttaataggatgaacacagaggcaaagcaaatatttgaggggttacagttatacagttaccttaccatgctgctggaaagtcccaacctgcggaagtataagttggtgacttctcattgatcagccttaagtttcatttttctttaatataagcatttacaagaaaaagctcaagttaagtttcacttatgtttgcaaatcaagcaaagttaaggtgacttatgaggcctgtcttagtcttctcacagattcttcaagtctccattttaatttattataacgaaagatatattaaatataaatgaatatctcatatggctaaattgcttttattatttaatacccatatttctcgataaatatcagatatatattttatatgggataggatgaaacatatccatgatgctttgtcccaagatccaaagacatgcctatcaaataggtaaatagcaaaaaggcaaattggtgattatactagagacaatatctgcattctaatgatctcatcaggaactaataataagacatggtgaactggataatacaaacaaatacacataggttaaacaaaatggaaaaacatccagaaacgattggaaaatcttggctacaaagtaggacatctcacaaaacatctagcattttaattggctatagatgcaaatcaacagcataacacagcttaccaaaaagtgaacacgaacaagttgtgttaatgaaatgagagtgtgtaaaggacaaacacgaatcttttcatgccctgattctgtcaggaaacctctagaatattcggttcaatgtctgaatcctcatttcaagtggtacattggtatctaaaaggcagagtatgtccatgatgggatttgcactgaaaatatgtcacagaggagagagagaaagaaagggaatagctgctgtgcctgaaaagaagctgaactaatgaaaacagggtagccgtccaagtcggactctatgcctgccttgatccccagctctcacaaacatgaagtgatcacacgcagcactcacagcctccagtgacctggcttcccccatcctctagccctgctcctctgctcccacttttactctatcttctagcattatggagccccttagattttcctcatatgctgctgtgtctccatgctattttgctactattcttccccttgaagtgcccttttacctctgcttttcttcttcatgggataaatcatcctcatgtttaagactcagctcaaacttatctactctagaaaacattttgtgaccccccttcgtccctattccacctctctgtcccatccaatgcccctcctctggaatcctgtagcatcttatacatatatatttttagcatatagtgaattaaaatgatctgtgtatgactgtcttccgtagctggtgaactgctaagcagagattctatctgatagtggctgtgaaaagacatctgatgaaatgggctcgatgttcctcatgctaaaaggtaaatgaacttccttaatcacaaatgtatatactaagtgcctactgagtgccaagcagtaaagctcagtgagctagacaataccagaaggaaagaaaaagtgaacaggaactcatttaaaaatgaaacaactttctaataaccatatttgtctaaagatggaaaagaatacctggtaataaagtatgttaaccatcattgatagtgcaaggagtactatataaaaatgatttcatgattgggaggctatattagatcgttaggtactttctaagatttcttccaatcctaacattctatagtctcaactacttattccccatttcaaaggtgaaggagatccattttcatctttaaatgacacatccatagccatgtagttctacatgtaattaaaaccaaagctattcaaagaaagcttttgctgcagagaagcaggatacagccagacacaaactgcaaaaatgtgagctagtacttagcacttcttctatctaattcccttaattaagaaagtaaaaggaattcccgggcagtccctgtgtaggtgtgtgtgtgtgcacagtgtgtgtgcatgcagggatgctgtgcatatctgtctaagtgggttatattatcagaaataactgaggagaagacactgaacccttacagtgtgcccttgcaccgtcaggaatcagtggccacactgcgggacaaataaaacaaatgaatgcattttgtactacatgacactaaattaaatgattgttagcatttaattacttgcaaggaaataggaataaaactggtcattgttcaaatgactcctgatcctgtgtctagacatgaaaagcaatagattttaaaatcctcagggacacagcaacatccaggtgctacgtgggcaacacagcagagtgccagtgggcacactctctgtacccagactccctgggtttgaaccaccctcagtaatccctagttatgtgtccctggcaaatttactcaatttcagcatgcctctgtttccatatctgtaaaatggatgtaatattacttatgtcatagaattgagagaggaggattaaatgagatcacccctgtaaagcactaagaacagaggtgtaacatggtaagtattcacaatattgccttctattattattattattattttattattttttttttgagacgaagtctcactctgtcactaggctagagtgcagtggtgtgatttcggctcagtgtaatctctgcctcccgtgttcaagcgattctcctgcctcaagcctccggagtagctgggactacaggcacgtgccaccacgtccagctaatttttgtatttttagtagagatggggtttcttcatgttggccaggatggtctcaatctcttgacctcgtgatctgcccatctcggcctctcaaagtgttgggattacaggtgtgaggcaccgtaccgggcctgccttctattattataccaggacgcattttcatactgagtggttctgcaactatcaatacaaagtaaaataatattactgactagaaaactaacagagtaggtatctttccgtattgcttttaattaccaaaaatgcccatatatgagatttaaaaaattcttccattcatttaaatgaattcttattaaaatttgtttgaagtgatattttaaaataatttttaagtaaatattaaataaaatgcataatttaagaaatacaaaaagactttatgaatagtcctaaaatctgatctactaccaaatatggccaaagaggataaagaaaattctagatgaaaaatacttccattaaatgtttaagttgaataaaggcaaggcctatgtcctcctcctcactttatcttggtaattggtgcccagaacttcaatatttaaaagaaaaataaatggataaatgtgcaattaatcaattctggttcatttcagcatatcctatggaagggcagttgccatcaaattcaataggtgctctttgtacatcatctttgtatttttttaatgtgttttttcttttagatagatttcagttacttcagaacattaaactacatgaatgagaagatatgatttataaacattttctctcaaaatgaatgactccctactcattaaaaataatttggttaatattggctcaactattatgataacgaaagcaaatagtctttctgaagtcaacatttctttaagcatcacatatgaagatattttcccacaacttctcataaatataaataagtcatatgtgctttgttaaattacgttctgtaggaccagggttggtgaggcaaaatcaattataaaatggaaaattcataaagtccatccaggagcttcctgtatttttaggaaaaggatgttgagatttcttggagccacagaaatccttgtatattgaactaaaaatagagagggaaagagaagatgtggaaagtgcatccatttgctctaaacattccaaggcaatcatttgcttttctcatctccatcctcttcctctaagccagcagatgtatgtgctagcttggctcccacactgaactcacattttgagatccacatccggtcagaggaacaaagttcaatgtcattgttctctggtaagtattgtgtaagattttctcttaatccttgatgatctgtcagtagctagattcctgcccttgcatcaataactacttcataagactcattcttcaccttcactgaccttcaactctacactctacctctgcctcacccttggttcccactctgcacttcctcccaggcagtctgccacctggcttctctaactcctgccttgagccaaatcccgacaggacttgttactttcacttgctcttttttcctcccattttagcagccaaggatgggaattacacagcgaaatgcaggctaatcagctaaatctagattaaatatgctagtccttggggaccttgagctgaattaatggaaaccgaggtttttaatgttccagactaattttggaagctcacttccagcagaggcaaacttgaggctgtccaaagggagcagatggcaaggctttctccaggtgcaccaacctttgaaacagccctcggcaaaaccatgaggaaggtaggaagattggaatctttgaatcttacctttgaatttccttttgtgcttttcacttgctttccagtgctcccctgcctagccaaaacatacccacctagaacttctcaggctccccttcctttctctgtgcatcagacaaaattctttctctcaaataatgacagatttccggtaaatcttaatcatattaatgtaatttttccttccttccttccttccttccttcctttcctccctccctcccatcctctcttcctcccttctttctctctttctttctttttgacggagtctccctctgtcacccaggctggagtgcagtggcacgatctcggctcactgcaagcttcacctcccaggttcacgccattctcctgcctcagcctctggaatagctgggactgcaggcgaccaccaccacacctggctaatttttttgtatttttagtagagaccgggtttcactgtgttagccatgatggtctcaacctcctgaccttgtgatcctcctgcctcggccccccaaagtgctgggattacaggtgtgagccactgcacccagccccttccttccttccttcctttcctttcctttttctttgtttcttctttttctttctttccttccttccttccctccccttccttccttccttcctttcctttcctttttctttgtttcttcttttgctttctttccttccttccttccctccctccccttccctccctccccttccctccctccctccctccctcccttccttccttccttccttccttccttccttccttccctcctctcttcagtgtctcactgttgctcaggctgcactgcaatggtgcactcatgtctcactgcagccttgacctccccggctcaactgatcttcctgcctccgccttctcagtagctgggaccacaggtgtgtgccatcatacctggctactttttttgttttttggagagatagggtttccctatgctgcccaggctggtcttgaactccttggctcaagcgatcctccctcctcagactccagaagtgctaggattacaggcatcacccaccatgcccaactattaatataattaacactgaatagttcagtatgaggaactctcttaagatattttgctcttatagtgtgtttattaatctcagtgatataatggaatttgaaatttgtaggatacacaaaagatcattttgaccatggagttacttttcatttagctgatttttcaaaataaattatattgaataaaactacccattagccaaccaacctccatcacttcttcttgcaggccctttataagtagctctacactccatccaactatacagccctcaagctgggaaagaatgtaaatttgagtttgccacagataaagcatgaatagattccactaatcacttgcttggatgataaaaatacaatgccacagactagagagcacagaaaatcactataatggcaatttgggcataaatgcttatcctaagaactggagaactcctagtgggctaaatcatttttgaaggcctcgctagatcaacggggagcacagagcataggtatcttcagagctgactggggaggacctttgcttctttatttgtctgttcacttttttctttatttccctgattagcaggcaacaagaggagatcaagaaagtaaaaataattatttcaattgctctttcatacttccagcaaatttctatctaaagacagcagacagcacaagtttctccaggtgcaccagttgctggaaagtcaaaactaaaagctcaatgatatttgggtaaatttcagatgattacatacatccatgtcttatgacaacaatgatcaaaaatcaactgcattctgggcaaacaagctgtctgtgatttttttaaaatgatttttgaaatcagcatatgggctatatgtataatttttagtaactcattagataacatttacaagcaaataaaagactccaagtgtaatctttatataaatttggcattttgatcaagtctgatatccatacactcatctcaggtgctgagtttactaatgtgctcacccacccactgatagctgccttagttgaacaactcttaccttactcttttgcaactatttgccttttctttttcttctgcctgactttttattaggtttgtgtattggtttgggacattttatgacaatagcttatcacaaacacaatatcctgatgagactgaagaccaatatttgtttctatcactgtaatgagtgtgtgtgtgtgtgtatctatctacctatctaatgagcctaatattacagtcaactgctgtcttaatactgtgattaatgctatgtcttacctgcccacctgtgcacctaatctttacaacttctaatttgtggcagagataaatggactatcaatgggaaactacaaagattacttgctattgctccttcccttgcagaaacattttgttgccctacaaattactttggttaaactctacagttacattgtctggttataaaatgcttaatgggaagtttctccccacctccatttgttttaacaaacacaagaattagaagatatgtgagtaatcataaaatctcatcttgcacccaaaggaaatattcctgtcagatggtatattacttatctacagctgcatacaaaattactccaaaacttagcaatttaaaacaacacacatttattatctcacccaatttgaggtttgggattgtgggagcagtttagttgggtggttctggctcaggatcgcacatgaggctgcagtgaagctgtcagctggggctgcagtcatctgacaactaggctgtggcacaaggatccacttctacaagctgttgacaagaggcttcacttcctcactgcgtaggtctctccacagggccactcacaacatggcagccggcttccctgagtgagtgatccatgggagtgagagagattgaccaaaatatacgatgcagtgccttttacaaccaaatcttggaagggacatactatcacttctgccatattctattggtcacatatcattactgaaattccggacaagatcacacaaaggtgtgaataccaaccaggagagggtggtgagcagaggccatcttggaggctggctgtcatagatgtttgttcagtttctgacaggatggttactacctcaggtggcagcctattccatctctgcacaattaaaactgttagaccagctcttctcagacaggccaaaatttaacttcattagagatgaggggaaagaaacaagtacaattcccttgatgttgatggcttatatattcttgtagttattggaatatgaacatttcaaattgactgctatttttggaaatttcaaaaaggaataaacagtattttttaataattttattctacagtgtagttaaatagaaagtatgccggggaagaaaaaaatagtgaataaaagagaaagggagattatgaatatagacagactggagtgaatacctatttgatgctgaaataggtattaggataatatttatcccacaactcttgccacaccggctgtaatttatctctcctctcttctctccttatagtaccagattaattttctattttctagttttaacagcagggtttgtgggttacagccattctaatatcttgtaactacaatttcatttatgtaatttgcagcaaaatatggcagaattgttaggtttctataagaattattttacatattaaatatagaaactattattttgggaagaaataattattgaacttgaaatactccataaatacatattcttacttcaaagataatagatttcatgtctgcttcttgcttgaaaacatataaaaaccaatggactaaaatcaatgtatttaataacttttacatcggtccagtaccaattttaagaaattacacaatacagagatcagtaaagaataagatccaccatataaataataataattttgaagagttcttttattcagtattgtgttatatataatgtttttcttgcttagctattagcagttttttggacataatttgaacaaagccaaaatgtaaatgtcagattgatggattattaaaaattggcaaatcagagtagtcccagttaatattaactcttataatatcaagaaatcccttttaaaggattaaataaatccattgctacttactgaatttctcccatattgcagtaagatatagtaaatgtatccaacaaacgccagcctgatctttccatatatctacttaattttcatgtaatattgactacaatgttgactccctgaaagtataaataatttctctttggaaaactatcacaataccattcatattctaatattcatattattttatatatacatatatatatatatatatatatttttttttttctttttgagacggagtcttgctctgtcgcccaggctggagtgcagtggcgcgatctcagctcactgcaagctctgcctgccgggctcacgccattctcctgcctcagcctcccgagtagctgggactacaggagcccaccaccatgcgcggctaatttttgtgtatttttagtagagacggggtttcaccgtgttagccaggatggtctcgatctcctgaccttgtgatccacccgccttggcctcccaaagtgctggcattacaggcgtgagccaccgcgcccggccatattctattattattttattttcaccgagaaataaaagccatttgaaagggccattgacatagtctataattaatgttacagctataaagttaaaatggccaatgataagtctagttattaaacatcacagacattctaccaatgcatacatttatctagaaaatgctagggctgactatgagtactagggggagaatttcttgagttctgactaattttgtcctgaacttatgtctgttttaaattctgtttgtaaagtcttctttctaggttccctttacaaaggccttttctactgcagcttgtttcactttagcatgctaatgattgaaatagaaatttatgctattcacaataggatccttcacatgttacagtagcatagtttaaatgttcagaagctctgtgttaaaatttagtttttgacaaaatggctcaagttcctcttattaaagaaccggatctctctcattctctgagaaagtccctttgtagatgagatgcactactgcactgtgtcatcactaatacagggtggtttcattcgcacttggcacctctcaggtaggttgttttgcaatggctttatttcattttcccctcttattaccctgcagcttatttaacagaaagtgcaaagccaagcctcactttgttcttcctctggggacaacctactcttaggcagcaacatttctccttccagctcactgtgtcaatgtctctcccactagctcaaatggcatcatttgggaggcgtataaaacatttggtgtaggacagatgatttgttactttaaaacttgagtaagtaacttttcacgagaataattaatttagtgataacataatatttttccaaaatatttcacattgatggtttcatcacacaaaactaataatttttaatgtttggaatatatttttctgaagaggaggctttattgaaaataaagaacacttacaagaaaataaagaacacttacactgtcccatccctctccttccctccaaatataccttccaaagcctctgacaagcattctatggctattactagtaggttcaattttaatttagtaatcaggtgattttataagcttactttccaaaagtaaagttccaagaacaaccttttatagaactgcagtcatgcatttagtgtgggcatttctgagatgctgtttgcagatgttgacttataccttaagtcgttttcatggtgaatgagattccttaatcactatgtccttttattgtttgatcctatcactagaacattttatgaagtaacaattttcatcagaaaatttttctttcccttgtggattattttccaaagcttagaaacataattttaaaggcaggtttccatcctgactcatattccagaagacacagaagccagctgattcacaatcccctctataaagggggagtattcttgacttagaaagtggttgacagctttctccaagctggtttcacactagaatcatttggggaagttttacaaagaactcaagctcagatccaatcccgagaggtcctgatttaattggtctgtggtgagtaggccccaggaccaatatttttgaagctccctcccgaagtacttctaatgattgttaatcattaacctccaacctctagttggaacatttacaaatactttaccatgttgttcttgcttttcatgatactacctaatttcacatatatgaagtgagagcaagtaaggcaatcttagagaaacatatcatttgcctggtatcctttgggaatgattattatgaatgaaagaatactgcaaataagaaaaatttggcctaccaatggtgaatattaaatatttaaccaaatttgttgggaatttttctaataaatattatgtaagtctataccttgaagaaaatatactaaacattatttaatcttttcttgatggttcaatattatcattgtagacacctgtagttgtattagcttgtctttgtaatatttctactcctccacttaatggtatcagagttgtgaaagtttttggaggtggtgattcttatcatgcctcagtctcaattattacttcttagtgattttaacccacctatttccctttgcttttgacctttctgcttcaaatataatgatgtaaatattgattatgctgaaatgacttaatatattttgagaagaccttaaagcttgagggaacaggtaatcatgctcattaaatcaagtaccctttttgatgcacacaattcatgtttagtaggctctgtggtgagaacacaggaatggctcttctgcaagagaaagcacttgaagactgagaccaagtttcctccttgcaattctttatccatttttttctttcatgactgtattcagatattttaatattttaggcttatgatctgtgcagtgtattccaactttatgaagttaggctaatattaaggtagaagagtatgaatagtattaaatggtgtattgcgtaagaaatatatatttatctcacttcttagaactgcgtaattctttgtctacttctgtcattaaaattgcttctgaagaactgtcatctacaaacttatataagatttcctcatctgcagcttttttgaagaatgcatcaaaaagttacagtataaggtgtgatgtgaattcagtttattttacctttttttgttctttgggttaaagccaggagagatttttaagtatgaaatatatatgtaatattagatgaatatattatctcactaaatagtatccctgagctaaaactccctgtcaaccatgcagagcaacatagcagccatgtgatggcatttcagttacaaaatactggaaaatgttaaacttgtcaaataataatccgacttagtcccttagcccccaggctgagtaattccaggctattttctctgccatcagcaggccaccatgagatcagactgttttgcagcaccatatgaagtaaaaagccagagacacagattcaacatatataaaaggatttcctattgccctaactcttctacgggaaagcgttttatagtggcctacattgtatgccctcaaaatatatgttcaagtgctaacccttgaaacctgtgaatgtgaccttgtttggaaatgggttctttgcagacataattagttataacgagatcacactggttcagggtggcccctacatccaacgacaggtatccttacaagaagaggagaggtcacacagagaaaaccttgtgaaggcagaggtggagactgcagctacaagccaaggcatgaacagtaaggattgctgggagccatgagaagctaggatgcatcaaggagggattctcatcaagggccttcagagagaggaaggtcctgccagcaccttgactttgaacttctagcctctagaactgtaagaggataaatttctgttgctttaccacctctccacaccctatttgtggtaatttgttactgcagcctccaggaaactaatacagcattgaaacaaaaactttccattatagcaaatttgagtgtggagaaggaaagcaatcatttgttaacctctcaccatgttgagaaatagcctgatctcttaaaccctccatgcaccctgcctctcccgctcttgcttccccagcatacatgggtctcctcttggtacttgctctccttttcctggtcttggctgaaccaagaaatccctcacatactttacccagcaccaccaggtattactgatgatgttccatggcacagcattacaaccattctgtgaatgttgtttttacagaatgaaagcaacactgtcacctaggctggagtgcagtggtgagatcatagttcagtgtaacttcaaactcccgggctcaagcaatcctctcacctcagcctcctgagtggctatgactacaggtggacgccaaaatgcctggctaattttttgtggaaatggggtctcaccctgttacccaggctggttttaaattcctgggctcaagcagttctcccaattcagcctcccagatagctgggattacaggcgtgagccactgtgcccctccttaagttaatttttacatatggtgagaaatgggagtccaacgtcatccactttgttggtgtgtaattgttcatagtattttcttacaatgcttttttaatttttgtaaaatcactggtaacattcctacttttacttctgattttagtaatttgtcttctctcttttttttcttgatcatcagtctagctaaaggcttgtcaattttttttatctttctgaacaaccagcttttagtttcattgatttttactataatttttgttgttttaaatttcactaatttctgctcaaatctttattatttgttttcttctctctcatttaggtttagtttgctttttttttttcctccgtcttaaggtggaaggttaggttatttatttaactcttcttttttcacaaaagcccttacggttataactttccctctaagtaacactttatctgcattccataagtcttactatgcttccttcattttcagtcatctcaaagtgtttttggatttcttttttaatttcttctttgacccgctggttatttaagagtgtgtcatataatttccacatatttgtgagtttccccaattttttcctgctattgatttctaatttcattccattttggtcagaaaatgtactttgtattatttcttttcttttaaagttgttgaggtttgctttatggactagtatatggtccattctggaaaacagtcctcttccctctcactttggacagtcgagaatttactcaatatctttaattctaacttaaaatagaaataatatatagccaattcttcactggaatctgactcacattagagagctttgatattataatcaggctatgtttactcaaatgtcaatacaggtagataggcactacacatccatgcaggcctccttcatttaaatcattgcagaaacttgcacttgtaatttaatagcatcataattctgacagctataattgagaaaaccacaacaattgagtatttgaaaaccccgcttttagtagataagaagtagaaatgatgtttattttgtcataaatgaacacactaaaccatttaaataactgcataagtaatatttgactggacttattatagagtagtgagagacaaaaccagtcctgaccatgaatgttctaagaaaaaatagactccactgatcattaatgggaacaaattggtaagatgctactaaataatatttttgaaatttaagaaataatctttcaaagaatttatcaaaatgggactgacttctaatttgggaaattggtgaattaatatgggaatatataataatcatacatctatctgctagcaaattgtaatcagcattataaactgtacttactagtaatgagagagtatcaaaatgcatttaaaaatcatatacttttcattatttccattaaggtgtctggtccccatgatgtctctaatgactttgaccagtaccgtcccatttgctcactccactccagccacactggctacttgctattctaggagctctcccatcttttcactgagtgctctctctcacaggaatgctcttcccttagagatcctcgtggtgaattccctcatttccttcaagtctgctcaaatgttacttctcaaacaggtatgcatgtatttaaaatcctatttgaaattcaacctgcctccatgtttctcccactgttggcaatcttgatcctcttactctaatataagtttttctatgttgaataacatttatcattttctaacaccctccataatttacttgtttattatgtatatgttttggtccttctccccatgctagaatgtaaatcctaacaaagcaaggattttagctgtttttttttttctctcgctagaatatcataaatgcccaaaactgagcatggctcattcttgcaagaaatacttattgggcacttactaaatgctaactattgtgctagtcatactattagacgatgtgttaaaatttatgtgttcactgctctcatggagtttatttctgagtggcagagatggaggctaattaataatcatatacaataaaatataaagttgagatacatatttattctgaagaaataaagtcttatgaaaatataacaaagaaaatatatccagaagtgagttcattgattagaaaagcctttgctcaaatatcagaaagttattcttgaactgagatatgaactacaagcaggagtttacaagggaaagagaacatgcaaatattctgtggctaggaggagcagaaaaaagagagaggactatatggggtagcaggagggtatgagggttcagccggaaaagaccttatgggctgaatgatagttttgtctattgtccaagaaaaatgggaaaccactgatgtgtctcttttttggcggggggtgggagggggcttgattttttttttttttttaatgcagggcaggagacagggggaggcataagaaataggatcataattatgttttgatgagctgactttgactttggctatagtgtggagaattgtaatgagctctgattattcaggatctttttagaatttctgtttatagatggaggttaaaataagttaaacaaggctgggcacgttggcttatccctgtaaccccagcactttgggaggctgaggcaggcggatcactcgaggtcaggagctcaagaccagcctggccaacgtggtgaaaccctgtctctactaaaaatacgaaaattagccgggtgtggtggcatgcacctgtaatcccagctacttgggaggctgaggtgggagactcactttaacccaggaggtagaagttgcagtgagctaagatctcgccactgcactccagcctggatgacagagcaagacaccagcttgaaaaaaaaaaaataaacaaatatattttctcataggagtatttcatggtaaaagtaaaatgtcttacagtataattctaccaataggtaattttcaaagtctattttttatgcataaggtcagagaaactcaagaaattaatatctggtactctaaattttgtgtgattcttaagtgaagtttaaataagaaatacagatttctgtgtctgactagagttgtatcagtaagtataaatagaaacagtaatgcatatgtaagattttaaaaaagtgtatcttaaattatttgttaaatatgcatacatattggttccagcctcattacacatttcatttgcttgctagactttaatgaatatattttctaacccataaataaatttgtgtagtaacttagctcatgctgatttttaaaaagaagaaaaagtttaaataaaatctcatcaccaaaacagtgggaggcttttttccctgctagtataatggcatttgatgattttcctgtgtatacacgtgatatagacgactgtgagaaataggcgtgttccaactgaggactgtgtgcaaaggatgcccttgtgatctaataatgctgcaaatttctgtcagaaatagccttgatgaatacatggaattgcataatgttacttaacctaaaacttgcttaaagaattcttgaatttttatttaaaatccagtttcacaaatggagaatgtgtgtgtgtgtgtaagcttatttgcactgtttcactgtaatacgcattctgataatttaaggatgtcatggttactttgaacccaaggcttgttagcattctgaaagtaagaatagtttctgtgggttttctgtggggtaagatatatgtcataggttccgtgaaggatgtctgtgagattaggaaccatagaatgttgtgggtttatttatttattttttattttaaaaggaaactttaaagttccctttaatattcctttgtataaaacccattatgaaattgcacttgttctaattctcttttttcggttatttagtgcaaattatttttggtggattgttatcccacattactgcagccgagacagtttccagagatactactgtgatagaactcagcaggggtagcacaaacctatctcccactgtcactttatgtattttggctgtctgaatttttgtttgtccacatatcggtaatattgcattaaattttattcttcatggaatttcagcccttggaaatacaatgtctgctccactctaaaagccttttctcccaccttgttatcctaaaaacctactgttgagcagtcctttacttaggaacctgaaaagtgggaaagagattgcatttttttttttcttagaccattggacgtgttcaaattgatttagaagagaaaagctacttacctttggctcttttttattatttttattgttgttgttttgtatttggtaacaatacttttgttacaaatctatagttttttaaatacagcatgttatgtgagttaaatatgtatacaaaaaggctatggggctgatttttgcatttatatagtacttcttttctcagagtgataaactaaatgagtattatggtcttttatttttaaaggaagtttgcttacatctgccttttattttattttacttatttgtataatttaagaggtacaagtgcaatgttgttacatggatacattgagcaatggtacagtctgggcttctagagaaccatcacttaactagtgtacattgtacccactaaataatttctcagccctcagccctcccactctcctactcttcccagtctccagtgattattagttcacactctatgtccatgtgtacacattagctcccacttttaagtgagatcaggcagtatctgactttctgtttctgagttgtttcacttaagataatgatctccagtttcatccatgttgctgcaaagaacatgatttcattgttttttatggttggatagtattccatggtgtgtgtgtatgtgtatgtgtgtgtgtgggtgtgtatataacattttcatatatatatgtgcatgtgtgtgtgtatatacatatatatgaaaatgttatacacacacacacacatattttatctaatcatctgttgatggacacttagactgataccgtatctttgctactgtgaacactgcagcaataaacataggaatataggtatctttgtgatataatgatttcctttgggtagatacccattagtgggattgctggatctatttttaagcaaacaagaaaaaaccttaaaatacctcttcctctacaaagcaaataaaaaatattcctgaccttggaggcagttgtgaacactagtggaatgtgtctattttctggctgagagaagcaaaaatcatgctggaagcagccttctgcaaaggcaatggttacatgggcaatagttacatgcagaacaagcgctggactggaagtggcagacctggggttcaattcttactatttcttagtagctgtataactctaggtcactttaactttctgtgtttcttctaacatgaaacagggataataacacttcacttcacttagcaacatacaggaaagtgcattctaaaatagaaatccttaaacatccaaataattttttttaccattagattaagaagaagcactgatatctattaatttttatttggctaatatctcttgccttgggcattttagatacaccaagtaatatgtttttgcagtgatttcaaaggattgtgagtatttaggttaaagtaaagtaataaagctcctgcttctttgagaaaaaccacatgggctttaaaaaataaaccgttgactgaatcttggtgctggtggggaagtgcctgatgtgtaagattcaaagctgtaggtaaaacaagtgatctgttttccctctagctcaacaaacacctgcgtgcctatatgtccaattacaacagtgatttaaatgtgtctaacgtattgaatattagtaagataactctaaataatttgctatttttcttaactaaagtaaacatttattgtaaagcatataaactcttttatatcaaatttactaacagaaatcatttcttcaattatttgaagaatgataaaacttaagcatatcatctcaatgttttagttttcattaattatatatgttgcattaaccatgccaactaattttattgatgttatttcatcttactatcctaaacactgaagtatactcatggctgtttttgaaccaaaaatctgatttattcgttaaacagtcattaaatcatagtgtacccaatttattttcaatttataatgaataaaaacaagctgtcatcttaagctattttcttgcagtattactaacatttttctgacatttactttttttcattgattttgttaaatatgacatactggctgttggttgctatttagcttcaacatgaacttcacatttctgacattcgataaaatcttaatatctgtataagttgattaaaaaaatgtaagcatgtatagtcctgccaaccctttaaagggccaattaatcatgatataattttaataaatctacccaccctggcaattattaatttattcatatatttaacaaatatttattggaaacaatcttgccaggaactgttcttagtgtctgggatacatggatgaacataacaaataaaataatccctgtcttcatggtcttacttaaaacaaatgaagaaactgaagcacagagtgaataaattactgaccaaaagcccacaactagtatagtgctgagtatttactccctgacttcatatcacaatatatccagttaatggtagagaggtgcttaaaatgcatgtctgtcaactcccagactagggatattcccacagttccacactgtccctctttctcttcctaccacaccacctcacacttgtttgtaatgatttctgaacagtaatttaacaattgctgcaattagacttttctacagtctgataaaaacaatatgatttttaccatttgcagtgatgatttcccttttggttcctttctagggaggaggctccatgatcttaccttcccaattatgaagtaagcaacgatgacctcttaaactcgtgaatctaacagtggttgggcatagataattgctgtgaaatacttgatgactgattagctttgataaagaattctgagataatttttatgctgttgttactaatcccaccctcagcattctttcaaaaatgagattatttgtctttttcttcatggccttggtggaaatataaatttctttttaaccctaaaattgtcttggacttataacttgagatatcctatgagaaacagattaattatgcctgctaattttggaacaaactatcagcctaataatgtctttctagttccatcttccatcatttgaaattccagtaaagtaatacttgttgagtactaacatttatatgtattttacgtcaatgatctgaacgtagctgcttttgggatatgtttgagaaaagttggagaaatgttacagcctaaagttgtattttgtttgttgtttgttttcaagtttcttaaaatgtggggccgggcgcagtggctcatgcctgtaatcctaacactttgggagactgaggtggttggatcacctgaggaaaggagttcgcaatcagcctggccaacatgatgaaactccgtctgtactaaaaaaatacaaaaacttagctgggcatggtggtgggagtctgtaatctcagctactcgggaggctgaggcaggagaattgcctaaacccaggaggcagaggttgcagtgaacggagattgcgctactgcactgcaacctgggaaacgagagcgaaactccatctcaaaaaaatgtggtccatctagaaaatttgcactgatattggttatgtctgcaataattcgctttcatttctttgcagcagttgttttctattgtttcccacaacaccaagtgaagagaatatagccacttttctgtagggtcaaaaaatattcaggctttccctcaaaaatacaaagttaagctcatttcttaatttccttcaggggttgtataaacagtcacttatagacacacacatgcacagagacacatacacatataaaatgcataagatgtacacatattataaatatttatacctatatacttcctatgtttataattctgtgtatcaaagaagagactttctgtgtgaaacatctataatgtaagaagggtagtctataatgaattctaaatgcattccactttgttacaagtacttataactttaagaaatattttaaaatgtttaataatcaatgtgatcaatattcccaattgttatcaatgtctatgataatgttttcattaaaagagtcaaaatgggctgggtgaaggggctcacgcctgtaatcccagcactttgggaggccgaggcgggcggatcacgaggtcaggagatcgagatcatcctggctaacacggtgaaactccgtctctactaaaaatacaaaaaattagccaggcatggtggtgggcgcctgtagtctcagctactcgggagactgaggcaggagaatggcatgaacctgggaggcggagcttgcagtgagccgagatcgtgccactgcattccaacctgggcaacaaagcgagactctgtctcaaaaaaaaaaaaaaaaagagtaaaaatgatagaattttctgctgttaaaacaaaatgatttgtgaacaaagctggtacagataaggtgctggataataacacatattataatacataagtcccttatagaaacaaaatagtaagtatgtacaaagccataaattaatcttaaataaacatcaatttccattccaatgcaagtaatacatctgatgtatgtttagcactgacaacatttcagtaaataatgaaatgctttagatctgaaaagaagagtttgccatagaagcattaacaaatttttatatctgttgacaaaaccttgctaaatttatgcacataaaaaaatagaagtaaccttttctgtgatcacataactgggggctggcattgcgagagaagagcctgctttaccagttacgacacagcagcatgcctctgacttaaagttcagtttttaaaaatatggatatgatcatagcaaataattccaggaaatatgtcataaattagcagacactgtaataaactgtctggactgttttgtctcagtcatgtcattttatcctatttagtttcaaaaatagtaatcagtctgttcaaagtgtcaactttagccactcaggatggggaaaacttgttttgacattatgccgtatgaaaaatgacaaaatgaatgggacaggctataagaagtagattgcaggctcaatattagtctactgtgtgcatgtctgtcaaaagaagctaataaaacataaggctgaagaactgaagtaatgaatgcaacaaagaatgtaataatcccattgttctctatgcaaatcggaccctatctgatatgtaatgctgatttctgagagtcacttttaaaaagaaacattgatgagttaaagtgctttcagaataaatactcccgaaagtttgtactaggaatgataaagaaatggaagacatttcttaagtaacatgggagagttagagaaatatttgtctttgaatattttaggcaatattatgtagcaaaaggattagatttattttgatttcctgaactagttagtacaaacacaaacatatactagttaccaccaatgggtaaagggccctgtaagatatacatatatatataaataaaaacaataactgacagggattgccaactctagtgaaaataatttctttacttttcactccacacacccttttcttcaagaaaccttgtgtacaacttataaagggagagtgcgaaaagtttcctcatcaatagagtttataaagaaagttttaaagggatcaaatagtttgggataaagaccttttcttgagaatactaaacatgctaatgaagataaaattcatagacagattttgccaagaagttatccatgtacttgcacaaaagttttattcaatatagttaacaagtaattagaaaagcactcttttttataaaactatgtaaaactgtaacttcaaacaacatacagctatatccaaactggcgaatgaatatgcttttgtctcatccaagaaatccaaggctcagtcctgacagtcaaacagggttaaataaaagacaagggcttgcaggcaggaacaaacagatgattctttccccaaaggaaacacacgtaagagcattaaatatcaagtgtgcctgcccggcatggtgtgtgtctgtagttcctggtactgaggaggtggaggggggaggatggcttaaccccaggagtctgaggctcaagcaatgcactatgattataggtgcactatgatccacctgtgagtagccactgcactccagcctgggcaacactgctaaactctgcctctactgaaaaaaaaaaaaaaaatcaagtgtggccctccaagcagggagaagcctttcagcagcagaggtataatgtcggctcttccttgaggtaaacaggcccagaaagtacaagccgaacacaggcagggtgggaaggtggaatgggaagacacagaagaaacaaaatacaatagagggaagggaaaccagttaatgcatcaaacgctttatcccatcaaaggcctatgaacaaggagctcttgagttcgagtaccaaggctaaaatggagtgtcaaagagcctgtgaggagacagttgtggtttctagttttagaaggtgtgtcacgggcaccactgtggcctttgatgtatggtagtagcagaattattacaggtgatgctgaagctggtactcctaagtttcacatacttagtcactaggaactgatgtcccacacacaggatcagctagtttgctcggctttcactatgttacaactaaggaggtggggtcagacccatggccttctggagtgccgccttcacaggtctcaggtgacaagctataggaagtggactgcaggctcaattggtctattgtatgcatggctatcaaaagaagctaataaaatattaggctgaagaactgaggtaatgaaggcaccaaggagagtaatagtcccattgtactctatgcaaattggaccctatctgatgtacaatgctgatttctgagagtcacttttcaaaagaaatattgatgagttaaagtgctttcgcaataaagcaaatgctcctgaaagcttgcactaggaaagataaagggaggatgttatttactttttgtaaaactatttttttttacaaaaataatgataaagtaataatttctactttttgtaaagccattatttttgccagagttggcaatccctatatatcctgttcatcatttggatatcagggacccaggcctataggtggaagatctggttgctaaaaagtagaatgaagggaaatcttattaatgctttttatgcaagtacacccagagaaaagttcactacaattattacaaaactgaagctaaaaggggaatggaaaactctcatgcccagagatatctttctatctagaatcccaaaatgagactcaaggagaaatgaactagttaaaaacaagtatctaaagtaagaagaggggcagaaaatggagctgaaaagaaaacaggatgttgtcagagtgcaaggaaaagaaaatttacctgaggagaatgttcaagaacatatagggcagatcagacagatttttaagggaaaagaaattatggatcttgataaaagaaaaacttcagccaaattcaatttaaagaagtttaattgagcaatgaacgactcatgaatcagacagtccccagaatcacagcagattcacagactccagggcagccacatagtggaagaagattatagacaaagggaaatgacatacagaaatcggcagtgaggtacagaaatagctggattggttacaggttgacgtttgccttatttgaacacagtttgaacacttagcagtccatgagtggttgaaacatggctactgggattggtcaagactgagctattgctacaggtgcaaactcctaagtcaggttttcaatcttgtcttgtctacctgttaacccaggttacagttcatccacaaggactcaaatatagaagtacagagtttttctcaggccatatttagtttgctttaataacctcctgatgacttttaaagtagcctggtcccggactgatagtaaaattaccccactcagagagagagaggaatgtggacaaaatttatttgaaaaacaaagtgtcactccggcaaactcagaacacaacagcttatgtctcttcctcagggacactgtcaaaggactgactctgggcaaaagtgttcacagatacaatgttgggatccagaagccaaaaaggaaggatgaagaaatgactgtgagcaaaacagtattatatggtagaggagagatgggccaaattaagcagcaggtaataaaatcaatcaaacaaacatgaaaccaaccaagcaaatccagctgagcctatttgaaaggaaacaacaccagaggcagacccctcactacaaggaaaactattccaaacaggaccgttctctgagcctagaatgttcaagatttggggtccctcagggcacaagcagtgaaaagcatcaacacatgactcatttcaagcacggaggatgacgctaatgctgagggtctgggaggaagccacccccaggacacaggacttttaggactccagaatttcagagcagaaggagtacagcagccgtttagcacaggattaaaagcgtcagagggtcttgctggggatggggaaatacagagagaagagcagagtttgggaatgacccttcagtcactcatttcagaaatatttagtgagagtcaggcagtgttcatgatggaactagttagtactgattgccaaggaacaagagaggcagaaacctctgccttatcaggactcacattctcaggaaggttacagaaaataagcaagacaaatgagggaaataattttgttagggaggatcttaaaagaaaaaagataaatagacaagaatatgaagtattggggttgagggctgaaatacagtggccagggaaagagaggactttttaacgataattgggggagtgaaccacatggatatttgggaatctatccccttcagactcaagagcaggacaaatttgaggccatgaagaggtgcctgttaaaagagcgggtacctctgcacctctgctattgctttaagaaaagcatgtcatgggtggctcattagtccatggagaatgaaaagcatatatagtagatctgatcacagctggtagtttggaaccaagccaagccgagaccagtctggtatagccagagcttagtcaacatataaacgtaagtctgagaataaatgatttgttatcaaaagcacaatgagataccatctcacatcagttaaaaagtcaggaaacaacagatgctggagaggatgtggagaaataggaacgcttttgtgtggtgattcctcaaggatctagaaccagaaataccatttgacccagcaatcccattactgagtatatacccaaaagattataaatcattctactataaagacacattcacacatatgtttattgcagcactatttacaatagcaaagacttggaaccaacccaaatgcccatcaatggataaaatgtggcacacatacaccatggaatactatgcagccataaaaaagaatgagttcatgtcctttgcagggacgtggatgaagctggaaaccatcattctcggcaaagtaaaacaggaacagaaaacgaaacaccacatgttctcactcataagtgggagttgaacaatgagaacagggaggggaagatcacataccagggcctgtcatggggtggagggcaaggggagggatagcattaggacaaatacctaatgcatgtggggcttaaaacctaggtgatgggttgatggatgcagcaaaccaccatggcacatgtatacctatgtaacaaacctgtacattctgcacatgtatcccagaacttaaagtataataataagaaaaattttaaaaaataaaataataaataattttaaaaagaaaaaaaaagagcgggtaccctgctaacaaaggcagaggagactgcctcagtatacatgtcaccttggggtactgagaagagagtgaacattttacaggcttgtgttaagaattaaggcaaagacagaaactgagtcaggtcaggagaataaaggtggcagcttgacaaattttttattattatactttaagttttagggtacatgtgcacattgtgcaggttagttacatatgtatacatgtgccatgctggtgcactgcacccactaactcgtcatctagcattaggtatatctcccaatgctatcttttgcaataaggcagatgaggtttcatttccactccacaagaaagtagcactaggcattggggattttctctaaggatatgggaggcatagtgtcacaattaatgttttaatggaaaaattctcccaaaggagtttcaattaacaagtcacagactccagaaacttggaaaggactgacgagtaccatgcaaaagccagaagcaagagaattttagcttttcctttatggctgttatatgttcgtttcttcaaagaactcaaaagctctacctggttccatgattgttatctgaagggcagctccagttaaaaatatgtattaattcaaatgtacatcagttttcctggatgactgctctaggccctgaggatttgcttgtgtttttgcaatttcatgggtgggtctggctgtgccatgttttcatgtgttgcacagctctcgcagggggaaaaaaggagaaagagggagacacttgaatgttttaggagttagaatcatttcaacgtggggcacactagaagacagcttaaaatcaatccgcttgctgctcggctcatcatctgcctccgactaagtggaaaaataaattgggagggcagaattttagtctttggtgtaattgggatttgattcgcataacaggttttcatttttaactttaatttctttgggggagataaaatgatgctagagggaggtctgtcttctaatctggggagttggatgtagaggctgggtattttggcctctgttctgtcatgtggcgcccattgtaaaacgtctcctgtcttactctattgtgtgaagtgtctggacaaatatgaaaatgaaaacggaataacagataaatcttcagcccagggcaggagtgttgttggagatgactgaaatactgccctgttctgacctatttcagagccttctgagggcaagctgctcactctcctaggaacaaagaaggactggctgaatgaagatggggccagatttttcttatgtgccattgttctttcttgtgtgtttgtctagggtggaagggagggttatggcagcattctgcgaagggtgaatcattctctacctacgtttgcagcagtaaccaggaagatgcatggaaaagtaagtgacagaatggaaaagcttgtgtggccagagatgagcatgtgttgggcagttttctattttctgaagaatgacaggagttatttgaaatcagaaaaataaaacatgatgaaagtgctgctgaaaatatggtcaaaatcacagattgttccatgaattctgactgtgtcaactcttccaacatccatgtgaatacccaaagtagccaaatttgattccgtaactgttaaaatgttcttcatggagattttcaatggaggtggtaggagggtagtaggagtggaggtatttccttcaacagattttaaaagaaagaaaactttttttcatgaaaaattaaacaaaaacttaattagaaagcaaaatgaggaaatgagtaaacctaattttaatgtttaaattttaaatttttaaggtggcaatgcatctgtcctagaattatgggtttaaatccctcttagtcattcctgaacttagaaacaattgtacttattttgaaacctagcttttgcataattataagagctctgtacagtaaatggtataaatcatttatgcacccaattacaacattcatgtattaagagaatttttctgtctcctttcaatttttatctttgagactcttcatcttttgaaaagcatattctggttttcttagtttgttcttatgtaacattctatgtaaaaaaggaaataatggcagaagttattttatagaagtgctactacatctggtaaattttgtatatttcatttcccctgcaagcttttcaaacacagtagcttgaactgctgttagaaatttactgtctctgtgcttgtcaccaggaagatgaatgtgaccatttcacatcttgcaaaaaatactttttatttgttagcatttatatactaggtattatgcatacggtttcaaaatcaatagaaaaagaatacgcatcaggagaaatacttagattatcaaaaacaactcaagtgagaatgcattctgcaggtgcaatttaaagaatatgggtgtaaaacagagaatggaacattctataaaactaatgttagttgagataatctgtaaaatctaactatcagcccttctttctcggttaccaggagacaatagctgtgtacacatatgtggcgatgaaaggtaacgtggactccacatggcaaggcaggcaactgctcttaagtgcacagatagaaggttcacggtcactgtcggggagaagttcagtctgtctcgagtcatcttttagaattcatcaaagacggacagtctagaactattttcagtttcccaatggtgaagatttaaattgttgattaaagtccaataacagtaaaacaagaaaaggccatatgcttgagctgtcaatgattactcagattttttggggttacagtttaaagtattttgatttaatatcaagttatgagtattgaaaagggagggaaaatgaaaattttctaaaaaacgtgaaaagaaaaaccaaacccacatgtggtctatctttttcacgctttcaatctgtaatgaacttctggccaccttgatgtgaagtgccctgtacggagtgctcagcgtgttttgatagttcttatttgtgtgaataagaaaatgagcatttgataacacaaactgaaatgcagttgaatattattaatctttttaaaaaacaaaagcatagtaaggggaggaataggaagaccttagaatctaggtttcattttcatacaaatatttcctgttagctcaaaatggtagatgttgaaaatagaaggaatctaattggaatatttatattatgggtgatggtatttatgatgacatctgggcttcctggtcttggcgcagttcaggcagataatataaatggaaactgtaatacagactgagtagatgtcaagactcattagaaaatgagtggaaggactttgtacaaataagtacagggctactggcatttctttggttttgtccagagaggggtaaccctgcgtcatcatggctcttcctgcttggttttatggtgttatgtatataggtgtggcctttatcacaaaacactattaaatattcattaagcatattgtttatagaactttccacaacaagacagtccagtgaaagctatctttcaaaattccaattgttaccaggtatgtcatgtatacatatatggcagtttcttaaataataaattttggattattttatacatacatacatacatacacacatttggattattttatacatacacacatatatttttaatatcatcagtaggtctcatttatgacaataaagtaggtacagttgtagctaccatgagaaataagatgctatataatactttatgtctcactattaatttatattgtgtttattgttaaaatttcagctggcaaaggaagcctatggtctactaaggtgccaatcctatacacacttataaatttaatgaatattgataatcataaatgtgagaaatagtacgaagcatcgatcttgaaggaagagcactagaaaagaaaaaatgtttgaattgcataaaaacaaagttagaaagggaaacggttttgtcaaatctgcctatagactagaagttgcaaatttgggttctacattagaattctctggggtactgttgacatttgttagattctcacatacacaccgtgaatcagtagatgcccaataactattttaactagaaatccagcaatctacagaaatcactgctagatgactttcatttaaaacattacaaatagatatttccaatctgtattctgccattaatgaactcaattgttcaaaattgaatagcataagcaatatggaattgccctaattaggcagcattagcaaccataaaaatggtccagagtaataaaaaatgaatctgtttacaaaaaaattccactttatcattgtttaatttttaaaataagcaaaatatagctatttttggaaaacagagataaaaacaaaaagcagatagaatcagccataatcaaaatgtcccatggttgccacagctaccaagtttttttttcatttgaaaatatgtatattttaaagtcagatcaccagattgtattttagcaaattttttatgtagtaaaatatgagcatttcctatgttgttggataatctcttacaacatcacattttaaaatttatctttgctcatattataatatactttactaatttttattatttcagaaattagaagaaaattatctattacaaagattgctctttaattatgtctttgaaataaataatttctacatctttaaagcaatatatttccaggaatgtggcttgaaggttaaatacatacacatacaaactaaaaattcttgcaactaaatattaggccagatagaatttcaagggtagtcttttctctcccctgggaaatagaaatcagacaggagaaacaagttagaaagttggtaagaaatgtgtgacatgggaccaaacaacttatcaaagaagctgaatacaaaatcagtatgtgattgatacctagcagatccctgtcccaatcttcctaggaactgccaacaacatgagtgagcagagaagatccattatagttctcttgaggatttctttataggtgataactttgaaaggttgacatttacttacctatttagctaaggctgtgattacaatacgcacagtgttccaaagaacacaaggaaacggagatgaaatcagtggaagttcaaggagctgtttaaggacaaaggtgattatgattctatgtctggaaatgaccacagaaatgtctaccttctctcatagagcaagaagatcgaagcaaatgaacaaaggtgggatccggttccaataatgaagaatgtgatgactacatgtataccattctggaacagagaaaagactgcctgcagcaatatctctaaaaactacctgtggcagactcagtggatggtcaagtttggctctgaaacaagtctcctcatttgtcagagaaaggacagagaagatccagtttatgtgattaattcaatgatattagtagagatcatagatacaatgatcaaaataagaacattgctttttgcaaaatcagattaaactgcactccaaaacaatactgaatcatgtaaaagcagaacttcctctcagagatttctgtatgcaaagacaaaacaattaggtcacaggataccatgttcttgagactgtatgtccttactaagtttcattttcattcagatatgtacaagaccatttggtatttgtaaagaggttatgtttatctgtgttttcctgaatatagaatgaatatctttatgacaaaaaactttagctcagaagaatctttatcgcatttaaaataattaacaactatagtgcataatgtataattcaagggttttctgtagcccatttcccatctaccctgtccctgtccccatactccttcctcacctccacccaacctccaccagagataattaagcttttaagaatgagattgatcacttaaaagtaatatatttttactttatttctttaatccatgtttagactttcctacctgccaaaactttgtatcttttaaacttggtattctacttctttctcccatctcaaactatacgtaaatcagtgtgttagaaattccagtgagtttaattgaacagaaagttggggtatcttgtatcccctccttttttttcttttgggacataacctttgtttcccacttgtgattccagaatctatcttggtatgattcaacaccttttatcagctgcttctaaacaactttcaccaccatattgcctcctcattcttccgaaaatacactattttctagtcaggccaaactatacattctttccagagctgaccacacttgttatgttatattcccagctaaatgccttctgtaacatttactacttatccttctggatacaaccccaatgtcaccacctccttgagagcacccctgattccacagggttgagagtcagggtggcctgggaagaccacacatgtcctctgccatcattcagaggtgggtataagtgaaatgggagagttccctggtccccctcacaggatgtgtgacaggggtatggctctcttcttggctgctatgagctcaaagcccttacaagaggtggagcatgcagatgagcaggtgcaggaaccagagcgagagcttttggggtcccgccccacagcagtgtctaggggtgagtttctgtgattcccaaaacccaagtgggcacatgttacagtgtgctcttctagtgttgctgtccaagtgttaactagcttagtggaccctctgcctttttgcaagggcagagggccaatgtgacagctttctgtattctgagctcttatccagcatccaggaagaatcaggtgacacagggacttgaaggatgaatgtgggggttttattgagtggtggaggtggaactcagcaggatagatgggaaactggacaggggatggagtgggaagatcatcttcccctggagcttggccatccactggctgattctctgaccatccccagctgaactcctcctaacagtccttctcttctttcctctgctgcattgttctgccatccagtttgctaatctccttgtttcctgtctcctcatctgctcctggagcctggggttcggagtttatacgggtacaggacagggtgtgtgtcaggtcaaaaggcagctttttgggcatgaaaacaggaatgcccgtcctgtatccaggctagagggtggggcttttgctggggaactgccctcttctacccagtatttccctgtctcctttctgcatcataaagatgtgtggtacccagttggtgcagacgcgaaattcatctgtttctttatgttttctccctttgctctaaaagggtccatatttgcctgcattctagtgctcaccacaccacattggggtatttggttatgtgtctggtttcttcagtagcctaatggtgttccctgtgcaagattcttagatgggcctcaataaaatggttgagttgcactgaattgtgtttctaaagtagatatcatgtcttatttccaccagggcacaatgtctagcacttagaagcttaaaaaaagattgttgagatactaaatgaatagattaaccaaaagtttaatttttctagcagtgttcatgggtgggaacaaagcagtaaaacaaacacatacaaaaataaatggaggtcaaggacctataatactaaatgagctagcaccatttcatctggctgtgctacttcctagctatgcaacctgagacaaatcacatatactctctgatcttctatttcattatctgtgaagtggacacaaaaataatacctacctcttagcactgtttataaaaccaaataaaagtaagtaaagtgcttagcagagtgtgtaaaacacaaatttgtgctcggtaagtgttagttattatcatcttattgtttcctgaaaggcctccagctatgcttgttaagaaaggcttttattaagtgtatttaaagatactaatgattaaagtaatgagagtcaacacagtcaatatttattgagtgcttactttgagccagtcatctattctcactggattacaccattgcaacatcaaggaaacagttttaaaaaagtataaccagcacaaggttagtaaggagaaagcatgaaaactgtgcttctcatttcatcatctgggatcttagcaaatatacaacattcaagcaaccttctatgaatctagccacacattatggccccaccaccctgcgtcttaattttgttagaacttgccttattataattaagcacgcagccttcctttaccttctagtaaacagtacattttctgaagaccgagactgtgtaactcacctttataactctcacagcctaaagctgatgtacacacaggtgcacacacacagaaacacatacacacacacaaataaagaggagaagtgacaaagtagatccacattgttggaaaagacacagcaggttaaaggagggccactctcagaaacattttagcaatgaacagaaaaactagaccactcaaatgaaccacgtgcttgcattcacagtgttatacctgtataatttgttgaatttctaaaatctgtaattcagttagttcatcctccttcaaccttgagtcattttatagtttaattccagttttccttctctcctaaatcctgttgtgaaaaccactttcagattggctgtcttgattaatagctctgtaacgtctacattctctggtggacaaaacattttttgttccaaagtaattctttacctctagatgctggcaatttcagcatcaaaagaataaataaccaactgaaactatattcctgaggccaggctattgccatcagaacccatattttcctgtcttctcccattacctgtgcactgaaagacagagcgggtggcatctgaccaagcagctctcctatgcctggaaaagtagccactttctgagcaggcaatggatggatttaaacttccaacatctttcatcaccaaatagcacttccccagaagtgatgcatcatctggagttatttttcgggtaatggcacttgaacctgaccggtacttcacctaaattaagagtggaacaggtctgtaaagaggacctatgactgttatgcatcccataataactataatttttgaacaccctttttatagtagatgctatagaaaatggtggataaattttgtttttatcttcaacaacagtataaggaagatatgccaattttataaatgaggcacctggggctcagagagatttaggtaaggattagcatcaaggtaagatgccaagaaggggcagagaagggagtcccataaaggtgaatctgaagacatcctctcttcccaccacaccgagccatgacctgtagaaaaccatcaatgtctggtggtgcctaagacgctccatgccatgggaaaaatttattgaaatataatatccacatggaaaaatcaacaaaactttatgcctaaaacttattcatgaagagacaatggtaaagatacttaattagaaatataaaatagctgacattgtaacatatcctctatacttattgttgggaaacaattgtccctggttattttattatccttggttattttcacatttcagtatgatcctgagcctctgagcaaagggtactgcaaggatgtttgcttaacagacagcctcggaagtcggagagtaatgtctccattaagatagacagcacgggagagatctggagacaaggctctctcctttctattctccggatgagattggcttacattctggtataacagataattaatttctcctctctctctctcaatctctctctctctctttctctatctatcactgttgctcttactcaggcaaggcagaggtgcgagtagcccatgaaagtttagtctctcctaatttgggggttcctctcccatgatgcaaacctaatgcaaacgcaggtaaacttttgactcttaacagcatcgccatgaaaggactgggaactagagccacaagccagagggaagacagttctctggctgctgcttttctgtgagtcataaggctctgtgtctctgccccggactctggtgtcttctgtcagtatatgcataaaactgtgcaaggctaacctgttagcttgcaagtagagttcagttatatgcgggcgattggctccatgaccctcacctataccaaaatccgtgcatacccaagtcccgcagtccgccttaaggaacctgaatatactaaaagtcagccctttctagatgcgaggtttgcatcccccgcgaatactgcattttcaatctgtgtttgcttgaaagaaaatttgcgtatacacaaatctgtgcaggtcaaacccatgttgttcaagggtcaactgtaatctgagaccctcctcagtttctaaattaacatcagaagttctcaaagtgtgttcccacatcagccctggggaatagttaaagaagcatatacaccatggaatactatgcagccataaaaaatgatgagttcatgtcctttgtagggacatggatgaaattggaaatcatcattctcagtaaactatcgcaagaacaaaaaaccaaacactgcatattgtcactcacaggtgggaactgaacgatgagatcacatggacacaggaaggggaatatcacactctggggactgttgtggggtggggggaaaggggagggaaagcatcgggagatatacctaatgctagatgacgagttagtgggtgcagcgcaccagcatggcacatgtatacatatgtaactaacctgcacaatgtgcacatgtaccctaaaatttaaataaataaaaaaaaaaaagcagcagcaaattcttggcctggcgcagtggctcacgcctgtaatcccagcactttgggaggccgaggtgggtggatcacgaggtcaagagatcgaaactatccgggccaacatggtgaaaccccgtctctactaaaaatacaaaaaattagccaagcgtggtggcaggcgcctgtagtcccagctactcaggaggctgaggcaggagaatggtgtgaacccgggaggcacagcttgcggtgagcccagatcacgccactgcagtctagcctgggcgacagagcgagactctgtctcaagacaaaaaaaaaaaaaaaaaaaaaaaaatagaagcaaattcttgggccccagcccagatccactgaatccgaagttctggggtggagctcagcaatttatgctttaataagccattcatgtaattccagtgcacaccaagatttacaaaccacaaaacatactctgttcatatgtttctagtaacagtagctccatttgacagtgccctgctaacacaaattcattttgaaagaacactcaacagatctatctctaaaagaattaagatttctttgaagaaatcactttcatgtgtttgatttttttaattcaaatatttaatagtagtacaaactctgcactcacaaccataatttagtgtaaattagaagagtttcctcaatttcaaatactatattacttggctgagccaaaaataatcatctgtacagagcatctatgaaaataaacagcccattttgtcacactgtcactaagtagaaatgtcttgctttttcaaattgtgcttacttgtcataaaaattactcagcaaatataaaagagagtgaaaaaattaaaagttattaatacatgttctgtattcctccctgcaagattttgtttaaaaaacacacacaaaaaaaacaaacaaaataccagaaggttaccttaggacaatatcaagtatcaggtcttaatggctgtaaaatattcccataaactataatttatttaggcaattcatcatctacagtatgatgtataaaagtgatgtttttaactatttatcacaataaaaagttacacggcactctaaggaatccctagaatcaaatcaattggaaaatcattaaaactaataagaaatctgtaaattcatactttcaaataatcgatagctttgctatgtaccagcaaaacctatttagaatatccaaaaaaaagcaatctcatctgtactaacaaattttatttctcatttgtgcgataaagctttgcccatatctttatttgcaaatagtgtgtcctttttatacaaaagcatatagagaaatacttgattcaatttaacagtgttgtcttttagcaaaggaatttaatccacaatgataatccatgacaataacaatatttaaacttattatttaccttatttaatgccatatgattgggttttaatacatattttgtcttattttgataaaatgatcgtgtttaaatgttttcctgccacttataaattatgcacacaaaacatattctactatggtttatctgtagatcgtaaaatgtttgaatctctagtaatatcacatgcaagacaaaatgttgagcaaattttactgatcgctttgccctaaaacctattcccaccctatgtacagatacacctacaaactcattctccaaacacaattacacgcctcttttgattttacaattaaaaaaactcttgcaatactctagaaatttttttatatttgttttaagccttacagccacactaacagcaataatagtttagacttgattctgagctctactggtattactgatcacccctctttctgcttttaaagtgtcttccctttctgagtctgtctagatggcacagtgtctttttcacgattttatgtgtacatggttatacactttgagttctcatatgttaaaacatttttctgtcattgcctccggaatgataggtttattactgacttgtaaggatttgttatatactcttgcacaccaagggctttctgccattctcttttaagaaagctttctcccctatttccaatgttagggttgttttgtcattgaattcttagatcaaaggttatctctcctttgcaaacaacccaatccaaaagtattcacttgacttctgatcattttatcctctttaattttttaattaaaatatttattataaattgacaaattatagttgtagatgtttatgggatacaaagttatattatggtatatgaatacaatgtggaataattaaatcagaccaattaacatatctatcaactcaaattcttatcatttttcatggtaagaacatttgaaattcacttccttagtgattttgaaatgtacaatacattatttttaattatattcacgatgctatgcaataaatctcaaaagaaaaacaacaactcatattcctcctatctaactgaggctttgtgccctttgaccaccatttccccattactccacctctcagcctctggtaaccatcattccactctctacttctgtaagttagattgtttcagattctacacaaagtgagaatgtgtagtatttgtcttcctgtttctgatttatttcatttaacttaatattctccagttctattcatgttgtcacaaacaattaaatttctttctttttaaaagtgcatagtactccattgcatgtgtttgtatatatatatcacaatttcatcatccattcatcggttggtggacacacaggttgattccataacttggctgttgtgaacaatgctgcagtgaacacggatatgcagatatgcagatatgcctttgacacgctgatttcaaatcttcagggtaaataccaaaaagtgggattgctggatcatataataattctatttttaaattttctgaggaacctacatctagtttggttagactaatttacttatcccactaacagtgtacaagggttcccttttctccacatccttgccaatgaccttttgtttttttgataatacccattttaacaggtgtgaggtaacaatcattgtggttttgatttcatttctctaatgattaatgaaattgaattttttttcatatatctgttggtcatttgcatgacttcttttgagaaatgtctattcaggtcccttgcctactttttaatcaggtcatttgttttcttgctattgaattgtttgagtttcttatatatattggatattaaccacttatcagatgtgtggcttacaaatatagtctcccaatctctaggatatctcctcagtctgtacattgtttcatttgttgtgcagaagctgtttagtttgatgcagtcccatttctctacttttttgcttttgttgcctgcatttttggagtcagataaaagaaaaatcacagttcagaccaaggttgtgtagtttttcccccgtattttcttctagtagttttacagtctggggtcttatgattaatcctttaatccatttcgagttgatttttgtatatgctgtgagataagggtccaatttcattgttctgcatgtggatatacagttttcctgacatcatttattgaagagactattcttttcccattgtatgttgttggcacctttgttgaaaatcaatgtacatacgtgagcttttttctgggcctctattctgttccattggtcaatgtgtgtatttttaaattttttttattttttataaagtacatttttttgacatgtacaacacaaagtttttaatgtattgacaatgtgtctatttttatgccagaaccatgcttttaaattagtatttgtagtataattttgaattaggtagtgtgatacatccagctttgttcttttggcttagaattgccttggcttatttgggaatttttgtggttccatatgagttttagaaacttttctaatttctatgaaaaatgacattgaaattttaatagagactgcactgaatctataggtcacattgggtagcatgaacattttaacaatattaattcttccaatacatgaacacagtctatctctccatttatttatgtcttcttcaatttctttccttaatattttagagtttccagtgtttatttcttttatttttttggttaactttattcctaagtattttaatttttgtagctattgtagatgggattctctgtgtaattttatttgtggcactttccttctactagtttatttccttccactaatacttaagctggaactttccctgttgactgctgggttcccagttcccagaatagtgactggcacatagaggccactaaaacaattgttgattaaatgaatgagtgaatgcatgaacgaaatcaattagtctgatatcgatagcttcattgagctctggaaaagaatgtgtggcttctgttaatttctttctatctgagccaaaagaagagaaaggtattattctattttttttttcattagcaaagttgggagaccaggttaatgtggagaaagaaaaaaaatgtaggcagaacatcacagctgcatataggcacctctgttcatgagggcagctgatctctcttgtgtgctgtagcaaccacagctgagagtggaacctggcaagaagcaacccccacaaacctccctctggtagtcaggctggcctctctcagagcagtgagggccctaggatgctagtccccaagaacagcagtgccatgtgagaagctacagcaccatcaaattttgattgtattgacaattcaaatttttttctccaaactggccaatgttaatttagaagaagtggcatagcaaggctgggactcctccctaactcatcatctcaatccttgcagggaatgaaccctggtgtggcacccacttcatttccttccataatctgaatgaacttcaattatgcaaagagtaatgttccctgatttctgtgcctactagagaaatggttcttaatattttagttgagtgtatctgaagtgtattagaagaaggagaaatgcaaatggccttagaataccttgttggtcctgaaaatcctagttcctttttaattctattcttggctggttgttagaactggttttgaaaagtgctcaagagaagatgacttaggataacattgacaaaaaaggaaaacccatgtgttattcctaagcaaaattataaatattttaactatttcccaattgaggacatatgctttcccctatcagacatacttgtggatgcatggtagcagttgttgatcttggcatgtacattttttagtctgaattcataaaactgtgcagaaatgaaaagttggttatgagaaggtcatgagaaattagtgtttagtgggtacagattttaagtggaggaagataaaaagttctggagattgatggtggtaatggttgtagaacaatgtgaatgtacttaatactatagaattgtacactttaagattgttaaatagtaaattttatgttatgtatactaaaccaaaataaaataaatggtgatcccagtgcttaccttgggtggggaaccctcaataattagaaacaattattcaaaaaattttcaaacacctatttgtgctttttcatattaatgtttgcagttgttagtattatacacataattcaattccacttgaaaaacaattgctagctgattctgtgaacacattttggaaagatataattagttaatgatgccttgtcactactgcagattttacacattgttaatattgcagaagcttctttaagaaaatgtattctaaagttactatcttagtatctaaaataatactaactaaaatatagtcattggccaggcgtggtggctcacgcctgtaatcccaacactttgggaggctgaggagggtggatcacctgaggtcaggagttcgagaccagcctggccaacatggtgaaacctcatctgtactaaaaatacaaaatttagctgggcgcggtggcgggcacctataatcccagctacttgggaggctgaggcaggagaatcgcttgaacccaggaggcggaggttgcagtgagctgagattgcaccactgcactccagcctgggtgacaagagcaaaactgtgtctcaaaaaaaaaaaaaagttgtcattgtgaactttgctaacattattcattaaaagtcattcctaacattgtatgttactctccttgcccactccttttagtcttgagactaataaatattaattcattcatggaataaattaaaacaatatttttgttcctatcatgtgccaggacctgtggtgaggacgcacaaaaaggaacagaccctgagttcaaaactcctatctgggtgtgcttatgcggtgaaggaagagtagggatgtgaaaggaaagggagacaaagcatgatgacaatgagaatgaacaataacatgaaaaaccagccgggcgtggtggctcacgcctgtaatctcagcactttgggaggcggaggcgggtggatcacctgaggttgggagtttaagaccagcttgaccaacgtggtgaaaccctgtctctactaaaaatacaaaattagctgggtgtggtggcacgcgcctgtagtcccagacactcgggaggctgaggcaggagaattgcttgaacctgggaggtggaggctgcagtgagccgagatcgtggcactgcactccagcctgggaaacaacagcaaaactccgtctcaaaaaaaaaaaaaaaaaggaaaaagaaaaagaaaaaccacaggtcatttagtccacgaagacacgacctttacatgcatgctgtctcagatgatccttccaacaattttctaagtaaagtactattgttatttcacctttacaaatgataaagtcatgctcagaaagtctattcaataccattctcaatatcagaaaattagtaatttgaggtacctgtctctggtcattttacttcaaagcctatgttttaaatcacattatgatattacctatcccttctaatgttaaaacaaaacaagcaaatctacacaaggtgagaaaagatagtgtggaacctgggaaaacagtacaacaaaatttggcatgattattattttttttttgtcagaggaattttaggttttagttttggggaagttatcgagtagaatgctatcagtctcattaatgaaacaactcccaaaacattacacacacacacacagacacacacaaatacacacacacacacacacacacacacacacacgggggagaggggggcggagagagagagagagagagagggagagaaattaaataacagcagataggtgatatctggaaaactggtggataacgaatgactgcttaaccagatcccaggaaggcaattgcctgagctctgaatgaagaaagcttactggtaagttgattcacatgtcagatcttctacattgctaggaaagttggctacaaaggggacacaagtagagggactgacagaaagcttatattagaagaaggaagacccatgctttactttgtcaaactatcatactgccgtccctccaaaaagtttaatatgatcatatcagaaggatatgagaataaaaaaagagaaagtaagagtgtgtgtgtgtgtgtgtgtgtgtgtgtgtgtgtgtgagagagagagagacagacagagaagaaaataaagaagaaaggagggaaaggggaaggagtgggagagggggttggaggaggagaggaaaacagaagccctggttatggtttaaactatttccttgtatagctttccaaaaattaaatctaattttagaaggtattataacttactattacattttataataagtttcccaaatgatacggaagttttagactactacttttagggattcagttaactgacattctcttctaaagcctctttgagggatgtggtgcctgtttcaaatgacatttgctaccttaaaacctaggactcgagttatctatccaaaggcaagttgagtaattttcacaagaatttattaagtctattaatcttgtttattccagtgaagcagatcatttatgttcttaggttataggtaaatggtataaaattcttcagagaatcaatgagcttttgttttgtttgtccttctcaatagcacgttaattttaactttaaaaggcatacaatttgatttcataattgaatcacaagaaacacaaataaaaactatcaaaagtttggtgctaataaataaatcacccaaattcatacctgggaaatttcagattttacacagtgaggctttctttgagcaccaaaatccctttagaatgtgttaatgtgctataggagagggcactgtgtgtatccaggttgtcctggaagaaatgcattcctaaagaccaacttaatccaatagaattgaaagtcttagcattgaatagtgaagagatgcatatttaagacattccagaaggttcttttcccttctgcttggatactcattgctaggtgacagactccttctcctctttcacgtcacctcaaccaaaaactctgttctaccagagcctctcaaatgccatctctggtttccacctttgaaatgcattgatttattcatttggtaaatattttttcacacacaaagttacacagccaccatctgtccaaatcgtgctaaatgccacacaatattctaggtgctttacataaattatttcatgtatatgcaacaatactccagtgtaatatgatctctttcaacagaggaagaaactaaggcttagagaaacagtgcaccagccacagaaatagaacacggcagagccaggcggcagggcctgcagtctctgcactctgccccgccagcactctgtccctcaggtagcaaacttgagggtttacttttttttttttttttttttttttgaggcagagtctttttctgtcacccaggctggagtgcagtggcatgatctcagctcactgcaacctccatctcctgggttcaagctattttcctgcctcagcctctcgagttgctggaattacaggcatgcgccaccacgcctggccaatttttgtatttttagtagagatggggtttcgctacattggccaggctggtctcaaactcctgacctcaggtgattcccctgcctcacctcccaaagtgctgggattacgggcatgagccaccgtgcccggccgagggtttgctttatacctgtccctgtactacacttcacacctgtcatcccatctgaatgttaccacaaactgatgagcaaggcactactgttgttcacttatgcacaagaggaaactgaggcttatagggactaagtcacttgaggaagactgcttgtctgataattggtgactgggtgacccaaagactctctcctgccctacagcgcaagtttctactcactgccctctgcctttgctctaccaaatatctgcaaccatgcagaggtactctataactgtactgatttctaccaggacttaataaacataaacttattttgagctacataaaaatatctaataaatatgataaatatgctagaatcatgaaacagtgatcaaaactactgtatctaatggctgctctttaaaataatctgtgtattacaagctgtaatagctccagtgacattttcaacttcatggaagataaatttaactagaaaactccaattatggaaagaattatttttgtaccatacgtataactttaaacatccaatttcattcagatataggaaaatcataaaacctttccatcagattaacaataaaaacacaaggactacccccaaacttacctgacaaagaattaaattaaaaggtttaaattggtacaaatagtagtaggtctatgattgagactcaagtaggaaaggggaagaaaaaccggaacaacttcaatttctatgtgaagagctggcggcaaatctaattaacaacacaaagcctcaggcgaagaagctgctattctaccctttgccaaataaaatgaacttcatcttttaaaagctccagccaagctaaaataagttactaaatggtaagacgtgtgaaatccaagccctttaaagatacagaggccagaacaacaaatgtaattgcttcattccttaacaagcggattgaaaagtaaacaccttgtggtcattataacaactaagtcatataaatatatttgatgcagtataaaataaaataacgcctatagaaatattccatacactgtaggcctctacagttatcgggtaagatgtaggtaggtaggtaagacatgacaacacacatggctttgctttcaactaagggcttggttacctgtacagtttctggtgatagcatccattgagaatacacactttgttcagcattgtgctttggggttcaaggataaatttacagtatcatacatgtacttcaggccttcaaaccgcttggggaaatggaaagagcgcacatagcaatagcactaaatatatggcggaagataagccagtgctgaattttgtgggtcaggtgagaaaagttttaaaatgctgagggaggtttcaaaagcaagagagtgcaagagaatttgcagagtttgcagatttgatgggatttagaacagtagaaggagggggcatggatgaggaggtcagctctggaaggctgagtcaggatgaactaagcactaagaagagcctctatcttccccgaaactttaatcacagaactgaaatacaaagagaaataaaaaatcgtttagcccattttttttcttccttagtccaatgcccactgtcagtggagaaggaaagatgctgtaattacaaaagccaaggaagcaacatgatgtcttagagaaaaagtgacagcttcggatttctaggaatgaggtcaaattctcactccagaagtttcctcccctagtgacctaggacaacttatttagcatttctaaacctcagttttcttatgtatcaaatgggggcattaatagtcaaagagtaaaaaaggctccacaggctttttgaaaatgaaattcagatgagataatgtttagcttctttctcttacaccatctcttctccacctctagagaagggcctgagtatccgctctgcttcagtgtgagtggcttcttggacactggtgatattatgaaataatttttcccactccaggctagacttgaggactaaatattgtgtgatctagccatatttttgtatctaattcaattgcaggagaaatgggaaagcttcaattaacacattttgttagaagacctaggctctgacctcacctaggagatacttctgtgaaggacttataccaggatttggttgggttagaatcgttcctgtgggaaatgagactcctcattcagaagatactttccagtttcttgggtgtgagtttttttttaattgcattagattacacattttctcctttttttgttgtttttactgttaacattagtcagcttgcatatgtgcatatgctcaacgcatgcgtgtgttgttttgaaacacaaaacaactggtgctttgaaaaagttaaacatctacaataaaattccaattgccatcttccccaggaagtttcccacttcattctttaaggtaagttcaatttccacttcttcaagaaggctgcaatcatccactgctttcctgatttactcctctcctcccgttaggttaggtactccttttatgtgatttcctacaaccttgaacacatctttagcactgtgctttatcatagtgtacaggtttacatacattttctgactccaggctgcgagttctttgggaacaagaaccctcttattcctcattgtatcctgtgtttagttgtctggcatataacgatgcactcagtaggtaagagcacaagatacttatctagaagcaacagaaatgtcaccctgtcccttcccatttaaatagtaaacattattctgtatgccaaaaggttcattcattcttgctttggtgcttcttcacatcattctcatatataagacacagcctccctagcccagttctttacatcatcttagcaattctctgattgtttagaaggccttacagaacaccgtaggtgccttacagaacaccttagtaattctctctgctgggtttgattctttcaaattcttagcccactaaatgcacttttactctatgcttgcatgtaaaggatgctgacttatttttcctttcaaagcctaggtctaaagagaaaacaactaaaaaaattctgcagcattatacaaagtaagcccaggtattagtcaaagtccaattccaacaccttaggcctacttgataagatgtgttctcccttagggcacaattcatctgtaatcactgctactggatactgacttgagcagaactataaacattttattgcagatagcttgactttgacaaaggcaaaatctttttaccctctaattcataagatctcctcatttactcatcagccttactttttaagagtgcccactgggataattacagtggttgtttcactcatgtcggctttatttagataataagctcaaaggccagggatgccttagcagtttctatctttagcactgaatacaatatatgagaataacatttgtgaaatgttaataccaggtttttaatatcttttagtaacaaatccttttgaattgtctaggggctacactggagtcaagtttcatttattttcttcttgagatttttatattgattccaatgctagaaattataggccattagtggatcattgagcatttcctcttcttgaacattttcagtagtgtactactgatacttaattctaaatttaatctagatatgtgctcctctagatccaatgccaactaaatatatatatgtattttgagacagaatctcgctctgtcgcccaggctggagtgcagtggcgcaatctcggctcactgcaacctccacctcccgggttcaagcaattctcctgtctcagcctcctgagtagctgggattacaggtgcccgccaccacgcccggctaatttttgtagttttagtagagacaaggtttcaccctgttggccaggctggtctcgaactcctgacctcaagtgatccgccagccttggcctcccaaagtgctgggattacagatgtgagccaccatgcctggctaatttttgtatttgtagtagagacaggatttcaccatgttggaaaggctgatttcaaactcctggcctcaagtgatctgcccaccttggccttccaaagtgctgggactacaggcatgagccactgtgcctggcccagtgccaataatttcatcaaaaattttctaagcgataattcagtaataagagtttgccacgtactgttctcagtgattatatacacacaaaaattgacaggtattttaaaacttattcagtgtctcacaaccaagaagcaatgcctacgatttatacacaggtttagaatttgaacatggtcttaccactacatcctacaccaagattatacaatactaactaaggtgatacagatggtccccaatttatgatggttccacttaaaaaatttttcaattttatgatgagtttatcagggcagaaccccaccataagtggaagagcatctgaactaacaataattcaacttataatttttgactttaagtttgtcagggtgtgaaatgtctttttgactgatatttttgacttacagtggtttactgggatgtgatcccaccgcaagatgaggggcatctgtacttcaatttggaaacactgacttgaatcataaaatttctgactaaaactattaaacataattgtagcattttatcattacatttatctgtcagttttattttaccatattttatttctaatattatatttactgaataattctatgatataatcgtttctgtgccaaagtacagaaataacagatttttgttattcctaagttttactagaatttaagtgactttaaaatataatcatagccttagaaaatttgtttagggaaaatgaaagtcatttattaactctctatggtaatattttagtgttagttgtgcaaacatgcgtgccaggacatgcacacacaaactcatttaagctttgcttttccatattgtgtcctcattttacttacttcttagccttattaagagtagcagaaagtgacctacattttcctctcctaaaaaattatgcttgtcatgttttctgcaagtcatattcagtcttccaacaaatgtttactgcttgcaatgtttatggtgcttggcatattatcagtaaacaaacagaaaaatgtcactgcacgaagcttgtatcagaagacagaccataaataatagaagcactaaataaggaattttatagtaggtgagaaggtgatatgtgctatggaataaagaaaaagtagatgtgggttgggtggatagagagacctgggtaatgggagtggagacagttgtatccttaaatagggtggtcctggttggtaccgttgagaaatggctacctgtttgaggagaagagaagaaagagatgcagttagccatgcagctacatgaggggagtgcaacctggtcagtcaagaatatttttattacttaaaactgcctttaaatgcttattcttgtgaatagggagaccaaaatgtgtgttagacgaaactctgacagttcattgagggtgaaaatgagctgtaaagggctagattgacaatgaacaaatgcaggacactcatcgtttctgccctgcaaataggctctggcttagcagcatttctgagataaaaaatgaaaattcccctggacatcctctgaacaaaaagagaaccttctgaaatgatggtatttactattgtaatacattgaaaaagaatagataacaagttgaacttcactacagattaggacctaaaaaatggctagttagcatgctgcagaagcaatgaataaataaattgttaacaaagaagtgactagaactgacccagatcagtgctcaacaagacttggatagataaagccgagactcttagctaaagtgcagcccaggggaaatgtctgcaggtcatatggagaactatccttctttgccatggggacaaggataagcacgggagtttcagaagcaaaaatcagagacctttgactgcaaatattgaagccccacaagagtggagagaggagaggcatctttgtgagctaaagaaagacccccttcctcatgcagatgtaaatgggacaaagccgagggacttgcatctaggaaaaaaacaatttggaagcccattttccaaatgattgacctttatctatattctgagcaacttggcagcacattgattcagaactgggtaagcagattctgaagtctaggaactttgactggaggacaccagctgctacttcttaatgccccatgatctgagaaaggaagtctgtaagtaaaaaccaagcaataactgctctgaagacccaataagattttatgaacctctgtaatttctctaatcacaaatttgtaatttttgttatttgtatttattccttgactcaaatattacttcctcaaagaagccttctcaaatcccctactatgtaaacttgcctggctttgcaatgtcagagggtttctacaacggtaattaaaataaaatgacaattatataatggaatatcatataattaattctataaagtgatttacagcatgtatctctctaaaatatgttttataaaaacggtaagaaccaggcttgttggccttactgttgtttccccaacacctaggccagtgcctaaaggagtcacacaataaacattcccctaaataatcagtgaagacatccagaaaacaagaccttcagagggattatgacataaaatgtactcagctattttcataggatggtacgttagggcgtggtgaagaataaaagaaaagtctaattggtagacaggcaggtgacaagaagagataagtgaaatacccagagcctacagatacagagaatatgtgctgacttcaataatgtaaagcactgttattgctcccaggtttaccgagggacaatatgagaaacatttatctaaagaatatctgtttttccccaaaattaaattttgggacttatgaaatttattacttagactatttaaaacattacctataacataggtattaacttataatttaagggaaggcttgtgagcatagaccctggagtcaaactgctagggtggcctcccagttctgtccctcactgggtgagtaagatgcttaacctcaatttcctcatctgccaaactgggatagcaactgcaaagtgagccctagggttgaaagaaggtgtttatacaatatatttaaagtgcttataacagtgcctagcctatggcaggtaggatgtaaattgattattattgttattactatctatacacttttgactgataatatggactatacaggctgcatgttattatctagatattttggaaagaattaaatgcttgcttgccacagcaaacatccctgggtacctggcaattccctttctcctgctaattagcttttgatttatattttaaccactctcaaattatattgacttatataactttcaaaactctaaattacctcaattgctttctagaagtagacaagtaaaaagttacaatcttttaagtattatacattgaatgcaatttattatgcttataattaccaaattcattacaattatcccttctaaattagtctgaaggtcaattaattttgaaatacagtgttttgcaaacttaaactaatgaaagctaattcagcccaggtatcagatattttaaagactggtaaaattacacaaacttttgaaatatacttcctaaatattcagattatttgcctctaacatttgcatgatacatcatagtaatttttttgactctgaagcagaaatgagtgaaaaagcacaatattcagcacatagtaagtgctcaaaaaatactgattgaatgaatggctgaactgatggttttcccatgagatggcctaaggagttcataggacggttgggttttatcactattaaaaatttatcaaaaactgtaccacaggttcttgctataaacacaaagaaaaacataaggtataaacacaaacagaactaagaatgaatttttttgtacaatctggtttcattgctatctatgccttctttaactactagttgaaaatatgatggactaaaagggaaaccagaagcctatttcttaagcccaactggatccatcataaaattcttccctaaacctctctcattaactttgagctgctaatgcctattgatccgtgtgttacatggcatcgtgtaggctgaaagtaataatgacagtaaccgcctattaactgtttaaactctatattgcatacgaaaacaccacaagttctggttgccatgcacagccgtacactatagaaaacaagtggctctacctcttactctccatcctgtagaaagtgctgtcacatgtttgatggggaagatgggaatcaggcagggtcgggtggcacagttgtagttagcaagcctgcttcaatgaaactgccactctgacacagtcttactcagagatatcccagaaaaccacggtcctctcctatggctccacgtgtgccctggagagacatgtaagagtagagggcaccccaagcacagaagacaacaatgatggaggcctctgagaacagtgttggcctctgtacagtttcctgccactctacattctctctgcatggttgcagccatatcctgactatgtgcagggaggatttaaggccgtcgaactgaacacttgacactttgttctcacactgtactgtgccccgatgtgattaaattagcaggatcaatctcttcctgagtccggttactgactgtatgccacaatttggccactagatttataattttttcccatgtccatatccctgctgagctctccagcttatttaggatagggacatcaatttgcggttgcccccgaccttgcaggaatttaggggtttcgttggctttttctaccagcagtccctcctctgcttctgtcctccttccctcatgacctacacccaggtctactggtgaggtccctgctggagataccctagacatgagataccaccagcagagatgtcactggcctattttgaaatcaggtcaggttttaatatttccacgcaaaatgtgaaaatgtaggggggaaaggagagcgctggatgccttcctatttcacatccatgttcacagtcctactgatgaccttagattcctcactgtatggttttaccacctgttgggacacctattcatgtagggccgtcacatccttgttactgacacattcaccggcttatttaattcttcatctattaccatctttttcaaatgatatgttctgctcactgagctggacttgtaacatgtttgctacgctagtaccacctgacaggtcatgacatagaaaaaaatcagatccatgataattttaaggtatcatgacatagaattacctttgaaattctattccatgtagtttcttgtacactgtcacaataaaggagtgtacttcttgctctattttctgtttctgaagttagcagtgaaaggattgaaggaaacatatgttttccagggctgtacagtcactctttcatgaataactgtttcactgaattcagatattaaaaagtttgcatactccctattcacccagaaacttgtttctatttaagtatctcttttgttttcctctcgaatctcaagtgcagatacaggatggggaagaaaggcatagagctgaagcataattggaacttgatccccaggatgatcaaacacaaaccttaacagctattgccattgggcagttatagaacaacaagtaaaatatataaaaagagctaaaagctttccttttctttctctctctttttgagacagaatctcactctgtcggccagaatgtgagtgcagtggtgtgatctcggctcactgcaacctccgcctcgtgggttcaaacgattctccggcctcagcctcctgagtagctgggattacaggcgcgtaccatcacgcccagataatttttgtattttaagaagagacagggtttcaccatgttggccaggccttctcagcctctcaaagtgctgggactacaggcatgagccaccatgcctggccataaaagctttccttttaaaagaaatatttcccagctatgagaaagtgatattaaaaaagaaagacataccataatacccaaatatggcaaatggctcaaatacttcccagaaaactttttatttccagcatcactaaaacattcctctgtggcttcaccattcatagcttgaaagaaaattcagtgcatttctattgcttgacacggcaaaatttacaaatacgtatagagaataagaattattaagatgtgagctgttaaaccatgaagctgccctgcttgaaaaacggtaggaaatctgaaagttgtaacatgatataaaaatcaaagaccaattcaagtgcaggctgaatctagaacaatgcattaagcctttgcttacaatgtggacctgcttggaattccttctaatgcatgaaagaacagatcggggcaagaattggtaggatatacacacaaaggcttttctggagtcgatgcaggagttccatcttgagaaaaagaaatcagggatagcaaggtctcctttatttatttttcagaaaatgtcattttctatttgcaacttcattaagaatgtgcatcatatgtcaccatatttcaataaaaaaactcagtgtactcatctgtttaaataagggcattacactgaaaataatcttttagatccaggtactgaagttgtcatatgtttatcattattaatatcaaaaacattttacagggcttctggttaagacaatgtagatgttttcatttaaagacacaaaatttcagttggataggaggaatatgttcaaaagatctattgtacaacaaggtgactatggttcataacaatgtattatatacctaaatgttgctatgagaatggattctaaaatgttttcataacacaaaaaattataacagtgtgaggtaacggatattttaattagtttgatttagccattccacaatgtatacatatatcaaagcatcatgtttcacaccataaataaatacaattgttatctgtgaggtaaaaaataaattagtttaaaaagatatatctatggcttttttaaaacaaaattcctagcatatacttgttttactaagagctacctctgtggtaacagtttaaaaatttataaatgtatcacctctggaacaaaagaacagtaacactatcttatgtagcccttcatgctttgatttttagcgattatattgtcctaaattattttcttctgtatatcctaatttaaacatttagtggatgtctaattatgctaaacaacatgagggctgaacaaaggagtactcagtctagtttggggaccaaacaaatacaactagtatatgagacaagctccattagggtcatattaataatcagaagggggatcctgggaggagaaattaactttaattcttgaagatgactattgtagaatgatatagaaaggtggagacattttaagtgggtccagaagattttcataaaaattgacaagaacagaggcagagaagtcggttgttgaaaaggctcaaatctacttactgtgcccaggattcagcatttcaagggacagtactaaagtgagaatgaaaaactagtaagagatgagactgattggcattttgtgtcattaaatccccatctggcttaggcaatagtcactgaaagtttctaaacaggaaaatcacatttgaattttgggaataggactcagcaatatttagaggaaattccagcctccctcattccttcatatacacatttgcctcttctctcctcaattctgaggcctctccaaccactcattctggggtctcagccctcccactctgggagggaaccccatccatcacttgtctcccctccattctccctccaaccttgtctttgctattataaccttcttgtgagaatttaataatccaatgttaattaaatttcagaagaatgccattcagaaaggtaatgagagcagagtagaaggtcctaggggcatttccccctaaacatcatgctttgaaaggaggcaattatgagaaagacagagtgagatactgtttaactgctcattctctgtttcttcctcccacgattttcacagctgcttgcgtcattttagctggtgggctaagggaagtgaccataacaactccaaatatggaaaaagatgcccatttgatgagttccctttttgtttctagatgcactcaagctgaacaggtaaattggagttactttttaaagttatttgaattaaatatatttattttttattagagctctataaatgatatattctgtcattgtctcatgagttataatctcttgttctctttaacacagccccacagtacactgtgactctcttcttagccaaagcagtagcaaaactgagtgggaggcaaatacagaaagccaacaggcaagatgtgaaacacggaactgtataatcaatgtgcctgagtcccctcattcactctcctgtaaacacaatcaaaagctctgattttaattcactcttgccctcatgcataaggaattaaagttgccctttccaagctttaaaacatctgtggtggaaaccctaattacaattttacacacacacacacacacacacacacacacacacacacacacacacaataccaatgcaaaaagaaaacccgtaagattaaaaaagaatacttcacaattctgagacgtttaatgaaaatgaaaaattaccaaaggccaatagtgccctagtatttattgtgtattgtggaatttaataaagcctttctgggcactgatattaaaataaccttcataacacttttaattccagaatttcaggatggaaaaatagacatttttgagtaaatatctctaagtgcaaatgaaaaatatttattaacttcgtcatcatttataaaagaaaaatattttgaaagtgctgttattaatcccctttttctcatctcttagtttgaggactctgcagtctcctgcagataacaaaaacatcattttccatatgcagactgagatgagagactcctggatattgtcagcacctaatgttcactgtaaatttataaatatgtaagattaatgctaacataaaatgagttagtggaaatgatttacacagaatcaatctgacttagccataaaacattaattacaagtattatgatacagcatcattattatttcacctgttactagattttatgatcatagtaaaagtactcaatcattgacaaagaatgtaactacagaaaatcactcaacagcttcaagtctgagcatgagggtagtttgtcatttattctctactacagtgaaaaacaccagagtggcttcacatagtactggaaagtttatctctagcaacttccaacttaaaagtagtccccaccccacagatcctattcacattaaaatccaactatacagacagcaatgatttccagaattcaagtatccatgcagatactgaaaacaggctttgaacactcctagaaaattcagagcagaccatctgaaacaaatactaaaccaattcggttaaataatacaaaataataagactttagaaatggctacaagaacttactatattttatcagttaagacatttcttgtttctaggtattatgtaacaaaatgaggcaggagaagtaaattaagcgtacaccttgaaacaatttttataaatattttctttttgcatgaggccagatgttgtctcaagcaaaaagaacaaagctggtggcatcctactacctgacttcaaaatatattacaggctgggtgagggtggttcacgcctgtaaactcagcagtttgggaggcctaggggggtggatcacatgaggtctcaggagttcgagaccagcctggtcaacgtggtgaaaccctgtctctactaaaaatacaaaatttatccaggtgtggtggggggaaccagtaatcccagctacatgggaggctgaggcatgagaatggcttgaacccgggaggctgaggttgcagtgaaccaagactatgccattgcactccagcctcggcaacagagcaaggctccatctcagaaaaaaagaaaaaaaaagaaagaaagaaaaagggaaaagcattacaaaactataataataaaaacagcatagtactggcataagaagagaaccatcaacaaagggagtggaataggagaggtcagaaataaactcacacatttacagttaattgctttccaacaaaggtgccaagaatacataatgaaaaaaggtcagtcttttcacttaatgatgttgggaacccaagtagatatccacatgcagaagaataaaactggattctttatcacaaaccatatataaaaataaactaaaatggattaaatacttaaacgtaagacctgaaattgtagaactgctagaagaaaacatagggggaaagctccacaacagtaatctgggcaattatttttggatatcactctctgaaagtacaagcaacaaaaataaaaatagacaaataggattgtatcaaagtaaaaagctactgcatagaggccagacgtggtggctcacgcgtgtaatcccagcactttgggaggccgaggcaggtggatcacgaggtcaggaaatcgagaccatcctggctaacatggtgaaactccgtctctacgaaaaaatacaaaaattagccaggcgttttggcgggcgcctgtagtcccagttactcaggaggctgagacaggagactggcatgaacccgggaggcggagattgcagtaagctgagtttgtgccactgcactccagcctgggcacagaaaaaaaaaaaaaaaaaaaaaaaaaggaaaaagctactgcatggagaaggaaacgagagactgcagaaacaactcagattgggagaaaatatttgcaaaccacacatctgatgaaaggtttatatccagaatacataaggaacttaatagcaagaaaacaaataatctgattaaaaagcgagcaaaggatttgaagggacaattatcaaaagaaaacattcctatagtaaatagatatgtgaagaaatgctcatcataactctcatcaggaagaggctaataaaactacagtgagatatcaccttatacttgtaaaaatgggtcttatctaaaagacaaaagataaatttgagaaataacatgaagaaaaggaaacccttgtacaccattagaataaaaattagcacagctattacagaaaccagtatggaggtttcttaaaagataaaaatagaattaacacataatccaacattcctacttctggctatatatataaaggaattgaaatcagtgtgctgaagaggcatttgtatccccatgttctttgcagcattgttcacaacagctaaggtagggaatcaggaatcaactttattgtccatgaacaaataaactaatagagaaaatgtggttcatggcacatactctgaaatcaaccatacaatctgatataaaacaggactcagcaaattaaaaaaacaaaacaaaacaaatcataccaaccacactttcggaccatggcaaaataaaaataaaaaccaatacttaaaaaatcactcaaaccataaaattacatggaaattaaacaagctgctcctgaatgacttttgggttaacaatgaaattaaggcaggaatcaagaaaatttttgaatctaatgaggaggaagatacaacataccagaatctctgggacacagctaaggcagtgttaacaacgaagtttatagcatctaacgttcacctcaaaaagtagacagatttgaaactaaccacctaacataacaactggaagaactagagaagcaagagcaaaccaaccccaaaggaagcagaagacaagaaatacaaaatcagagtgaaactgaaggaaattatgattgaaaaaccatacaaaagatcaatgaattcatgagttggttctttgaaaaaaattagtaagatagaccactaactacacatataaagaaaaaaaagataagatccaagtaaacacaattagaaatgacaaaaaagatgttaccactgaccgcacagaaatacaaccaacaatcagagactactataaacagctttatgcacagcaactagaaaatttagaagaaatcaataaattcttggacacatacaatctcgtatgactgaaccatgaaaaaattgaatccttgaatagaccaataatgaactctgaaattgaatcagtcataaaaagcctaccaaccaaaaaaaagcccaaggccagatggattcacagccaaattctgtcagatgtataaacaggagctggtgccattcccattaaaactattccaaaaaattgaggagcagggactcctccccaactcatcctatcaggccaatatcatccagataccaaaacctggcagagacacaacaacaacaaaaacacttcaggcaataaccttgatgaacataggtgcaaaaatcctcaacaaaatactaccaaatcaaatccagcagcacatcaaaaagctaattcccctgtaatcaagtaggctttacccctgggaagcaaggttggttcaacatacacaaatcaatgaatgtgattaatcacataaacaactaaaaacaaaaaccacatgattaccttaattgatgcagaaaagccttttgataaaattcaacatcctttcatattaaaaccatcaataaactaggcactgaaggaatatatttcaaaatattaagggccatctataacaaacccacagacaatatcatactgaatgggcaaaagctggaagctttctctttgaatattggcacaaggcaaggatcccctttcttactactcctattcaacatggtattggaagtcccgacaagcacagtcaggcaagagaaagaaaagaaatccaaataggaagagagaaagtcaaactatccctgtttgcagataacatgattctatatctagaaaaacccatagtcttggcccaaaagctccttgatctgatatacaactttagcaaagtttcaggaaactaaatcaatctataaaaatcactcgcattcctatacaccaacagccaagctgagagccaaatcaggaacacaatcccatttataattgtcacaaaatgaataaaatacctagtactacacctaaccatggaggtgaaagatctatacaatgataattataaaatactgctgaaagaaatcagagatgatacaaacaaatgaaaaaacatcccatgctaatggataggaagaatcaatatcatcaaaatggccatatggccaaaaacaatttgcagattcaatgctattcctatcaaactaccaatgacattcttcacacaactaaaaaaaaactatttaaaaattcatatgaaacaaacaaacaaaaagcccaaatagccaaggcaatcctaagcaaaataaacaaagctggaggtatcatattacccaacttcaaactatactatagggctagagtaaccaaaacagcatggtactcgtacaaaaatagacacatagaccaatggaatagaatggggagcacagaaagaatgccacacacctacaaatatctgatctttgacaaagctaacaaaaacaagcaatggggaaaagatcctccattcaaaaagtgttaggataactggctagccatatgcattagattgaaactgaacccctaccttacaccacatacaaaaataaatgcaagatggattaaagacttaaatgtaaaacctaaaactataaaaaccctggaagttaacctaggaaacaccattctaaacatagaacttggcaaagatttcatgatgaagatgacaaaagcaattgcaacaaaaacaaaaattgataaatgggatttaatcaaacaaaagagtttctacattacaaagaaactatcaacacagtaaacagacaatctacataatgggagaaaatatttgcaaactatggatcccacgaagatctaatatccagaatctataagaaaccaacaaatttgtaagcaaaaaacaagcaaaagtggacaaagaatatgaacaaacactttaaaaagacacacatgcagccaataaacatatgaaaaaatgctaacattgttaatcatcacacaagtgcaaatcaaaaccacgatgagatactgtctcacagatgtcagaatgtctattattaaaaagacaataaaagtaacagatcctggcaaggttgtcgagaaaaacgaacacttatacccaaggagtgtaaattagttcagtcattgtggaaagcagtgtggcatatcctgaaagaactgaacacagaattagcattcaacccagaaatcccattattggatatatacccaaaggaatgtaaactattctaccataaagacacatgcacgcatatgttcattgcagcaatattcacaatagcaaaggcacggaatcaaactaaatgcacatcaatagtagactggataaggaaaatgtggtacatacacaccatggaataatatgcagccataaaaaaagaatgagctcatgtcctttgcagcaacaaggacggtgctgcatttgtgggagaccattatcccaagcaaactaacatagggacagaaaaacaaatactgcatgttctcacttataaatggagctaaacaatgagaacacatcgttactaggaggagaacaacagacagtgggcctacttgagggtgaagcgtaggagaagggagagaatcagaaaaaacacctattgagtactatacctattacccagccgacaaaattatccatacaccaaacccctgcgatgtacagtttacctatatgacaaagctgcacatgtacccctggacctaaagtcacatttatagaaatacagagtagaatggtggtcatcaaaggcatgggggtgggaatgaaggaatgaaaaaaatgttaattaaagaatacaaatttacaaattttcgattagacatagaaataagtttttgagatgtactgcacagcatgttgaccataattaataataatgtattgtgtatttcccaactgctaacatggtagattttaaatgttctcattacaaagaaaagatagtatgtgaggtaatggatatgttaattagcttaatttaatcattacacaaggtacacatatatcaaaacatcacattacatcctgtacccctaaatatattgattatgtgccaattaaaataaaaatttaaatttaaaagaagtgattatacttgctcaatgtttttcacttaatgaaggtgtaagtaatcaagagcttttagattctagaatttaaaaaatcaattttagtagaattagaaattattcaatattgaagtataatggatcaagctttgaggtctctgtagaagatcaaatatttctgtatgaattatataaacttattcttctattgaaatgcatgttgcacacaataaaatttatcaattgtgcacatacatcttaatttgtaacatatactcttgtataatgggtacactccagatgtactcaggttttatactcagaatatagaatatttttgtgaaagctctcttgcatccattagtattcaatagtgtcaccccatttccagcttctgaaaaccattgttctgctttctgtcactacagtttttcttttctagaatttcacatcaatagaatcgtatgggatgcaatgtttgtgttttgctttgatgggaatcagtatataccatgccgacatgtgtcatattagcacaaaaattattttgagctgaagacatttgagttcctgaaatcccttatctgccttaaagcagagcctcctaatataatacgaaaagactgaattgtcataaatcccctaccccagagcaactaccatctcttatctattttcttaagagctcatttatctttccaaaataattttcttttccaaaagggccctttctttcctccccgcttcccctactaagttagacatttagaccccaaattcaatcacctattgagttactcatcactgagaactcccaagtatatgagcaacacatatgttaataaacctgtttttttcctcgctctctctctttaagctgtgttttgtcagtctaatttacaagggctcagccaatgaactaaagaaaaaagaaaattttttcgttccctacatctcttttcacttagtaaaatgattttgaaatgcatccatgttgttgtatgagtcaataatctgtcccttttcataatggatagtgttccattgtatctgtattccatgatttgcttgcctattcatcagttgatgggcacttagagttgtttccagtttttgactattataaacaaagcttgcaagaacatttgaaaacaagtctttgcataaacatatgttttcatttctcttggagagatacctagtagtgagattactgggccacacagggtctaccttccttattaagaaactgtaaaactattttccagtaagttgtaccattgtgcatttctaccagtaatgtacgtttccaattgctttgcatcctcactatcatttattattgccagaccttttcatcttagccaccccagtgagtgtgaagtagtgtctcattgtgatttccatttgcatttctctaattactaacgatgttgagcatctacttaggtacttatttggcattcatttaccttctcttgtgaagtctctcttcaaataaagtgcaagtatttttaataaaaatcaggttgccttattaagtcataagagttcttatatctactagatataaatttcttatcatatatgctctttaaatatattctcccagtctgtagctggtcttttaattttgtaagtagtatattgtgaagaacaaatattttaactttaaaatgtccaatgtaccaacattttcttttatgacttgtgctttttgcctcaccaaaactcacaaagatattatttttttcttctacattttatagttcactgctctctatatagtttatagctctataaaccagtttgaattgttttgtatgaaggatgtgaggtcgaggtttactttttccacaaggatttccaattgttccagcatcattttttgaaaaaacgaagatttctacattgaattaccctgggtcctttgttaaaagccaattaaccatattcctgaattttttattttttctaatgatctaatatgtattcttattgcaatatcacactatcttgactattttagcagtagagtatgacttgaaatcaaatattgtaagttctccagctttgttttctgtttaaaattttgtttaattactctgttttttgcagtctcatgtacttttcagaattaagtggtcaatctactataatgttttataggattctatattatttaattcactaggattacattgaaactatcgatcactttgaaaataatatctcaacacggttgagtcatctaatctgtgaaaagggaatatctctccgtcattgagttctttttaaatttcttggttatgttttcagtctatagattttgaaaacatgggttgcatttatttctgtttttaatgctttcatgctattataaattccattgttaaaatttcaatttttagttattggtgttagtatagagaaatgcaattaatgttcatgagagatattggtcttcagttttcttttgttataatgtctttggttttggtagcaggatattgcagaccccataaaacgaggtttggagaattacctcttctattttctggaagggttcctatggaattggaaatattttttgcctgagtgtttcatagaaatcatcagtgaagccacctgggtttgaatttttttttgatattttaaacaatagattaaaatgcttgatagacattgagcttttcaacatttaccactttcttcttgacagaactttgatagtttgtgtttttcaaaaacattttgcatttcatcttagttgtcaattttattggcttaaagatgctcactcatctttaccatcttttcatttctgtagaatctgtaatgatactcatataattttcttgatattattaatttgtattctctctttattttctgattggactggctaaggatttgtcaattttattaatgctttccaagaactgccttttgttttctttaaatttattttttactgttcttctgtttctatttaattacgtccttgacttatactcactatttccttttttctgtttgctttggttttaattttcttttcttgccatatagtctctttagacagaaacttagaccattgatttgatactttcttcttttctaatataagcaattagtgcaaaaatatttctctaattattgtttagctgttttttacccattttgttgcatggtaacttcattttcagtcagttcaaaatattttctaatttcttttgtgatttcttctttgaaatgtgggttatatacaaatgtgttcttttgtttttaaatagttgccaaatttcaagatactcttttgttattgatttatagtttaatttctttgtggtcagagattatacttcacatgatttcaatcctctttaattcattaagatttgtcttatggctcagcatctggtctcttctgggttatgttcttggtgtgtattttctgttgatgagagaaatattcaagcaaatcatgttagatgatagtttgttcaagtcttctatactctttccaattttctctacttgttctatcagttactgggagcagagtgttgaaatatctaactgtagttgtggacttgtctctttttctttgtagctctatcaagttttgcttcttatgatgtgaggctctgtcattaggtgcagaaacgtttaggactggaatgtcctcttaataaagtgatatctttattattacaaaatgtcccttttttccccagtaatattccttgtctaagatctacttcatttgacattaacaaagccatcctagctctcttttgattactgcttgtgtggcacaccaattttcatcttttcacttttaatgtcttgcttaaatgtatcacgggactgtgttttctccacccctccaccagtgcatcactcccattatcgagctctctataggtcagtgaatgggacacaagacagcgctcaggacagaaacttaggaaatgactccattcctcttttctcctacccatcaaggggatcctagtgattcttcagaaaacacaaaaaactcgtttacctgtctccacatccacagtacaaacctaaaagaggtcaagatcttcatgactctagagctcttgacctacctcctagctccctctgtaacccaccttcatgccatttcttgtaccagcagcaaggatgatcttaaatacatggcattatgaccctgctttaagtcccctggtcccttcccattgcacttcgaacaaaatgtaaattcctccccatgaccaagaagccctagatgactggcgccctgcttcctctgtaagcccatttctccttgtggaccaccacacttcggttcctcctggtctttcggcttcttgattctattaaattatttcttatctagagcctctgctattgcctctgcctggaataaattcacctgagtactttccattattagcatttaaactgagactgcaagcatgcgaaagtgttatcactttattcattcattctctcaacaaatatttgttcaatgcatacaagatgtcagacactaagcttcatgctgagaaggaaatggtgagcctaaagatatttggtccttgctctcaaggagcttacaattcaatggggaagacaggcatcactccaggaaagtgcaaatatgcactaaaagaagtcacataaagaaagtgagcccagctctatggaaaccaatgataaaatggaaatcaactgaggctgtaaataaggctttcttgaggatggattctttgaccatgattggaatggggagtaggagttaaccagcatactgtgaatccagtggtgaggaaaatcatattaatcgaaactttagttcatatacatgtacggttaacaagatacagtatgacaattttgatcagacaaatcatgattagtaattagttacaacatgctcaatgtggctcaatcttgtcatattatctgaaagtaaaattatggatttattatttcagtaaagaggaataatattttgcgtattattaggtagaaaagatttttttaaaagagtaataacaaggtttttttttaaaaagcaaactgattcctaactagtaaatttagtaaaataaaaacacatgttaatgatagtaaagattagcaaaaacaagaaatactttcatttccaaagctgcattccttaggcctcatccaaagatgccaaaacaattcaactcttcttttgatgtggacttaaaactagaggcagaatggaccaatacaaaaggcagagacatttgaatatttcacatttgtttctggggctgatacctcaaatggcctgggttggaggtaaagttagtcatctaatgtaccaaatggtgccatacttcacatcacttgacatattcctccaaattgacttcaaagtgtgattttacatttaagccccattttccttctgacctctcagctatgctgaaattaactaatgtcttatttacctatacatgttatttctgcctacctgtatttacccaaattctatttattttaaaaaatcgagtttaaaactaaactcttctccctcagttctcatctttataaaagtttctctgtcagcaagttctggtaatctaatcttggtgatatttagctacatattatcctgctttcctgtgtaactgtttcataggtgcgctacttgcatctctcaaatcagttaaccattgatgtttaataaatgactccaaaattcaatggctaaaaactatgaccatttacttagctcacgattctgctgagcagtttgtctggcctggttaggtactgctgatctcgctaggtcagcttatgcatttgaagtcagtttgagagtcagccaggggctgctcatcccagatggcctcacttacaggtttacggcagttggctgatgactgggtcacactgtgttcaagatctagcaggctagcctgtgcttcttcccatgggtactgggtactaaaagcatccagagggtaagctctactatacaagtgcttttcacgattctactcaaatcatttttacaactgtctcagtggccaaagcaacccacttttggataggaagacctataatgtcactatcaatagagagagagaaataattcgtggtcatttgttataatggaccatatctttagattaaaaaaaaaagaagcattttctttggaacccggtatcagtgccatgcatgtatgaaaggcgctcaagacattatatatatatataattttttttttttttgaaacagagtctcgctctgtcacctaggctggagtgcagtggtgtgatctcggctcactgcaaactccacctcccgggttcacaccattctcctgcctcagcctccccagtagctggaactacaggcgcccaccaccacgcccggctattttcagggtttcactgtgttatccaggatggtctctatctcctaacctcgtgatccgcccgccttggcctcccaaagtgccgggaccacaggcgtgagccaccgcgcccggccatatttttaactgaatgcttaactaaatgaacaggctgataaaagacccacacctcaggccaggtgcggtggctcacgcctgtaatcccagcactttgggaggctagggcaggtggatcacctgaggccaggagttcgagaccagcctgaccaacatggggaaatcctgtctctactaaaaacacaaaattagctgggggtggtggcacatgcctgtaatcccaggtacgtgggaagctgaggcaggagacttgcttgaacccgggaggcagaggttgtggtgagccgagatcgcgtcattgcactccagcccgggcaacaagattgaaactccatcaaacaaacaaacaaacaaacaaaaaaacaacgctcacctcagtctatttcatatgttagtctagtctctatgacaaagtaagtactttgttttttttgtggtaatactttagtgtcatttgcatatacattggtcaaaagaaatgggataactcaacttcttgattgggcaacatgaaatctgtaaattagcatgaatttccttcctggtactgcagaagttatctctgtattgccatagcaaactgaaatcctacagccctaatgatggctggaagattcctgacttcaatttgcaaaagtatttgtaaaaatgtcctagtctgagtttagggatgggtcatgtgtcttcagcaactacatgtcatgcaaatgaacttttgcattctactgagggatcaactgtacaggaacacaaaatgcaagagagaggagaggtttccgatcttcttagggcagggtgggaagaggtttgaaacaacagtggctgctaccacactaataccactcctcaacctcaaacctgcctccacctgcatctgttttaagaatgattttaaatagaagcaatatattcctttgagtttgactttatttaaattatggaaatcatgactctagtaaggcaccctaatggttcttcaagtctttggagaaaataaaaggtacagtgaagaaagccaagagaaatcctaacaagcttggtagtatttacatttggctttgaacaattgttaacactgaatgtgaatgtatacatcatttcatgcaatagctgtgttgtgacaataatactattaaaaacaaattcttggttcaagaatctctctttaagaattataggccaaatggctgcagaaagacacaataaggcagcgagcagttaattcatccaattaaaaaacagttgactgagcaataaacaattatcccaataggagcatatttcttatgggtgagaatgtccagaatagaaataaagacatttatgtggttggcatcaaagccatcccgaagaatgagcagaaacagtggactaaatgataaaagtgtagccaatcataaagctgttttttacctccctcccaccttccacagcatgatccactacacgagagaaaagacaaggatcattcctaggtcctctggaattaactcagtgccttgcacagtatcagtaataaaaattggtgaatacataatttaatagttcacaaagccaagaagcctcatcatactgcttaagtttgttttatcaggacttgaatttttaggttgaccggtcattgaaaatgcagattactttaactgcaatgggaagtcctgtggtttcacctggctctggaaaaggaaggaaacataagacagtactgtctggaggaaacaaggtcctctttcaaagcaaagtggctaactccagggcttcacatccaagcttatgcactaaacctgagaatgtaaaaaaagaaaaataaaattacatatgtcctgttttaagtcctcaggaatcaaatattctaaaatgtttggtgcaaaatgtgttttaaaggagcaatcagcaatgtcacagaattgaaagactgcgttagaaaaaaaagtgtgcactctactgggcttttgaaattgaaaattctatcagcaatttatcatattcaggtatttaaagtgtgcatatgaaatacatgccatgaattatttgtgacatttttatgatttagaaacacaagactattggttgatttccattgccatttggggcacaaattgatatatcaaaatacaagcttcagtttatcacacaagaagcagcaaaatgcactatcaatgccaatctgcctgttatcactattagcatactgcagtacgtctattacagtgcacgtgccgacaatgccctcctgacccacacaccattcataggtacttttgctgcccattggcacagaaaaagatacgtatgcaccatacaactccattcttccaactccaattctgcttattgggctataagtgaataattccaggttgaccaatcatattattcccagaaatctaatgtggtccatagaggtggactctgttagctctagacagctgatctggaaagtctgtagaaacaacactttgaggaccactgtgctgaccacatacaactgtggaagaagctggtctgaaggtagaaaaatatagacgagtgaatttgaagaaagaatgaaagagaggcaatgaggcccaaagatgctggcagctaaggagagtaacggctacttctaggccaggatgagctcctgtgacatacctacataatatactagtgtgtcctcccagtaaatacccttcaccaaagcttctgttccttctatcaaaatggtcctgtggcatctaatcttatctcatgtaaggggctgggtcagtggctaattcaaagcctaacatccactctactttaattaatagatggcattttactattaacagttgatatggacatgtatcgaacaaaggagcttcaatgaataaaacttttctagtttgttgtaggggcttatagaattgagtctctctcctattagagtgtaaactccttgaggataagatctaatctagtttatgttagcattacggtatctagaggcaggcggatcacgaggtcaggagatcgagaccatcctggctaacacagtgaaaccccgtctctactgaaaatacaaaaaaaaaaaaaaaaaaaattagccgggcgtggtggctggcgcctgtagttccagctactccggaggctgaggtaggagaatggcatgaacccaggaggtggagctagcagtgagccgagattgtgccactgcactccagcctgggcgacagagtgagactccatcttaaaaaaaagaaaaaagaaaaaaaaaaaaagagcaaaagtagtagtaggtcagttgatacattgataggccaatagttggcttttttttttttttttttgagatggggtctcactttgtcacccaagttggagtgcagtggcgcaatcttggttcactgtaacctctgcctcccaggttcaggtgatccccccacctcaacttccagagtagctgggactacaggtgcatgccaccacgcccggctaatttttcctactttttgtagcgacggggtcgccatgctgcttaggctggtctggaactgatctttaaatgattcacctgcctcagcctttcaaagtgctgggattacaggtgtgagccactgtgcccggcaaagagatggctttttaaaacaattatagttcatatccttaaaaagattgtaagaagaatttacaaatgtatgacattttagagagaaatattttagctctagtattctataaaaatcacacaaatctcctcaagagttgtgtgtcgggagccaattgtcaattccaacaaataagaaaaataattgaccagccgaaaccaaaaaaatacatagatacatatataaagtcatagttttctcataaacatcactgagaacattactggcagtattggaatatttgaatcaaaccgctacttttatactggagccattttagtttttttatttcatactttcatagctgaaatgaaatttcagctatttcagtgctgtattttacaatgttcttttcacagaagtctttgtcaggggtcattttttttccatattgtctcaacatttcccttcacttctgtttcgcttttaaaaaattatcagtggcatttgaaacaccacatattttaaaacagagtgaatcatagtttttatctctctgctgtatttaagataataatggatgttgagtagaaactaatcttaccactaattttagcatccattaaaaaattccaatcagtctcagtttgtagatctttgagtattttgtgaaactgtacatctattttccactgtcaaggcaatccattttcaaatcatgatcacaaataatttcttggaaagaaattacatttttactgttaaaggatttaaaagtttggccagacacagttttatcagctggaatgtaaaatccctaaaagtagaaaattgttgtcagttttgtttattgagatatttccaaaatccagaaaggtgctgagtacatagtacatgtccaataatacttctggagtaaataaatcaatcataccaagtgtcaatagttgggaaattttcaaaggccttttattatccttgtaacacaggtttgttaaatgaccctgggcatgtacctgattatattgatccttcaggcattcatttcctaaatgtgtactgagtgcctattatttatcaggaactgtggctcagagaaagtataccaagatgaatagattatagacagttctctctaggagttcacgatgaaaaggtaaatagaggagtgtacattctttgtatggcaagatgataaatacgacagacggtgaatgaataagacattaaataaatttacagcaaggagctgcttgtttctttatacatagattgagaagtataattgcagattccattatgcaaataaactatttcccctatgtgatcatctatgaataatttcataggtcaccaaggcactgatcaggacattaacagagtcatttattcaatgtaaatggcctattattatagcggaccttcaaaaatacgttatttgctcatatattaaaaatttccttgaaaataacttattatacaagtgctttccaatttatatagctctgagactgtgtccaactgatggggacaaaatagtcatttaacacaccgcagatcaatgatttcatttagaatatgtacgcggaaggttagttaagaactaaagggtcctgactttagactcacatgaaactgggttttgactccattcccatgaattattgactctttcagtctactgagttaagtcaggaccaagttttcatctatatgtacaaactttctgctggtgtcaaaaaatacagttcatcagaagaccaaacactgcatgttcttacttataagtgggagctgaacaacgagaacacatggacacagacaggggaataacacacactgttttgtgtgtgttgggaaggcagccagagggagagcatcaagacaaaaagttaatgcatgcgagtcttaatacctaggtaaggtgctgttctgtgctgcaaaccaccatgcacatgttttcctatgcaacaaacctgcacatcctgcacatgtatcctggaacttagaataaaataaaatagaattaaattaaatgtaaaaaatacagtctatacaaactgaggccacttatcaattatttgtattttctgatcacacaataatgagctcactccagtttccaattatattatgaaatattcataattttaattgacctcatcagaacccctaaaattatagattctattattccttacttaaaatttctctgaaaccaatgccaaggaactctgaatcttccagactcagttatccaagatggatttaatatttaacaaaaatacagcattgaatagcaatacttatcatttaccctgaatgtacaagtcctgccaatgaaaaagcacaaattcttgcacaaaaagtgaaagaagatatgctttgacataggatataacaaatacaatgtcaagtctactgaagatgtttaagtttggaattctttaaactacaagattttagacttatatatttaaacccttaactctcttataacaaagttttatgttacattggtcttctcttatcaatgggggatatcttccaagacccccagctgatgcctgaaaccacatatagtactaaaccctatatacacaatgtttttcctatgcatacatacttttagtaaagtttaatttataaaataggtacaataagatattaacaacaataactaataattattagttgaatattattaatgacatattataaaataagggttatatgaacacaagcactgtggtatcttgatagttggtctgataactgagatggctactgagggactaatgggtggggagtgtagaccctgtgaagatgctacatgtgaggatgattcacatcccagaaggacaaagcaggacagagtgaggtttcatcacattactcaaaacggcatgcaatttaaaacttagaatttatttctggaattttccatttcatattttcagactgcggtttaccatgggtaactgaaatcatggaaaatggaagcatggataaggggattgctgtacactcttagtaacagcaacattcacatgcattatttttatacagacttaaaattcaaaaacatttccacaaacactatctcatttaatgtccacaacagcccagtaaattgttgttattaagaaaaaaaaaacccaaaaaactatagttgaagagaccaagaaattgagttgcctaaaatcacagttagtaacttggttctctgcccttaagtccagcaccctttctctctcacaaacagatttagttttagggtgaatataagaatgtggaagatatttgtgcatccactttagtcttctttgcttgacaatcatccctgcttcaacatgatgaatgttcactttcaggtttggacacacctaagcagctctctctgaataaatctgccaagaaatacactaaaaatacttctattactaaataatagacttttacaaaaattatataaggaaaattcacgagaccataatctttgcaattatgtcatagaaagaaacttaaataagagattacatatgaaataatgctagttttgatattatttaagagttaaggagcccttaagtatctcacaaatgtaatctacttaatactagacctgagtgaaattccatagtctttcctctcaattcacactaagaactatgaatgacggctattttatctatctgctttaagaatagaggaatatatatatatataaaaagaaaaatgtgaagaagaggggaaagtagctactttcttatgaagcaaaaacaggattcagtagaaatattaggtactaattatacatcatgcactttagaaaacaaaaatcgcttatgtactaagaaatttttgtctctgaagccttcctaacacctcttaacaaattaataaaacaagacaattggattatcaatgaacaccatagtaatcaataccaaaatgactaggtaatgatctaatgaaaggacataatgtttcagtggaccttaaattttcattaaccactaatatcaataccaaatacttaatttcctccagaacagtggagaagtgatagaatatttcttcccaggacctaccctggggtacactaagagtatactcagacatttggggtttcttttatgtctcccgcttctacaaacctatccccaccctacacctgtcttttccaagaaacaagaaaagcagtccttacagactatcaagaagtaggaataatagtctagaatttttttaaaatagtatttggtatactggatactgcatattttttgtcagacatcaaacataagagggattcattttagctcttacttggaagaatgttttgttctcaaagagtctttgaaagaatagtgaagtgaaaagcatgataaaatgatgaaagatagctttgaaattaaactgatgtgaattaaactgatatctctctttctctctctctctctgcatctcttggtggcgtgactttgagcaaattactgaattccttgaatctcattttatccacaagtaaaaataaatagctgaacctgccacacaagatcatcttcagaatttctgagcggataaagtcctcggcatgcggtgaacactaaataaatgttccttcccttcccaaatccatagaattttaaaagacacaagattcaatacctggcaatattcaacagactcaaagtggtagtctcttctgacacccagtttggcagtagggtgtttctagaaatggtaaccctgggatcacctacaacagagcccctgaacttgattctgcttgcattttaatggtaggcgaggattttttatattagatgttacttgtatttttgaactataaaatattatacttatgaatataaatagaatatgttaaatggataaacactcccaaatatcttacattttaaaaattggaaaggaaatatcttgcactactaagactaaatggttttaaaactctgctttcttttaaataagagccatttctaactttgatcaaatggcctaatgttacctcattgcccactttgaaagaccatatggtgcatttacttgtaaatgctttgatgaaataatttaattacatcattctttccaagaatctggcttaggctgagattacacaaagagggaaattagctctattgaaaatgtatttgttttggttttggttaatactacatttgccacaaatctgcagatgtatgttgaaagatttgacatatcattcttatacctgcttgcttacacaattaagttattttaaaagacactggaaataaaccccccaaaatgaagaatatttaatagacagaaaatctttacaaattttttgatttaattgtttacaacaattcatagagaacattattaacaaccctagtaaatagctttgcataaacaatatcagatctgaatatgagagatgaagccaaaatttttggctttataaagctcacggattatttcagattcaggattgtactgggataaatataatctaaatcatagttgaacactaagtttggattatggggccgggcgcggtggctcatgcctgtaatgccagcactttgggaggccgaggcaggcggatcacgaggtcaggaggtcgagaccatcctgtctaacatggtgaaactccgtctctactaaaaatacaaaaaattagccgggcgtggtggcaggcgcctgtagtcccagctactcgggaggctgaggcaggagaatggcgtgaacccaggaggcagagcttgcagtgagctgagatcgtgccactgcactccagcctgggcgacagagcaacactccttctcaaaaaaaaaaaaaaaaagtttagattatggaactaggttctaagcatgcagaaccatggagataagcctgagtacaaatccagacaagttatacagagtgagttgtggatagtggtagtatcctgattacttaatatttattttataaagtttaagatttattaggttgggtcagcagtttaaagttataaataagggtaaaacagccaaactctgatattaagaatcatcaaagtataaagtttggcatatggtgagcactaaatcaatgttactttcctttctaaattaaaatgttacctcccttttcaggaggggaacatcacacactggtgcctgttggggggtcgggggctaggggagggatagcattaggagaaatacctaatgtagatgacgggttgatgggtacagcaaaccaccatggcacatgtatacctatgtaacaaacctgcacgttctgcacatgtatcccagaacttaaagtataataaatttttttaagttacttccctttataaattaagatttattttaaattaaaatggaagttgtataatctcctccggaaaggatcaagtctgggaagtttataaaagaacttgtccttggagataatttagtaacctcatgacatgagatttgtgcttaagctaaataaactgtattacaagggtacaaaatgatgatgatgaattgtggtttcaaaagtgaaaaggtgtcctgagattttgaatgtatgaatattttatttaaaattctataaagtgtcccgtttcaaattccacaatttaaagacagacaacatcagcaatcataccagaggtagttaagaatgcatttaagaagaataattataatgatgacagtagtgataatgttagtagtagctaacatgtattgggtactttttgtcatgcactatgcgttatattatttaatctccacaatgattctgacagatactctattgttcccattttaaagatgaggagattgagaaaagttaggtaatttgaccaatatcgcgatgctagaaagtggcagatttgagatgataaaatttaaaatatcaactactttcagaaatataacatgccagacttaaagacaaaaaaatccactcttgaaaataatagtaatgtcatctcaactataatttgctatgtgagattaacgaaaattcaacatagtagaagagtttacagatgagaaacttatgtcctcatagagaaaacagagaaaagtattacggtcaaggtcactggtgaggctacaaagcttttaaaatatttgtacaatcacttaacataaaatagctatttactgaacacacattatgtgccaggtctggaattaagcactctttaaattagacttctaattttcccaactaccccaagagtcatggccaaaaggtggcagagtcaggattcagaccagagaaaccaatctgtcctcagagcccatgttctcagccatcgtgttatgacccggggcatttatacaccttcaatcttcccagttttcatttaccaagccttgttcactaggacatttttgagatacctttttcctacacaggacataaaacactgcaaaagttgttacacattttagataaatgtgcatttcaagagacctagtcctccatgttaatattcaatatctctctgatttatgtctcagagatactgactcattcttgaatctcagggctttgagatgcagtataacctgtgtgcttgagagggcaaacctttggatgacctttatttctcaacatccgtccacccaagataagtccgtgtcatggcccaagcgccaatttacatcccttagcttctgctctcatagaagtcactggaatgcacttctaagacaaagtcttcttagtctcatggctccccttttttttaatctctcccaaggattccctacactaactattcctattctgccgttccattcaactctattgtcttttctcagctccaattctgttttgataataatcctgactagagtaaaactggcaatgtaatatcttggaacagaagacttttaagtttgaggaaaagatacatggaagtaaacttatatgcactagcagtacatgtaagggaaccccacagttagggaaggatttgcatatagatactcacaataggcacacttcatcataaccagttgaaaggagttagcatctccattttataggtattggttttacgtggcagaaacaacacaaattgtggcaattataggtttcacacaactatatttcagttatacccaaaaataagaatgcttgtcatgaaattccacttgcactaaatgttagctccttctacttcacataagtatgaaaaatatcttcaaatacatcagcatatgcttagctaatcttaaacacctcaatcgatgttcaatgcctttttgtgctagcctactttttcccttctgctatgtgtctagttagttaatatagctttccaatttacaagaaagcagaaatatttcagatcaggtcacgacatcaaatatcacctgcaaacagtaaatatagttttcaaactcttacacagtgttagtgagacaagtgaagtctgctttgcaacacctccactgatctgggattatatctaagcaaagtggatgcatgctgatcctttcaagaaggtgtcccggggaagatctaagtagtaatcacttgaagggactcaagagcaccactcacgatgtgctgaaatgcagaaggggacaaagaaggaaggcaagtctgttaatggagcttcatgattacttttgcaatgttactcatacatgttaaaccttatgaatagcagtcttaatcttttaacttacagttcagagccaggctagcttagtcatcaagagtatgaactttatttgtcaattaaaataagtaaaaaaaaggacatcagatttttttttaaagagcatgagctccaagtcagatggatggaattcatgtcaaaatttggacctatcgtatttaagggcaagctatgcacatcctctgcagaagactgtgaaaaaaagaaataaggtattactaccaaaatgcttctaacaatgctcaataaagagtagttattttatccctaactcagaaagatagagagagggcccatttatggagtacacaatattaagcactgagttggtgttttccagaaattatctcacttaatcttcagatgagatgttatcatttcagttttacaaattaggaaactgataatcggggaattagatatttgctgaagtcagacaacaaggaaacagtggatttggaacttaagacacatctgtctgatcttctggcctttttcacatttgaggagaatatagtaaagtttagagtcagttggctaattttcacaaaaccatcgtttgtgatacaatagcattgcattatttctgtatatcatttaagtgcttttgtcaggagaaatgaaagaattaaaataaaatacatttctagctaaataaataattgcatataggaggaaataataaagattaaagtaaaaattaatgctcagagaatcagaaaacagtaactctataaataaataccctcagtttttaaaaactctaacaaaataaacaaaccattggtaaccttgatcagaaaacaaaaggcagaaggtaaaactatacaaaatgagaaataacatgaagaattagctattgaaaaaaagataaaatgaaataagtagcataagtaactacagacatctatgtatacaagtttgaaaatttagataaaagacacagttttccagagaatcacgtgtactaaaattgactccattaatggagaaagtttaaagagatcaatttccatacaagaaatagagaacattattaaggatgaatatcataaaaaacaaccaggcccagatagtgtcatggtaaaaatctacaaaacatttgaagatcaaataatctcagtactctacaaattgctgcaaaacgttggaaatgaaagagacaatgtttccttttactgagccagaataacgttgatacctaaacctaaaaaactttgttcaaaagaaaataaatctatagacctatattgtccatgaatatcaatgcaaaagtactaaaataaatgttggcatgcatagtattatatatcatattaagaaaataatgaatacaactaagtgggatttattatagaaattcaaggttggttcctactaggaaatctattatgatcatatgcaatatgatttttccatatatgctgaaaggccttaatgaaattcaacattcactcattataagaatattcaagaaattgaatgtgatttttaacatattaaaaatatatatttgtcaatgctaaaattggtattttaattggacaacactagaagcattcctattcacatcaggaacaaggggaagatgctagttatctccattactatctattattttactgaaagtgttaaaaaaatgcaattagacaaaacaaatctattaaaggtattagaattggtagagaagaggtaaaagtatccctacttatagatgatatgatacctgaaaaacacttaagaatcaataataattaatgttaattcccaaatcgtaaaataatttagtaaggcaacaggatatgaaattaatattcataaattaagatattaatccttcatgtacattgcattataaataaataaccacagtgaaggggatgggaaagaatagaactaagctaaataacttttagaaaacagtgttttgaccgcttactccaagcccaaagacaaggaaaagtatccatacatattgtctgattaaaggtttgtttttcagagtggtatgaaattgcgactgtgagactacattgtgtgtatatgaagattaagcaaataattaaataaattgatgatgctgagagtgaagtttctcaatgttaaaaagaggatactgagagtgaagtttctcaatgttaaaaagaggagttacaagtaatggaagggatttggctagaatgaaccctgtgatgctggactggaatcaggtgcctcaggatgaactcaggaatgtgtgtgtgtgtgtgtgtgtgtgtgtgtgtgtgtgtgtgtgtacaaactgacataaagtagagatgtgtgcgcatatgtggatgtatatgtacacatatttcctagctctgtcaggtgacctagaagcaatggcagaagagcaatgagcacatctagcactcagattttgtttccaaatacctttcgctaagaaaaagagccaaataaccttcacagaaaggttgattttgggaatgggtagatattagcgggatgaagaaatggagcaagatgagcccgcaagatcttgtagtgccacagtgagcatgtgctcaaaatttcgtggcatcagagtcaccctgaaggagcccccaatggccaattctagaatgagagcaacaaactaaatgatgataataatgaagtttatctcatggaataaaataaagaaccttgagtccataccaccaataagtaattgaattaataggtaaggacaaaatccttagaatgaaattcaaattcaaaatacaaaaggaatgatggatatagaaaatcatcatctcacaaacacagtggtaagaatcattgatggaagctaaaatttgtgggcaaaagtttatgagaaaacaggacattggcatagtctcaaactctttcaccataagatccttattagctacaagggaaaaatataaatttatagtggagaaaactgacagactccacctcagtcaagtgatcaaaattaacatcaccaggaatgagacgtgttgacatcatgtaactcctcatatgacacactgagaaagtcacagtgtagcctctgcagtattcgtgcaaaaatttttaaaacctgaatttaatcatgaacaaacatcagacaaaccagaattgaaggacattctccaaaacgactggccagcactcttcaaagttgtcaaagtcataaaagattgggaaagtctaagaagtaccccaaatcaaaagagagtaaagagacataacaagtaaatgcagtcggtgatcctggattggatcttaatacagaaaaatgacatttgtggcacaaactcataggaacagagggtagaatggtggctacaaggatctggggaataggagaacggggagatgttagtcaaagggtaaaggtaaaagaataaaagtgaaaaaaaactatggtatatttacaaagtttactgttctgcatcagcaaagcagatcaaactgttgttataaattatacaacatggatcagccccacagagatgatatggaggaagaaaatcaaaatagggcatagtgtgtcattccatttatacgaaattaaaaaaaccgataacatgaattggtagtgaaaaaatgtattctaatgagtacttctgggggtgttaatcaggacaagtaacagaaaggcctttgggtggatgataatgcactgtatctttctatttgtgaggcttacacgtgttatttatggattaaataacactcaccaagctgtacacttaagatccaggtactttatcataggtaggttttaattagtggagaattatgcaaaaacatttattgaatgtattcttttgtctcagttttcatagtttaaacgtgccattttatcagacagaactttctaaaggatgcaattaaaaccaagtattaacttctgagattgcacttcttcataaaacaacagaagagaagcagaattgttttcttcttcaatgcctctgctgaacatgtatgcttcagatatctgttggtcactttcgatgatgagaaaataaaatatcctggtttttgctataaatgctaattattccatctgttcaaagcgtttatttcttctttaaaaatggagggaaatattagttatcggatacaatgaagttcagcactttgagatatcttagcaaaatatttttaacatatgtgtaccaaaaccgattgtttttaaagaaaaaaacaaattttaaatgagatattatattttcctaaactatcaaaatgtctctagctatatgaaggtgctaatgcaaagcaatgcatttcaattttcctcaacactaaaagtaaatataattttctcttaattataaaatttccagaatttttcatctgtagtaactccaaattagccagtgagaatatgttccagttagctagaaaatttacttatttatgactcttccgttcaccaatattgccaagtaaagtcatttacagatctgggaacaaagctggggtgctacagtaggacaatttggataatcatatttcccctagaactttaatagaatttcataacatacatatattttttgtccattatattgtagaggtcttcttttgacttttattctattctattcatacaataaagttttccaggtcctcggaatttaactctttcttctgccattaccaatttttcaaatagtaggtttgatctaattaccaaaacattattagaatctaggtagaggcatgttattattttactagctaatgatctccaggagactttggaattaatatagaccactctgcagaaataatgaccactgaaatgagggccccagcacacactgaaatagccacactcaaagaagattcatttctttaggagtttagtgaaaatggagagattgactaaagtaatctccagaaagcataaagattaaattggctcctaactgagaaaatgctaccttagcactcacccagttctgcctttatgattctttgacactgatgtaagcaccacagaaaggaatatcaaggtggaattacataatcctttcttcaaccaattgttagcgtgtttgctgtagattaaaacactgccacaggcttctagtggttggcaactcacactgtggaaaatgtcactgggctttgctgcctcactagctgtgctccacagagcagaaaattaagcgcaacatatttggaagaggagttttctggtttgtaagaatttataaaaatagctatacttatctattctagggtcatatttgtaagttattagtagctctgagataaataatttaaatttttagtacatatgctaaaatcttagattattctgactcgaaatctagctaagggtctcttaggtgacttaatttctgtttctaatttaaaagatacatacatacatgggacaataaaatatttttgaatccatggcacgtgaaaatagactgcaaaaaatcagtatctaaaaccatgcatttctgcttcagtttcttctgattcctgtccaacatagataaatctgagtagctagtcagttatcagttatcaaagtatgagtttcatcatgaatagcttagatttgttgtacaaatgtggtgctgcaaattgaatcattaatcaaagacatactaggctcaaatttattttattctatacattttgtttgcactatgctaagatttaaaattaataaccttgctctagtaagaagattgtttaggtatatttcaaacactcaaatgtgtttttttctttctgttaaaagcaacacgtagtttttccataaaaatcctacctcacggattgccttatcacacttaatttacaaatctggaataaaaccatgaggtgcaacagaataagatcatcatggaagaaaaatattcacagtactatttctagaaaagctcgcataaactttcgaaatggcatcaagccacctgtttgaatcactcagaggcatttgccaactttaccaaaacaaggacacacctttctgtctcctgccagttttctttcttcccttactttgttgtctcatgcaacctaaaatagaagcatcatatcaggcttctagattctgtctgcagtatgataggtcaatttcattatagatgctgagaactccagcctttagagaaaaatgctctcaaatctctccctctcctcagcactttgcccctcatatgtttgtaggtggcactctcatcaatactgctttctctaaccatggcttggtaaggcaactctctgccttcttaatgtcctatcgatcaagctaatgacatttacttagcacctactcaatgaaagtcactgttctgcttgttgtgggggatacaggtatacataggacatgaagtggctttctgtaaacaaagataaatgtcctctttatttgtttgtcatataaagtagcccctaatgcctgaatttccttcatcttctagcagtcaaacaatctctcacccacttacccacacttgacaacttgtcttttccataacgtttctgtttgaattaagaaaagctaacatttccccacccaggacaaccacaatgcagaattctgtactcactcttgccttatgcccttaaaacacacactcacgaccagtatttcatggcaatgtctcagtctttacgcttatttgacttaatgcttctctaccaatgattttctgtatgtgaatccccgttacttttgtaaatgtgggaggaggaactgcttgtaacttgtggagcactgagcacgtttaagcactggagccctcggtgagtatgacaatcatccacctggattacagatggtcctcactcccgaaaagtcttctgggcagaactgcatggcaaaaggctgtagtcaagtacagttatcatctgcaagaaagcccgcatttgggcaacaaccctggctcagcaaactcttctatttaaaaagatctaccgtaagtcaggaatttgtagcatttaaaatacaagccctcacacaccaaagattttctgtcttcaactgttcactctgccttcagaacacttggctgtttatctcctcctttgttttgctttgttttatcttgttcttcctttctctctaggtcccaggggataaactggctcagtaaaggcttcccactgagcacggggctgcgagtcacaattccttgatgatcacccaccccaagctgacatgtttcaaatgacctgaagtagctacatctgttcagtcaagttattacaaggaccttcgaaagtgagccgcattctgagcaaacaaccaaaagacgggctccttcccattcccaggagattgcaacctccgtgtgattggcagttttacggtctggctttctccatcacaggataatttcctcctcattgtaaaaagctttctgcagccttctgctttttggctcttttttataatgagcaaatttggcttagagaaaacttttcagactgagaaggaaaaggattttacgtcttaaaaccgtgaaactagtgtaagatatttaaaatgttatatttaaatatatatgatatataacatacacacgatatataaacatataatttatgtatatattaatatatgtttaaatatatatttttcctccactctgtttttcaaggggtttcttaatcctgaagtttagtgttgggctaatcagttatatcaacttttaggcactttgaaatcactgtcgctctgaaaaatcaatagccaaacaaacataagaactcaaatttataatgcctaagttgctgtgagctactgtaaatttaaccgtagaagctgagtaggttttgtgggtaaacgtgtacaactgagatgaatgagactttcagactgaggcaaaacagcagtgtgaactggctgttgttaccgccatcgacaggtaaggagtctctgtgactcgcacatagttgctgctgttggggctcgttactttgaactgcaggaccctgaaggggcctcaaaagcaaagcctctttctggccttctgcccttctttctcctactctcctttctcccacaaggcagatgatagaaactagggtttctcttccccaaggtgagtcacagaaaccagaacccctctcctccaaagccagtcataaaacctagaacgattactctaaccttcctccaccttgctgtgtggaagatggtcatagagaaatctgacctatctccttccagaaggtccctgcccaaacccaggaagacggaatgccacacagagggaccagaagaatctggacacgccctagttttattacccttagatgaatatctttttgtccgatcacatttctacacagctgtacattcttcattgaacctaagcataaaaacagacagctttccttaagtctttgcctcttcattttctgaaggctcccatgtcacgcaaacctttgattaaatgaatttgcaatgcttttctcttgttaacctgccttttgttataggggtgtcagctgtgaccctcatgatagggaggaaaggtatcacatcttttttgcccctacactgctcctcatcttcatgggtcaagatgatctccacacatccatatctaaggcacacaatacccatccttgtatatacatgtctcaacagccactcattattgttaaatatgggctggatttttaacaatattcaagctacctaagaagaaactagaggtacaggcagcctcctggctttttctgcaattactctcaccaaaaaaaaaaaaaaaaaaaaaaaaaaaaaaaaaaaaatcctctctacacacacatcagaatggctaaaacaaaagataatgacaacacaaaatgctcgccaggatgcagagactctgggtcattcacacattgctagcgaaaatgtaaaattgtacagccgctctgggaaacagtttggcagtgtcttttaaaactaaacatactcttgacatataactcagcaatgacactcttaggcatttgtcccagggaaatgaaaatttatgtgcacccaagaatctgtacacaaatgttcatggcagctttactcataatagccaaaaactggaaccagtccaggtgtccctgaacaggtccatccataccatggactactacctagccataaaagggagctgttgatacacacaacagcttgaatgaatctcaaggcaattatactgtgtgttaaaagtcagcccttcaaaggttacatatggtgtgattccatttatgtaatattattggaataacaaaattatagagatggagaagagattagtgggtaccaggggataggaataaaggatgtgtggctttaaaggaatagaataagggtgccacatagttacggaaggttctggatcttgattatgctggtggttacacagatctacatacgtgataaaattaaatggaacacacactgtctcacacacactcacataaacagaagtgcatatgtaattggtgaaattgtagtgacttctgtagatggtgcccacatccatttcctggttgtgatattgtactatagttacacaagttatcttcggagaaaactgggttaaagttacatgggacaatccgggatcttttttttttttttttttgcaatttttttgtgaatctataatttcaaaataagaagtataaaaatgaaaaagagaaatcttctcttgagtctcccatactagactagctgctgctctctgcttcctcttctgcttttttaatagaaaacttctcaaaatttatctacttgttgcctttaatacctctcctatgctatcttgcatctgctccaatcatagctctgattctttcaccagctcccaggaaactgcccttgtcaagatcaccaatgacatctatgttcctgtctaggggtcagctattcatctccattgcacatctgtcactccaggcccaataccgccttgacagcaggaagtgcaccgtagtcagttggactctgtcttcaggaggactttgtcttcacttcatggactctcccgattttttttttcctgatgagtggctccttcttggtctcatttggaggttcttctctttttcccagagacccattcccttggtaaactcatcccgacccctaggctgaaatagttacctatacactgacaactccctattttatacctctagtccagtctcttccctgaatcttagacttgtatctaacagccactgcaaatctctacatagattaccagtaggcaccttaaaatttacatgaccaaaactgagctccagataccccaccaaacctgcccatccccgttttttcctatgtcaacaatggacaattttatatttctagcaacacaagtcaaaaatattggtgtcatgaatttctcctctcatgcatcatgtccaatccatcagaaaatcctgttggctctactttcaaaatacatcctgaatccgaggatttcccgccacctttactgttatcatcctattcttgcccactattatctcttgactggattcttgaaatagttttctatgttgctactctgccctcactccctacatgcctgttccgtgcagtaaactaagtgctcctcctaaatcacaagttagagcatgacattcctctgcccaaaaagaccctatatattttgttgtttgttacttttccgacctcttcccttcctattatcacctttgtttgctctgctctagtccactggcccccttggtctttctaggacgtgccacatacatgtcacaggaccttagcctttgttgttcctccagcatgggtagccacaaggataacactcccccttcaccattcaggtgcccacatgacacctttatagatgaattcttatctttccacgccttgctgttctccaaaggactcatcatctgtctgtctgtctctctctctctctgtgtatatacgtgtgcgtgtgtgtgtgtgtgtgtgtgtacgatataccatttctttctttgttctttctctttgtttttttccttttttttttttttttttgacaggctcactctgtggcccaggctagagtgcagtagcaccatctcggctcactgcaacctccacctcctgggttcaagtgattctcctgtctcagcctcccaagcagctgggatgataggtgtgtgccaccacgcctggctaatttttgtatttttagtagagatggggtttcaccattttaattaggctggtctctaactcctgacctcaaatgatccacccgcctcggcctcccaccatttctttctttgttatctgtggattcctacacaaatgtaaacttcaaaggacaggatttttgtctgttttttcacttctgtattctcagtgtctaaatcttgcctggaacacagaagataagtcaatatataatcgtggcctgaatgaattatttaaccaattatgcaagtaattttctatttccaaataagagaagagttggtgtagctggagtagcctacctcctgagaattctgaaaaaccagagtagctcatctgctccactgactgacatctctggcaacagcagctgacaccgtctcactgctgcaaggtcagctagtcagtgggcccagtgcttcgcagcgcctctccactgattaacaaacaggcccctttggagggcagggcctatgtaccaccttagtcctagggattccacagccctatggcagtgagaaatgcagctggcaggaaggtagttacctgtgctcctcactgcttctcaacgcagaaaatctgaaatttgagccccagtgtaatcagcactgtgagtttgtagattataaatatttacatctgtgcttgcccaaggctggagcttataactcaagctttgcctgttggaaggatcagatggagtaacagagagcataaaccgttcactcaacaaatctttacaaaaggcctactggaagaagtccctgttctagacactggagataaagcagggaacaaaacagccaataatcgtgattccatgaagtcgatatttgagagttggaaggaagcaaataatatacatgcaaacaaacagataaacaatacaatttcagataatgattagttcagtgaatctaataaaataagatgataaatgactgaaagatttctttgaaattgggtgatcatgttattacgctgtggtgacatttgagcacaaatgtgaataatgaaaaataattagtcctgagggcagaatggtccttaaagaaggaaaagaaagttaaaaggcctttagggactaatgtggcatactggagaaacaaagaaagaaggccagtgtgtgtgccgcttagggagtgagaggaagttagaaaagatgaagatggagaagtagacaatcccagtgacctcaagtaaggagttcatgctttactccaaatgcaaaggcattagagatataactgcagactactcactctccattgttttcttcatgtgaagggaaacctagggcctccctcttgttctcgtgcctttgattggtgagtttagtaggaagaactgggcatgaaaggctcagtcccttcctcttgcctgcagagagcagggctcctgtctgctttgggcctagggctgagctttgtggccacagcttacctctgtagcacctgctgtgcaggtattcggtgctgcctgtggcttctgggtcagttcatctaattctggtgcagcagcaggaagcccaggctggcactcactctgccacattctccaagagctctgttagtaatagacctgacagtccgttctccatgtgtttaactcttttgtctccttctactgctttaaaatgctggcggggatgagggagttataattaacagccttccctctcaaactcctaaaggaagcttggatgtttttcttttctgaacaagaaatacagtgatctaatttatgttttaaaaagatgactctagcttttatttagggactgaattacagacagagggaaatgaaaagcaaagatattagtgaggagtgatggggttcaggacatgctaccgtaaaatatggcacctcggtatttgaaaacaatgcagaagtgggatgatctctctgacttctccttccttctcctctgaaccagttcataaaacctagaaataattttctgatcttccgctggagtagatcataagaccctcatgtgagaggtgcccttcctggaggaaaggaacgtctttatcgctgaagatacagggacatggagaagaatccaaacaaacaggccttgtacattcccttcattagatcataccccctttttccagtcatacttcttcacaacgatacacctcttcatcaaacttacaagtacacaggttttcctgtttctttaaatattcatttctgaaggctcccgtgtcacataaaacttatattaaataaatatgtatgcttttctcttgctaatgtcttctgttataaagacctcagccatggacctagcaattggtggggaaaagataaagcaggagaatccctctgcacgagactactatagttatttaggatagatacgatggtgccttggactaggattgataatggcaggcagagagagaagggtaaagaattggaatatacattcaagcaggccctggaagcaggccctgttctagacactggagataaagtagggaagaaaatagtcagtaatcttgattccatatagtctgtatttgaaagttggagggaagcaaacaatatacatgcaaacaaacaggtcaactgaagggatttataaacctgaggtaaggatcataaaaaattagtatcaaatatgacttctaggttctgtcttgagtagctgtaggtaatgaatagtgacttatccaagtgtggttctcaggtaaagagttgtgtagacaattatggagcttagtagagaggtctggaaaaataatatgaatttgggaattttcagatggtgtttaaatccactgggcaccatggaattacttagaggaagaatatagacagaaaaaagaggatggctgaggatagagctccaagaagtgtgctaaagtttaattttgtggcattagacagggtggaatggaatatgtgtacttgggagcaaattaaaatagaaaattataaaacaggaattaatgtatttcattttatagggttacattagaaaaaggacaaaagtgagacaaagcaaaaggagtgtctagaacagacttacacagcagaagctaagtaagtaggatgtgagaggaaatggagatagaagagaaatgcgaatcaaaaggtggaactcacgaaagtgaaagtgaagactttcatcttcagtggagttatgcaaatgaaatattttcacacacataaataatgataaacatagataaataaagcaagtttggagaggctggtgagaaaagtgaagtctataattcagtgttatgaatacagcactgtgtagtcaaaaggatttgctgtagggagtgaaaaggaacagagaatgttgatggaatgaaaagagaatcaaaaaagtgtgtttaggccaggtgcagtggctcaagcctgtaatcccagaactttgggaggctgaggcaggtggatcacctaaggtcaggagttcgagaccagcctagccaacatggcaaaaccctgtctctactaaaaacacaaaaaattagccaggcatggtggcgggcacctgtaatctcagctactcaggaggccgaagcaggagaatcacttgaacccaacaggcagccattgcacttcagcctgggcaacaagagtaagattctacgtcaaaaaaaaaaagtgtgtttatacttacctattagttatgaaaagagtcaaaagatgagacaaagataaatctaaaccttatctatagatacattctttgtagaagaaatcaacagaaattatagtttttctgtcaagattttggaagaaactttctgaagaaaatttcagaagagggcttcagggagtgtctaagaaattaatatcttaataataatgtttctatgaaataacataatatattttattgatatgtgcaaataattttacttcaaaaaattatctcttttgaagtaaaacacattgcgcagaaaataataattttcaagaaatcctgaatagccaaaacagtacctaaaaagaagaaaaatatggagaactcatatttcctgatttcaacactgtaaagctacagtaatcaaaacattgtggtactggcataaagacagaatacaggccaatggaacagaatagacagttcagaaataaatctttacattaatggtcaaatgatttttgacaagggtgccaagaccattcagtgaaaactggactgtcttttaaacaaatgcttctgggaaaaatggatttccacaaacaagaaaatgaaagtgtaccctcacctaatgctacatataaaaattaattcaaaatggatcaaagatgtaaatgtaagatctaaaattataaacccttaacgataaaacaaaagcttcgaaacacttaatttggcaactatttttttgattaacacaaaaggcacaggcaacaaaaaataattttatcaatttttaaaaaactgtgtgtcaaaagacagtaacagcagagaaaaaaatggccacacacaaaacaggagaaaagatttacaaatcatatatttgataagggattaatatccaaaatgaatagagaactcctaaaattcaacagctaaaaaccagaagacctaatttaaaagtatgcaaaggacttagatagacatttctccaaggaagatatacgcatggccaaaaggcacatgaaaagatggtcaacatcactaatcagtagggaaatgaaaatcaaaattagagtgagataccatctcacacctattgggatggctactataaaataacataaaataacaagtgttggtgaggatgtagagaaactggaacacttgtacactgttggtgggaatgtaaaatgttacagccactataaaaagtagtatggtagttcctcaaaatattaaaaatagaattcctttatgatccagcaagtcaacctctgggcatatactcaaaagaattgaaagcagagtcttgaagtgatatttgtacaccagtgttcacagcagaattattcacaatagctaaaatgtggaagcgaaccaagtgtccatcgatggaggaatggataaacaaactgtgggatagacatatgatggaatattattcagccttaaaaagaaataaaattctgacaacatgaatggaccttgaggatattacactaagtgaaataagccagtcacaaacaagacaaatgctgtatgattccattaatgtgatgtacttagcgtattcaaaatcacagagacagaaagtagaatggtggagtccaggggctgggaagatgtgggaaatggaaagttactgtttaatgggtacagagtttcagttttgcaagatgaaaaaagccctggagatggacggtggtgatggttgcatgacaatatgaatgtactcaacaccattgaactgtaaatggtaaaaacgtttaagatagtaaattatatgttacgtacattttaccataatgaaaaacactggatgaaaatgttcaaaaataacaatttcaggactctgaaaaatcaaacaaagacatacaagcaactgaaaggcatttaatcaagagaaaatactgaactttggctaagaacagcaggagtctctgacaagccattaaaaacagcagtttcactgctggagggccaacttgacttggagaggagcaaggaaaaccccaatccccttggcattactggaagcaatgtcgatggcaaacaaaccagaaaagccaacatcacagctaacctgcgtttgcaactctagttggagcaagcaacagacttggcatactgacctaagatttacagggagatccagtaaatgaaatggccatagtggccttgataagctccccaatattccttgtggagataaaaaatgtaaatgtaagcctggaaatatgcacacatgggcaaggctgcatgcacacagggaaaacaaggaagggcccgggctatccacacatccctgattgcatgtgagtgctcgcacatacacaggggagacacaggaaataaaaagctggggcagaatatcaccaaacttgatgttacccaacctacacagggatccttgggaaaaggtggaagccacattggctcaaggtgtttaaacatacactgtaataattcacaggataactaagctgtcctaacacagtgagtggtaacttccaggaaaccagacttaagagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagtcaaaaaacacatgaaaaaatgctcaccatcactggtcatcagagaaatgcaaattaaaaccacaatgagataccatctcacaccagttagaatggcaatcattaaaaagtcaggaaacaacaggtgctggagaggatgtggagaaataggaacacttttacaaggttggtgggactgtaaactagttcaaccattgtggaagtcactgtggcgattcctcagggatctagaactagaaataccatttgaaccagccatcccattactgggtatatacccaaaggactataaatcatgctgctataaagacatatgcacacgtatgtttattgcggcactattcacaatagcaaagacttggaaccaacccaaatgtccaacaatgatagactggattaagaaaatgtggcacatacacaccatggaatactatgcagccataaaaaatgatgagttcatgtcctttgtagggacatggatgaaattggaaatcatcactctcagtaaactatcgcaaggacaaaaaaccaaacaccatatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaagtaataaaaaaaagatttttaaagatgcacaatcatcaatatgtatacactgcaggggatacagacttcatagaattagttcagacaagaaatgaaacaaacagtaatggcaataaaacatgggagggagtgcccagaattgagatgctgccatatattatttaaaatgtgtagtttaaaaaaaaatccaactcctggatttgttgatcttttgaatggtttttcgtgtctcaatccccctcagttcacctctgattttggttacttcatgtcttctgctagctttgggatttgtttgctcttggttttctagttatttttgttgtgatgttaggttgttaacttgatgtctttctaactttttgatgtgggcatttagggctatacatttccctcttaacactgccttagctgtgtcccagtgattctggtatgttgtatctttgttctcattcatttcgaagaacttcttgatctctgccttaatttcattatttacccaaaagtcatacaggagcaagttattcaatttccatgtaattgtatggttttgagtgaatttcttagtcttgatttctcatttgattgtgctgtggttcaagagattgattgttatgatttcatttcttttgcataagcaaaaccctccatggatcaaggaagagatcataaggaattaatcttccttgtgaatattaacaataatattccttgtgaacagcctttatttcaacctgaatgaaaataaatgcatagtgtatcaaatcttgtaggatgtaggtaaagcaacgctaagagaaaatttacagttttacacagcaatattagaaaagaagaatctgaaaacagtaccctaagcttctaccttaaaaaactggaagcagaagcgcaaactaaacccaaagccaacagattttattatgaaaagtttcagaagaggcaaatttattgtgacagaaagcagattactggttgcctagggcttggggtggggaggaagactgactgtaaacaggctaaaggaatccttttgaagtgatagaaaatgttctaaaactaaattagaatgatgattatgtaaccctataaacgtacataaaatcattgaattacacaactaaaatgaatgaatttaactgtatgcaatttatacctcaataaaactattaaaatataatgacccaattggcagtggaaaatatgcatatggatatgtgtatgtaccacaaattaaagaaattcaatattcttaaattgagctattccgtgttaagcacaggcatgaatttgaaaacgagaaacttatttaatcctgttccttaaaattgtgtaggcaataaaatatcctcttctaattttactcactaaaaataaaatacttaaatatagtatttggctattgacaacttttgaaattaaaagttctatttaataactaaatgttatttgtccctaaggtattaagtcaaaagctggctctgtaaatagcttggcaattactcataagttttttaaatgttatcagcgtaaacttgtcttgtctcacctctttagcaagatacactgatttcaagtggaattatattaatgttgaagtaagtaacagtaattttggtgaatgatttatagacatactgtatacgtactgtcaaaatgaccgagatatactttcaactgatacagtcaggggcaacattctgcaataaaactgatataaatctgaattccattggtcaaaatttcaatataaaatggatttacacaatcctgaaaccctgaaaagaattcatctgggtcctaaatactgaataatcttttaaaaatgtttttaggtgtaaataaatctatgttaaatcaaaccatttggaattggaaattttgaaccatattaagggaagttggggaattgaatttttcttggaaaattagggttctgagaaaaaataatttagattctttcaatttaaaagcccattcatttctaaatctgatggaaaagataagaactaaaaagagcatgtcatgcactgtcaatacaagaattatttcttgtagggagtgaaaaatcttagacactatcatgatctgtggccttcctagggccagagtacataaaccaaatacagtatacctgtgatattaaagtgtcattggggaatattcagaaaaaaaaaagtctgaaaagaatccttagtggggagataatttaaaaaaacgctgagaaacactggtatagaagacacttctacagataaatcaatttatttggctctacctcccaacgtccatggaaaaaaaaaaatctcactataggtaagagcctgtgggttacctttacaaaactgaactctttctacttgataatgtgaaatgacattaagaatgcaagaaacatttctagagcatatctagaggctgtatccaaaaaatcaagattgtttctcatctttaagccataaatcaaatgaacacaataattacatataggcaaattacaaagttatctcacagaaaaattgatcttttgatttttactttcataatatgtaaattccatgtaaaaatccagtatacggctctgtcaatggcaaaaaaaaaaaaaaaaaaaaaaaaaatcttgtacttttcttatcctgcagctgctgaataaaaacagtgaaaactgtgctaatttagtacactggcattttctttgctgacctaaattataaaggactgacttcaagaccatcaaggaaactaattttaaacactaattacatctagtatgtaatatagttattcaaaagtagcaacatagatgcattaaaagaacttgcgtagtataacttcagaacagttagtgcacatatcgttttcagaattatttgaaaaataaactagccaatgtcaaatcttagtttgatttgattcattacttttagggttcaaagatgtatccattatgatccctttcctaattttatcctgagttgctttcactccatcttaccaagtaagttttctttacaataaaaaaattgcaaaacttcctagctgaattcaatgtatctatttctttcagtataaagaatcaagttactccttaaaaattagcagttctaccaatattattccaaaaaaaattatatgtaggaatagagggcacattcagaaatagtaaagcagcttcttcaagaaacttaacacttggggaggccgaggcggttggatcatgaggtcaggagatcgagaccatcttggctaacatggtgaaaccccatttctactaaaaatacaaaacattagctgggcgtcgtggcaggcacctgcagtcccagctacttgggaggctgaggcaggagaatggcgtgaacccgggaggcagagcttgcagtgagccaagactgtgccactgcactccagcctgggcgacagagtgagactccatctcagaaaaaaaaaagaaacttaaaattttttaaagaaattactactttagtatttagttggccacgtattttctcaacaattttcaaaatttgatgaatcttgatgaatcaaaaatttgatgaatcttgttttatcaacatttcatttgtataaggaagcataaacattacacacatatgcaatgcacacatttttaatgaccttcaaaatgatgggcaacacattagactatattcacgattctaaggaaaaaaaacaatttaaatacaattttaaaagttttaaggatagtcaatcagaggcagcgtcttggctaaattttgttctaaaatttaaagaaatttctaacaagtctatactgtctaactgccgcaatattatctcccactttagccaatggtattgaatttttatgatttagatactgtgatggataatttgaaatgtcaccttggctggaccacagtaagcagatattttatttaaaacatctggatgtttctgtgaaggtaggcttttttataagatcaaagtttaaatcagtagacactgagtaaagcagattactctctaaaatgtgggcggacctcatcgaatcagtagaaggccttaagaaaaagaaggacctatcccaagagcgaaggaattctgccagcagacagccttcagactcacatcaactatttctgggtctccagtctgctgcctacttgaccttgcagatttagacttgccagcctccaaattcatatgaaccaattctttaaaatctctctctctctctctcatacacacacacacacacacacacacacacacacacacacacacacacatcctattggttctgtttctctagagaaccatgactactgtagatttatatttttttctaattttcaagatagtataatattactaaaggttttaaataaagtattaataatgcccaatataatattgaaatacaaaaattattaaaattcatggttctctctatgtagataaaaagagatgctggatggatagatggacagacagacaggagagtagagcaagcaatatttctcccattccttctatttttctatggcaaatatcgatgagcagtaactgtggagcaaagtaggttaaagactgcaggcaagtttaaccgacacagctaaccagcatcctacactgcatcagggatatgcagctctttttatcagggaaggaaacatgttcagataagcaaagatggatctctaaggtcacaaaacctctgatggaagagccagaaatagagctgcctctccttatatctgagatgtactcttcagttgaaataacttttcctaggtgtatgttccttaatatgtatgcatatgaatataaacccgtgtgcacatatgtgtgtatttgactatatatgcatatatgtttgtgtatacatgcatatgagtgtgcgtgtgtgtgtgtatttcagtgaaaaatcctatacctggcaaacaatatatgtttgttctcttaccttgtctcctgctgacaagagatcccaaatcttatcttcggattataattgtaatcaaggactagaatcattccccaatgccttcgttaccacaactgttatttctttttttttaaatttaaataacttaatattgtctgtttgcactggaattaggatctcaatctaaggaccttgtcttattcttcctgcacctaaattaaaatacctactgaatagccaggtacgcaatgtgaaacagaggcaatgactcacttcaatgccatagtcagtgtttgacagacagatgggcccaggctctcggggaataaagaggacagaaattttgcccagagtgaaagggaatgagagtgtgtgaatgtggctgggggattagtgaatgtgtttagggaggaattcatagaggtaacaaaacctagtataaatcttaaaggttgaaaggagaaagtcttagtaaaaaaaaaaaaaaaaaaaaaaaaggcggggggaagaaaagtgatctgggtgatgaaaataaagcacatcagggctatggacacacaaagggccaggaaggggacccagctggagcagcctggaggagggtgtgatacggttatgatcgcattgctgtgacaattgctgttacagaaggagaagcagggagcaagactgaaggcgggaaaactaattaggaagctagagctttagactggaagagaaaaaaggcaaagactcaggtgttaggacacaggtaataaggctataggtgaggggtgaatttgaaaaactacttaggcagcaaaaaattcaggtcctgctgaatgtttagaattggatgagagggagaagcaatatgaagaaaaatccaaagattttagctgagctagaaaatgtagacagaaaaacagatccagatcagggcaagggaaagaaaagcaggaaagagatgataacaccatgaacgcaaagttcctgtggaacattctgacggagaggttcactaatccattgaatatgggggtttggagctcatgaaagaagtcaaggtggaaatagagatttcatgaccagcagtacatgaggagttaaaactatggtaattactgagatcacttgggcaaagcaccattgttaaactgggatcacttctcatcgacttttcccctagtcctcagtctgtttatctacattatctacctaatcttgcttaggacttaatggtaccaagtattgtctcttcttcccagaagaaaaatgagtgaacttggatcttcttcccctccagagggatgtggcaggttgagttgctatggattctgaggaagagagaggaagaagcgcccctaagtaaaagctttttattccatatctttacactgcttgtccattcccaaattctgctgtatgtgtatgcatatgtgtgggttttttttttcagaaataagacctgtttgtgatattcatgtaatacatacaaaaatacaaaggaaacactcgtcacttcctcccccatctgaagtaaccagccaattatattttcagtaatatatcattccacaatagtgggcctagtgttgtacactaggatgggaagtacatacctctcctatcctttggtcaaaattaacaacataacaagaagatagtgcaggcgtgtacgcatgcacacagatgcatgccatcaaagtcaataacaaaacaaaaagattcaggagacatagaggtagcatgaccagtagagaagagcagttgttgtagttgtattcattcatttgacaacaattagttgtcttaagtacatttgcaggtgtctgagatataagtgtacataagactgccaatatcctcacggagtttatagtctagccaacaaaacagacaaatgaatataaataaataaatacatgattacaacagactttgttaagaagtcaaatatatgtggcttagtacagggctgagagagaagagcaatggaagagaaagaagtacattcctctcctatgcaactgcatggcattgagaaatcttgcctttaacatcttggttttagaacttgcattttgtttgctttccataaaatatttgttagagcagatagcatcacatgcgtttgtgatttcaacagacaaccctcttaacctgcaaagaatcagatgactcaaaccctatttcacttcaaatgttatttgctctcctgctctatttaggactgccctaagctttttggtcacccttataacttctgtttttaattattgagtctttaatcattgcctattcaaattgggctttatgtatctaagtctattaggaataaaaatgcaggaagactacaaatgtatgaagatttcacacagagagtaaatattttgtatttgggattagtgtgaggcaaaatggtaaaaaggcaaagtcagctttctgaatacatcatcctcccttttggcccttccttcagcaagcccttttgctgcagtacttaatcctgtcccatcaccttcatgtcctaattcacatcaaggtgttgctgtttcaatttccagccacaaagaaggacaaagtaacaggtgttaattcttaacctaaagtaatgtatctctctgaacatagaatattaagaccaggctgctgttcttgggtagagaaaatcatctcttcctttaaattacactacagcacatgcttctatcagcagtcaagctgcacaccaaagatattcttaaaagccatgtaatttcaatgtacttaacacatagaaaatgttctaagatggagatagatgggagttaaggagaaatgcaatatatggtttatgtcttgagaaactttggcttgctaggtcacaaggtacacagaaccaggtataaaatggctaaaacctaaatattaatgtgaacatttaatacatatcatacaaataaatactagcatttcttcattactacttcattcattcaacaagcctttaccttgtgtttactgcttacaggcactatggaaggcagtggcagtggacagccacgatatggccttgtgaggggttcagttgagtgacgacatgatggtgaatactcaataaatatgtgctgaatttataagctcaaaatagcatgtgctggagatacccacagcatgtaaagaggaatagaagagtgtcactactcctgactggaagtcctggtgttagaggaaggggtatagatttgtggactaacagaaaagcaagtctcactgctgctggagttgagtcttgaagaaacaaaagcagaggaaaacatcctttgaaaaggtacagatcaggccaggtgcagtggctcacgcctgtaatcccagcactttgggagggtgaggcgggtggatcacttgaggtcaagggttcgagacaagcctggccaacatggtgaaaccccatctctactaaaaatacaaaaaattagccaggcgtggtagtgcacacttctaatcccagctactcaggaggctgaggcatgagaatcacttgaacccaggaggcagaggttgccgtgagccgagatcaagccactatactccagcctgggccacagagcgagactccatctcaaaaaaaaaagaaaagaaaaaaagaaaaggtacagatcaaagacaaaacaaacaaaataaaggaaaataatgcacataactgtgtacagctgaggcactgggggtgcacgggtgatggtcaacaaagctcctagagtcagcttacactaaaaagtttggcctttattctgcttagtgtagacagtgggcagccactgagtacatttcatcaagagaaaggcacatttgaattttggcaagatcactctaataatgatggtgtcaacaatggattacaggggaggaggaaataaaacagctacagtaataatctaagagaaagtcatgaagtcctgagtaaggcagaaactgaagacaagcaggaggaatggacaggaagggccagattcaggagatattaaagaagcagaatccatagaaagtggaagctataaacactgggcaatggaggtgagaaaacaagcaagtgaggaagtgggaggcatcaaaggaagctcctaggattccagcgtggaggaaagggaatccaaggatgaatgaaatgtaactcggccatctcaggccaccactgtttgcacctggtgcccacctccaggttagctagatcaaaacatgcatctgcacacacataagcacatatgtacaggtgcacatacacgcatatgaacaatcacacaatctggtgatcccttcctctcatctacatctcttctttttcttcctctcgcctctgcaacatacacactctggaattttcagttgacacctttatcacatagagtatttattagcccttatttcttttctttaattcgtctctcattccccactcagccaaagaaagggtcctccctagacttgcatttctcaggaatctggacagtagttggtgtaaacacttagttcaacatatttatcctgtctaataaatttagataggagcaagtttgctaggaaagataagtatttctgttttggatatattgttttaagtaggcaacaattggagtcaccgaaaaaaaagaaaagaaaaaagaacctgaaagcatttaacaatataattcaaggagagtataaagacaataaaagtaatatttcactctatagatgtaaagggacatggttttctgggaaaactaatcacagaaatgatccacactaacttataatctaacaaagttacttgtctgtaaaactaaagaagtatttggagagccaggcaaaaagactatttatatggggaacgcatgaccaggctggccactgaccacatatcactgtctagaggactatggaacaatgcttccaaaattcgtaagaaaacacaaacacacaaaaagaaaggaatggaaaatgtaacttagaaattttatactatcccaagatggcatggaggtgaaaaagaaacataccaacattttttaaaaatgcaaaaacattaagtaatatattttccatgagtattaatttattattgaaagtactagagctacccagagatgaatgaaaaaactatagcacaagattggcaggggcactgaatctattcaatggcataactaagggtaaacaaatgcaggattatggctatacaagagaagacagatactgcatgaaaagttgaaaaagagtaaaaaaaatgacatatagtttaaagattctcattttctcttctttaaatcttgagatgacatatcatttaaatccagtaaatcacacaatgatggttttcagtgtgttcaccagtaaaaaggtaaatgttaagaaatacaatttgccagtaaaataccaatacaatttaccagtaaaaaggtaaatgttaagaaatacagtcacgtggtgtgacaaatagttaagaagtgagaaaatacagttatttcaacattgaccatattagggagtgaaaaaaatactgtcctaatgaaatataagtatgggtaacatgtcaatttgtagtttaaatatatctactagattggaaataaagaaaaggaaatggacaaattttaactatattaatagaaaaactgacaagaaaaaaataaaatatcacttctcttctagttatttagaggatttattgcttttcaaacaaataattaatgcataattcacataaataaatttgactcacataattttggaagaaaatccagaaattaaattgtatttgagcactctatgattgcgatctcttctttcttctaccttttattagatgcaattttatcactttaccatagcactttccactgatttggtagttttcacctaagagttccaaatgtgtttttcagtgaaatattaataaatgcatgctgatgaggaacgaagctacagaatgacagtcaaagatcatacagcagtatttggattcgttgaattaaattaatccaaaaattttggtcctgttaatacttttcacccaacttgagcttcaacaggaatggaagttttattgttagcattcaattatatattaagcaaccaaacatattctgtcttttatttgctcagcactgtgccacaacaatatatagctccaaaagccacttgtctacttggtgataaatagatttaagttttcgaaactgagaccaaccaacctgagaccaaagctatgttcttctttctaaagcaaatgattttctaagctttatttgatctaccagagcctcctagattgatttgatttcaacattacaatgaagaagcagtggaacaatgttatttcactctcatcactgtgagttttaaacatcatactagtctgtacacactatggcagggctcaagatgtatctgtgcaaaagcctggtaagtaagaagcaatagaataaaatcctttcaattgaattatgatttgagagttgaatttatcatactaaatgttttcttcaaacagagtacatccttatttccagttaatatttaagactatccatacatcaagctcattgcttacagatatgcaaaacaactgtttttctcttcatcagtttaaactcacaatttataactgtgatatatagacatttggcaaacacagatgattttaatttataatgcacctctatttgatatatcaatataaaaggtaattctatagattatacaaggagaagaacctttcagaagagcttgaaaacactgaattatacttgatgatagaaagtatcaaatagatacctaaagccatcatgaacttaaataatgcttggcatctataaaggaattatttcaaatacagtatgtcggccaaggcaccaaccagctgttaatgtcactgggctctcctatgcaacttacaaaattatttttgagtatattcagtaattacttttggcacatactccagttccataacctgttctcgtctatctcaagagctttcaatctgattacattttccatgatgtaaaagcacaactccctttgtggaatccacgtagaaatcactgaattctgtgttcttcctccctttgctttatctcacataccccatactgttattaatggttatttgaatttcagtggaaataaaagtgatcaatctttactgcaaccacagataataggcatcctagtactcctatttcaaggcgtggtgtttatcatttcttaagaaggaatatccattaatttaggatataatagttttagaccaaagataactaatgtcaagaggaaactttctatatcagaagaataactggccttcagtcttaaaagaacagtcttgtaagaaagtcagggtgtatttcaagaacgattctgagcacttggtcagtgattcttaatgggttgtgtttctctctgtaaatcctcggtagaggtggaattaattttatttaacagattcatcaggcgcttattggacacagagcagagccctgggttttcaggtgttcgaacttggcattgtgcattggggcactaaactatcaacctaaaaccatctgaagtacacttaaaatataatttccttgacaatggttatctagattacttaaagattaggtgatctggtgtgagtataactttggcagaagtttctgacatcataaattctgaatccatccagtgattgaatagaaagaattgttcacttcccaacatattaaactttcaaaggtctgtgactctgccatacaagccaggcatttccaagagctcggaagtcactgttatgcatttcccattctcacacacacacatacacgcttgcacacacacagttcagtcataatggctacatttgtggatgatgctccctctagaactggatgcacaagagaataagaaatgaccagtgatgcaccctgcctcttgcaaactggagagagcatttactaccattctcatccactcaagaagagaatcaagttctgaatagaaaagaactatcatattcctctaaattcatgattcccagattctgagctaattttcttatgaaaatacattgcttaaaaatgtcaagtatttataaaaactctaaaatgaactttagtgattggccatggttttgtcagtttgagaaaacatggaatgtattttgatctcactgagatgaataataaacatttcctttcaaaggataaacaagttttattgaagagcttacactccttaggaattttaaattaacttaatcttcagtcacttacaaaaaaattcttttatattgtccttatattatgacatgtaaattattactttcttataaaatacataatccacactattgagtaatatacacacagtcatgattcactttgaaaagaagccaaaaaaattcttaataaaaatggtgttggaatggaaaatagcttatctcatacactgttggtggcagtgtaaatcagtagagccttttcagaagacaacttggctgtattaataaagagtatgtacctttgattttcaaattctacaatttggaatccatcatttataagtataatcatatatgcacaaaactatgtttaagaatgtttgttacattaataatagcataattacttaacctttactgagcatgtactttggagtatggccaaattaaatccatattacagaatgatatgaaatctatctatttttgtctatgtgtttttatatatacatattataaaatatatatatcacttttcaatcttttttctaatatataacatatattagaaatattgtatataaaatttatattatatatatttgaaaaaagtctgcaaagatactacaaactatggttatctatacggaagactactgaatgggggaggtgtggaatggggaagccaggaaagaggtaagaataaaagtcttcgcattttacattttatttttcacatttagttttgtgttacttacattgaacatgtaactctatcacttttcaattaaaaatttagaaggtatgttaacaggaccaatgcaatacattataactttttaacgacaaaatcattctgtataattaagcttaaacatctaaagagtatggtcaggaaatagaattaacactcaaattgaggtaggtttgattgtcttattggtaagtaggtttgataccttgagacgaaatatcaagatttatcttctatgaacctacaaactgaattattaaaaccaaaatcaacaaataaaatcaagctcttagagtgcttaagaatccatggtggggaggcacactacacaatttgaaagcacctaaggtgctccgtacctaatatgtactccatcagggtaggtatcttgtcctcttgagaactttaacttactacttaatctgaacccattttatctgtttttatttccaactctttcctaaatagatcttccctcctaacagcttggttgtgtcacagttccataaacaccattccatgaacctcattcattcttactatttagctctgcatttaataaacttggggttcctcctcagctaacatcctctctcctgggagctctttgacaactacacacccaccactcccctccagagagagtgagtccctgcttatccatgttcacagcatgtgatctcctgtgccgcgtgaccacagttgataggaccaagggttgatcctttactcatgatctaaacagctcagatgttctctcttaataatttaactaacagagtcaagactgaatcaattactagtagttcttggagctggaaaatcatatagaatgggaaactatggaagccccaggggctatgtgtactaattatttagcagagagagtcaggttgcagacatttaaaagcagaaacaggaaccaggtgatgagagaacaagagaggagaaaagaagagtagaggagatgggacaggaatagctgctttgttccccaggctttttagctctactcccaagaaaacccagtgtgtcttcattttctttggttatccagaatactactgccatcttttaataaatattttcttagagaagctaatttgacaggctttctgtgtcttagatacctgatggggaacttcccttttgactgtccctatatcaattctacatctttcaaggcccacccaaattcttcctttttcttgaatcacatgaaaagataaggacatgatgccaactcataccaatcattcctgaatacatcacacaaaatctgcacttcataatttaagctgagatgggagcaactttcacttgtgaaacaatgcctttgatagactataactcactagactgaaaccctccttagggcagaggtaaagtgttgtatttcttcaatagtttctataattggagcactccagtaggcattccagaaatatgttaattaagttgctgagcccatgttccaaaaatataactgaatctcactcaactgaaataagtaattaagtatagattctaatataaggcattgagatctaacaagaatatttaaatgaaagaagagatccttaaaaagatgttttgtgctagaaaatttaagccaattttgaaaaatgaataaaccaatatacattacttagatatttaaagcacatgtggcaagcattaatcccatgttcaaaactcagatgcaatctcatggagaaataaaatagagcaagtgaaatattattgctaatgtgttgtactccttacacacaaatgtccttccaggaaaagaataaatgagatagatgaaaaagtcaagtaaaattatactcatgactatgaataggacttgtagtttaaggattttaataatgaggagtaatatcacaaacatacacttcttgatgatttcccaaatatcacttactggaaaataaaacgaatatcattacattttgaaaattattcttgttacagtttccactaaaacaaaagaaaatcaccacctcttcaaaattacaatgacctttaagaagttgccaatttaacaaggactagaggggagtcctgggcatttgcccttgactgcagaatgtaagtctaccaataaataaaaatggagggtaaagactcatagaagaaagggagtcagatattaacacattctttcctttgctttctactcacaaatcactccctttccccctttactatagatgatctatgtgaaggttggttacttctatacatgctcccagtctcaagaagcataccaagctgagcgcttaagggatataatggagaatagaatctaatctagcagatattcaccataaactctcttttaatctttaccaaactctgacttcctatctgtgcaccccgttctggctttgccatatcattaatatgtttcccagaatcttaactctcggcttgtatactaattaacgaaactcatctccttcactcagacacagcattgatgagatacatctttgtcatttgatccactgttccagcatcaggactcagcctctcttgagatatgttccagaaggcagcttaatgatgcagctgccaatatggttctccactggtacatacatgtgacttccctccctattgacctgattaaagcagatgtattacagtgtgaggcacaccctattttcacattcgaggagctttagctgacaatcaagaatactcatttaatttatttccaaccaaccatcattaatttccaactggcttatcatacatagtatcacccaggtggttaacactatatattttatagttaacgattcaaaatggttgaaatagagatgatgaaaaagacttccccatgttaaaattattgtgcttttgctccctaaagcctagaagtttgactttgtatggccattcttctatctattggagtgggcctacaattgttttcagagatgattgcatgatacatagacaaatagatagacataaaaaatgaacaatctgataactattcaacagtgaagtgcatttacatcatataatataagcagaatgatgcccaattgataaaagctatagtgagcatatttcaaaagaaccagtcctcaggtaataactgatgaatcttctacttactccaaaatcttcaaaaataatcttctgtggaataaagtaaaagtatctagatgggtatcactaattatgctgtctgttatttcatacttaagatgtgtttcttacctcctttctaacagtctgtcctgcttttcctttctgttaattccatgttctagcagattaagaatctgacaatggagtcccccgtttcctactcctttgacatttaaccttcctctctctctaacatgtttgttcaaatcctattcagccttcaaagcccaactaaaacatcaccatgtttaggagatctttcttgatttcttcatactgataggctctctttccactctaaggttccaggcacttgcttattgtattagtctgttttcatgctgctgataaagacatacctgagactgggtaatttataagaaaatgaggtttaggactcacagttccacgtggctggggaggcctcacaattatggcggaaggcaaaagacacgtcttacacggcggcagacaagagagggagtgatagccaagtgaaaggagaaacttcttataaaaccgtgagatctcatgagacttattcaccaccaaaagaatagcacgggaaagacttgcccccatgattcaattatttcccactaggtccctcccacaacatgtgggaattatgggaattacaatacaagatgagatttgggtgggaacacagccaagccatatctcttatatttatctaattgttcttatgtcacccagtacagcggaatggctaagagtcagactctgcagtcagatgcagctggagtcccattcccagcacacctcactaaactttaatttcttcatatatataacgaggataattgtaagagttaccttgcagcattttcaaaatattaagtactcaataaagtttagccattattagatattttaaaattatgcattatggttgtcagcatttatttccatattttgaaattttttctctaagaaaaatctactaattgatcatgagaaaaaaaataactggggccaataaaaacagcattatgctttttttttttttttttaagtattacttcttggtatgaaactgttttggaaagttccttactctgtaactaataaaaccactggaacaaatctggaggacaatcagttactttgcaattaaaaaaacctatgttttgtatatctcaggtctttggctcctgggtttaaataaaatacttacttgctaactctaaaagataggaatgctaattcagtttttggaaaaggctatatgaaaaatgaaacctttcctgtattctttgttttatatttcatgctatctcacatgtatacaattctcacttcagtatactactttaggcataataaagatttaagaaagatttattaaataggtctcctgaagttgtttaaatcaaacacgaatttgaccctgcagttcagcaacataggttaaatggccacacactggattacttgaaagccagggcaactaagaaccttggaaaccaaagaatgtatatagggccagccagtatatcagtaactgtatttagaattcacagaggataaccagccatgtctttccattacattatcttgcctaatagaggtcaaatgactgatctgcctgctaacagagtttagcaaaggaatcagaggttaattaccttcactcctttttacaaaagctaaatgtcctaagaattactgcatcattatccagatagaacaaaagcacaaacaaaacattaaaacattacctggggaataatgttctaatattcatctaactgaaaggtcattatctctagaactttaacttttaaaattcaactactgtgcaagcatatttattaatgagtaaaataatatgtacttaaactcaaaatatttagtacattaatgggattttcatggttttcattagcattcattttccttttccttacataattaaattttgaaaatataatcctaataaaatgggcatgtaagatatctccctctagtttactggcaggagcttgtactagaaacagcattagacagggagataagagacctgggttttaaacctatcagttactgaacaagctctgtatgcacttagacaaaaccgagtatccttgctcattaaaaaaaaagggatgtttacctatgagaatcaagtagaactgctttctgactatgctatgtagaatgcgaagtgattaaacatcacagattattatacttccttttgataacccacataatatgaccatgtgactgttttaagtaaccaaatggagaaaacacaaatatcatgatattgaaggaaagaagcagaattgttccatctccatttgaacctactctactggcacatctaatccacaagtttgaggatgagattaagtgcaaccatttcaatggctcctaccaaataaataaaataactctggatcaattatccagactcagggaaatggaaaagattagtgtaaaacaccctttcactctgctaataagatgtacaaaagtcaaaacagcttccatacactatggtaatgtcataaaatggtaaattgagccatgcgacaagcaatttcaccctctcaaataactttggtcaacagcaacgagacttactcctaaattgagtgctaatgacagaattgaagatattattcaatattctatctgatggataatgaaaagtaaatgtttaacctacctaatatcggctttatccaagtttcttagggtccagggaggacatttgcagagctaaattttcattgtgaaggcaactgcacacactaagtctgatttcgaaagatctctctcttctcagagaagttattaagttaatatgttgaaatttattagactagcacctggatcttagtaagtgctcagcaagttgagatccttataattattattattactgatctgataaccatctttgtgttcatgtggaaccatccagtccactttgatgacagaatgtaatagcagggattagttcattttcatacaccatatcttgttcatcaaaggaattttatttttcatctttggaaaacaggttgaaccttttaagagcaatagtgtgagttttcctttgttattttttaacatcagggctaactctagatcaaatactctctctatatttcctcgtactaatatagctgaatttaccctatcctcatttatcatttcaacaatcaaaaaggtcagaatgccgaccaatcgagaaagactacctagcctatctgaaggctagaccctgtaatttcacaggcagtgtcttctcagaatactattctattgctttttattattagaaaacaaacaaaaatctatcttattcactgacctagtaaacatgaacaaccccaaattttccattaactgatattagaaattagaatatctttgatgctttgttggattcatcctacatctttgctttcaaagtttttccaacccctgctccttttctctccactccctttatcttctttgctgattccgaactccactgtggctgtaatgcctccctaatgcctgcaacagtgcctcattgccatggaaataatcactttaaaaaacaatacaatacaatacaataagtaataatgaaagcttaggcaggctgtacagtaggaagggagggtagactcagaaatagaacccagacttactgacactaacagctactcccttaatgtagtccttagatcactaaattcctctcttattttcactctcattttcatatacatactctccgatgatctcaggcagcatatagattttgaataaagaaaatgccaaagtagcagtgagacaatgaaacttgttcgataattatttgagatcatagctagtgtacaacctgtatgttcaggaaaagttagctctcaaaatgccctcctcagaccccctgaaatctgggtcaaaacggcattagattggatatttgtttttcattcttttttagttacatcatcacaatactttcatttttttttcccaaaccttagcagaaaactctgttgttgatcacatctgatttgagagatgcagattgctggttgctgccaggaataatgtgtcacattatataaataaataaaacaagcgccatgggaatgagcagtaggcacctcacagaaaccaccgggtagcatccaattgacaggctgttctaggaaaagaaatctacagattcagggctgtcaccatccagagacttctaaaacaagatacataatacaaatacacacaaatataatacattggaaagtaaatttatttttttacatgttactttcattgctttagttacgaataatttcatagtagtggtggagccatgtggaatccagttagagtaaacatgcctgtaaattggcactaatgttatgctgttgttgaaatcacttttgtagagaatatgaactttctgtaggtatttagaggaaagcttatgaaagcttttcaagcacagaaaagcacaaagaaatatatggaatgagaactgggactttaagaagctgcctcaaggatttagaaaatggcctggtgtgggctaaatgaagtgtcacatttaagggtcatttcctcaacaaacatttgaatgtgtttgtgacaagggattgctgggggctggggaagggggtggctacaatgatagctatgacttcttcttatgtccccgttctaatatagctaaatttatcctatcctcatttatcattttgacaatcagaaaggtcagaatgccgaccagatcgagaaagactacctagactatctgaaggctagatcctgtaatttcccaggcagtgtcttctcagaatagtattccatttctttttattattagaagacaaacaaaaatctgactatcttattcactgacctagtaaacatgaacaaccccaaattttccattaactgacattagggactcaaacattccatcaggagattacagtccactggatatggcaaattatcaaatataactatagtccatcatgattaatgtcacattagctataagtagaagcaagaatgacagtgatgtaacagttttaagtgagctgtagttgtatagccagtcgacctgtccaaggtcaaagagctggctcagagttaatacaggtgataatgggaaaatatgggcatgagttttcttaggtctatagagtaatgagaaagatcacatatgcagagtatttaaaaggaaatagggatatgggcagcaactcttttagagaccattacaaactgactgtctgggagaacaacactctgaggcccaggtatgtgagaatgaaaataagcaaacagaaagtagggctatgtttagaatggagaagatgctggttaaagcaaaagaaatgaggcaaagaaagaaagataggagagcatcaggttgcataataggggtaattagggtataaaatctgtggagcatgactgtttggggtgaaagagaaatgtggcctctataatattctgagataagtaagagtaaactacctttctaagtcactcgcaatgaaacaagatttaagttagtatggggatgatgctgttattcttcaatatttagggaccacccattgtgttctaaatacctaaaccctcattggaattgtaataaaaaccatgggactggatgaaaaggataagatgaagaaatgagggagcaaggttgagtgaaaaggtaggcaatatcaatcagtcaagaggcatttattaagcctctataacaaacacacctgcacagcatttttctagattctttggggagtaaaaaaagaatttaatagtctgattgggaaataagccacatttgagtgaaaataaaccacacaaggctatacataagtaattaatgtaataaagatttaagctgggccatatatgtgaccagacgatgattttaaaatgttattataagtaattgtgatggaagtatattgtttaaatggaaataaatacacttcattttaatttcatgactattatgctgcttattctagggcatacttctaattatgtctcttgctcataagaacaaactgtcttctgcactatctctaagtccagtgctttctctatgacattttgggggacaactaagctgtctagaataaatgcacatacagcagaagggaagaatgaagaagaaatgcagctgaggaagttaagtaaagaaaggcacaggtttgggaggctgaggcgggcagatcatgaggtcaggagttcgggactagcctggccagcatggcgaaaccccgtctctactaaaaatacaaaaattagtcgggcatggtggtgtgtgcctgtagtcccagctacttgggaggctgaggcaggagaatcacttgaacccgggaggtggatgctgcagtgagctgagatcacaccactgcactccagcctgggtgacagagactccatcacacatacacacacacacacacacacacacacacacacacacacacacactcaaaaggcccaggtaatgaagtgtctcttttgccaagctcaggaaattggactgttctctacagggactgagtgcctagtggggaagaatcggggtcagcagtgtggaggacggagtggaagctaggcataaacagtgagctaaagtcatatttaaatctttgcaatatttcaagagacaaatgaggctctgaattagggtaagggcaatgctaaagagtgttaagaaatgcagcagacaggacacagtaaagtaaaacatagagaggggaaactcaagaatgacactcaagtttctgattagaggatggtgaagctaatgaccaagaaggagacggtttcgaaggaaaaaatggtttcagttttgcacatgtgcctgtggcacatccatagggaagtatgtaggaggtagatggatatgcagcttggaacgcaggagacattccttcacctggagatactagagctaggggtcattagtgaagaaagccattggagctgcgggaaagggtgagcttgcctagagggtacatatagttcaggaacagaaccattaggacaatggcatttaaggaatgggtaaaggcagaaagaaattggtgaagaaaaataaggagtcatgttgtactgaaactattgcaggtaagatgcccaaatttttctttatcacagtctttacaaacttcagacttcatattaggaaggaaaaagttactctcccccacccgctggctattacttacagccaaagacatcttaactgtaaagtatctgatataattttaacaattatctcatatacgtatcaggaaagtaacaaccacaatgagatatcacctcacacccatcaggttggctactatcaaaacaaaaacaaaaaaagaaaataatgtcagtgaggatgtggagaaactggagcccttgtctactgttgacgggagtgtaaaatagtacagccactctgaaaaagtttggcagttcctcaaaatattaaaaattgagttgtcataagatccagcagttccacttctgggtatatggccaaaaacattgaaagcaatgtcttgaagtgacacttgtacacctatgttcatagtagcactattcacaataactaaaaagtggaagcaacacaactgatcattgatggatgaatggatgaacaaaatatgatatatagaaactatgaattattattcatccttaaaaaggaaggacattctaacacatgctacaacacggatgaaccttgagaacattatactaagtaaaataagccagtcacaaaaagatgaatactttatgattctacttaaatgaagtgtctagaatagtcaaattcacagcaagagaaataaagtagaatgatggctgccaaggggtacgggtaggggaaaatggggagttctttaatgggcatagagtttcagttttgtaagaggaaaaatttctgaagactgattgcacaaaaatatgaatgtacttaacactactgaactgtacacttaaaaatggctgacatggtaaatttaatgttctgtgtaatttactacaatggaaaattgtataaagcaactgaatggtgacagcaaaaacagattgactgtagaatgattttctatgattggttaaattaaatgatttttattttcttctttatcttcatggattatccaaaattactacaatgggatgtgtaccttttatagtcaaaatagaagttattccaatgaactagttcacactacccattatacgcaaattgatgtacatctccaatgtgctttcagagcaactgcattattctgttatattctgtgtcacgagtttgctgttggcacacaatgacgtctattaagatgcacatcaattactataacctgcaattaataatgcatagtttaaatattactggtgaatagtcttcattattaaatctagatgtctatttccttcatgtttctaagatacttctacttcaagattaattcatttaatttaactgaacatcagctacatgtagggcactgtgttagtccctccagtggctacagggctaaatgaggtatggtttttgatcttaagaaatacattctaatagtgtattgtattgttctccaaaatattctctgcccttccttatggagagaatatatgtccccataccatgttggcccataacaaattgtgtgaaaaaaaaaaagatgtattcctcccccttttttcttaattaataaatcttatgtttttatagcagttttaggttcacaggaaaattgaaaggaaaggacagaggtcccatgcacccctgtccccacatgttcacaacactactgacatcccatatcacagtggtacacttgttgtaattgatgaacctctattgacacatcattatcacccaaagtccacagtttctacatcagggctcattctcggtgttgcacattctacgagctttgaaaaatgtataatgacatgtgtccaccattgtagtatcatatagaatagttccactgccctaaaaattctctgtgcccaacctattcatccttccattcctcctaacccctggtgaccacaaatccttttactatctccattgttctgacctttctagaacgtcatacagttggagtcatacagtacataggcttttcagattattttctttcacttagtacggatttagtttccttcatgtctttttgtggcttgatagctgaataatattccactgtctggatgtaccacagtttatccatccactgatggaagacatcttggttgcctcccagtttttggcagttatgaataaaatttctataaaaatcataggcagttctagaggcccctgggcaaagctttgagatctttaacactgtttttcacggttcctccatgttctcttttgcctctgacctgtaactggaagtgctcctcttgggcctgctccatcagcctgcgctcatcttggaagaaagaagcttggtacggtcagtagtacagaatggtcatataccttaaacacactgttacctgaatttaacttagcctatcccgattgacacatataatcaagtccagtgtatcctttttatataaatttgctttaagccagataaacataatctcccagaagagcttatctatgtcacaaaacagacatatatatttcccaaggaagatgctcctcctgcaatcactttctcaaatgcaagcatttgtttttcaacagcactgagcaggaggcctctgcaactagggaaactcaaccgggtcacttttcccacccttccttcatttaataaaaatggcagagtccagttgcggaagatgtgctcagaaagtttgctttcttcatcctgcttttgcctttggccagtttgacccacggtggggtttcttaatttctagcatctcaatttcttgcttaagaaatagtcctatttacctatttcaccatcctctagtgttcactcagtggttatttctttgctacctcaaatgccgagtaatattcaccccaatccatagctggctgacacctattttcggtgatttctgtggtactgattggtgaagatccccttagcttgaaggaaattgaagaagcgactacatagcccataacatcccttttgaattccagcttgcaatttaaataacctggtccttcctagaagcataaaccttcaggattgctcaagtagaaatactgacttttattttgcctcttggtcagacagatctacaccctttgttaaggtatgctcccagaaacgcatgttcttgggctaaacatttacctcatgggagcctaaggagtttctgaatgtctccagaacagtagtttactgtaatggagaagcagtccagcctcattccctccacatctacacatggctttgataccgtaccctctttatttggtctaaaaatatttttaaagaaaaaaagtcacactacaaaggcgattgaggtagttggtttttaatcagttactgatttgttgttgtcacttgttttggttagaaacccttaaaaggagaaattcaactgatggctctcttctcatgaaccgaaagttcaatttcccctgacgaaagtgggtcaagggaaatgaaaccagtttcctcctgattactaggtcataaaaaacggattccagagccagcaatcgccaccagcaacccagatgggtagcccaaagcctgttgaggggcagttggtaggcagcacagcctgagattcatggatagagacctcctgctccacatcattatggtatgttagtggaggagctgctcatatccaggtgggacttctctacctccccttaggaagctgcatgatctgttcacttattgtttgattgggcccttaaaatgtgagtgaaaatacaccagaattttcccatgaaaggttaacaaagttctaggggtcctcattatagaccatttaataatgtattatttattctgaggctgtatccaagtttcagatgctccaagaaaaaaaaggaatttgatcttgtgtcataacacactttaaaaaatgccttcttgaggacaactagttaaaagagagtgctgctaggtctcttcccttggctgatccacctactcaaagtttaaaggctcatataagacaggaagctttataatctactaaactctgtaataactgtacagtctacagtgattgtaggcccatggatttaaacatcattttatatccctaggccaagtcttacttctgagatccagcctcacatttcaaactgtctgcttggcattttctcctgggtgtctcaaagacgctgcaaacttagaatgagcaaaataaaacacttgagtcctgatgcccaattggtcccaaatctagccttctcctttttaggatatggcactcccggccaaccattccaaccagaaatgtaaaagtcatctttgttcccaccctcatgccttatacgtaatccatcagcaagtcatgtgtactgtatttccaagatacataaggaattgatatacattctctgccatcaacttgaactagactttcatcatctaccacttacagcagccctcacgtggttgtcaaattcctacagttggtttctttccagcaaaataaatgatcttcttaagacataaattagattttgtcacttgcatacttgaacaattttgttgattgccttaaaatagaataaataaaataaaacacttaatataaaatcctatctccttaccgcagcctatgaaaactctgtctaccaagacccgtatttatttgcatacctagactcctcttctatcgtactccatgcctctctctctcactatgcttcagccacagccatctttttgtgtttccccatttggtgaacatgccagtctctttcccacgcaagagccttttcacactctctgtactctacctggaatggactctacctctaatttttcagatggttgattctttgtcacatttgggtcccatgtcaaatggtactttcttcaagaggcattccttgaccaatctatttaaaatggcaacccctcccattattctggatctcaaccatagtttgttgatgtagctacaccataatttgtaatgaaattttcatttgtatttgtctgattgcttttgtctctcctgctggcacatgaactctacatctgctttactcttttactcacctggagtctcccttatctagaacagcagtccccaaccctttcggcaccagggactggtttcatggaagacagtttttccacagaccgggggcaggggtggttctgggatgaaactgttccacctcagaacatcaggcattagattctcataagaagcgttcaacctagatccctcgcatgtgcagctcacaacagggtttgcgctcctgtgagaatctaatgccgctgctgatctaacaggaggcggggctcaggtggtaatgctcactcacccatggctcatctccttcctgctgtgcggccaggttcctaactggccagggactggtactgtccatggcagaggggttggggatccctgctctagaacaactaatacgtagaaggtatgtaataaatatttattgaataaatgaatacaaaagtagctatatggctaaacataataaggtgacaagaaagtttctgcatatgtgaagacaaaacagtaaaagaagaaagccaccgtcaggatgactatgagttccatgagccttgaaaaaacgtattcatttactagatgacacggatttcgcttttgctaataagtgggcacaattctaatcagtatcaattatcaaatgtctactgttctttaatcaggaggaaacaagaagctattgaaggtgtgtgagataagaatttaagaataaatttccttttgcttgattcactatttcactgccattttgaaagaacttacttcaaactaagtaattgttcaggtgacaatatttaaacaataacataaaaatccagaaaaatgcacatctacttggaaggattcctttggagaagaatttgggggaaaaaatccccaaaatagaatgcctctaatcactgggtttaatcaatttttggaataattagcctagttaattatttatgaaaacgtaggttttaaatgaaaactacagtttattgttaaaatatatcttctttgtaatacaaattcctatgccagtgtatcagataattaattttaaataggtgggaacaaacctattttcagaaatcaagattttgatgatcacggaaattagtaaggttcttatgccaatagtgatatttttagatctgttttctcttaaagaatttcataaattgctttacagagtttcagttctcgtctattgaaaataaggcatgctcagcctgcacaagtgaacatgagacagctcaggaataccttcattcggccctactgtgctaaattaagccatttggtactgaaagttagtagttacccagaaataaaatcttgctcagaatagtcagaaaatggtgtttgaacaaaggaaacaagtaacagtctttaaaaattacccggacatttcaatgttaactttccagtttctgatttttcagactttcctttgagttttatgcctaattttgaagtgttccaacacaaaacacaagttgtaaaagaaatagcacattgcattgggaattctttacctaagttcacattttcccctattgacatacaaaagaaaaagaaagagaaagtaaaattccaaatgggtattaacttttatgtaatattttctttttcctttttatatccctattactatctctaaaacattggggaggtaagtatcgcttttctctgggtcaaaaaaaatcaagataaacttaatcaaaatcaaatagggggtataaagtaaaatcaagatttttgccttacttttaaaattattatttctagcatctacctcagtacgagggctccgcgtattacctatagccagagactgatggtttcctaacctgggagacctgctgggcatgcagctggttctctgtaaagatcattaacatggttctctgtaaagattcattaacatggaggggtggagacgggtgaaggaaagatgaaatggtgttttctggtaaaagtaaataaacacaatacacatcttttgagagccaaataacatttttccaacctaatgatttttgaatacaagcgtttataacagaatctacttaagtccatacccattaaataataaaactcctaatttgtgagagagaggggacatgctatacagccttgctggaataccagaaagatatataaaaacattcataatcaaacgcccaagtaatgctgaatgcgggagctgcagttaacatgttcctaaaccccacgataaagacaaattcaacatcacttacattctgacactagaccatgggaaaagtgacagagtctacctgaagaagacccagggcctcctcaacccaagaaatatgcaccctgtagaatacaaacatatgaaggagcatccactaacagatattctaactccaccggctgcgggcacagggaaagctagagtaattggctgcagatgtttgaaagatactgttagtcttttccagatggatttgcctctatgacttagtaagagcaaatacaaatttaacattcaatccccagtccgaggaagaaaagtgtaaagaaaggcagagagcagcaaatcgatgaagcttccacatccaaaggatgttcaacaaagacacaaagaccatgattccaaaaggttcattagccccactttgtaaaagaatatgaccaccaggaaatccagcatagaattccacagccactccaatgacacggacagaagcaactctgcagtagaagtgtccttcatgatcatgaggacccagagtttatccaaaatagcaaaattaaagaaagagattgggttattctcacgaattacggttttctgctactctgaagtccaagagataggaaggaaaaagcctttcccaggaatcaaagtacagggaaggtttcccgtagataaaccatgtggagctgagtagtgctgggtattggcgctctctgagaggaagccacatgttcttccctctcaagagcaatttggttggttcacttggaaaggtagaaactcatgctagggcttgggtgaccaaaagaagtacaaaaggaagagcaagagagagaaacctcctatatctttttaccacgtgagccagaaggagggatgagtctcccagacagatggagagggtgagcatgctggagggtagtgtctgtggttcactgaatgaagagcccttggctgggttttgctgacggtttcccaaacccatattgcataatgtgcacaaatttgctctctaagctaattagaatatcatttgtacaataaaatcacagtggagaaagaatgaaacaaagggtaaagctgccatggaatgaaggtgctagagccaaaaggtaacaacatgggctctggagccagacacacctgagttctgatcccagggttactcactagctatgcaaccaaggcagggtgtttaaactctgaggctccatgcctttacttgtcaaacaggcatgataaagtatctccaccatagggtagttgggagaagtaaataaaataaatcacttaaagtcctttgcataatacctagtgtgtagcatgtataacaagttgttgtagtcactattactagtaccagtttcctcaacaaccatgacttaactatgtcattagaaggctatatttccttagtctggcttcagaaagctgattttggttacttgtaactgatataaaagtcagagtaagtactaaaatagatcattttaaattagtatagtctaggtaataacatcttaaacatctgatttattacttctatgtactttgaaaccacactttatatcaaagcacttcttggatcctatgttcatcttctttgaactgattatatccacttgaaattatcagcatgcatttgtatattgtaacagaaatgcaaagtcctcaaatatttttttcctcaggtatgttccttactctttattgcaccttacagagataacaagtattttttttcataagcagtacaagccacaagctaatggagtaaaactgtcctgaatctggaattatttgagctgaaataagtaaatttcaaccattattatgtttttagttgataaaattttaagatacataaggatagactggtaatttttgtagatcaatcttaccatatgttaggaaccagtggtatttacaatttaaattaatcagccggaggtaaagatttcttaaatcatctttttcaggacatttttatctgcctaataagagcagggtttatgagtgaaaaaaaggttttttatagatgattcatcaatatgttattctaatttagtgtgtgcttctatttttaagatgtaatgactttctaaggcataattctaaatagagaatggaggatacaatatgatctattagttaaggggtatgtactcagatgtgtattgtttctgccattaatttttttagaaataccaatgtatatcaaaattaatgttaataaatattcataaaatctttgtatgtgttcagagccacaggccacataaaatcacatgaggagataaggcatatctatgaaaagcaaacagtgaaaaagaacagcatctgtttaagcattttaagtacaaataggcaaacatctaataggaattcctgaaaatcccaatttgtccccattgcttttctgcaggaatacaaaaaaacagactttcataaagcaatttttttcattactagaaatgtgactgttcactttctccagtgaccttagaagttgaagtcaaatacagtgaaaggggaaattacattacagttagcggatatgctatggacataccaactgaaattacacatgcttggtcctgcttgatcctggacaaattgtttaccaactctcagtgtagcagacccgcagtgtctattaacttaatagctattacagaaaatgttttgaaactgatggaagatgattgcgggggatggacgttgaaggcattattgctgctatgaaaagataaatataggagccacttcagaaacacaggaaattggtaaatggagagaaactgttgtccctttgctttcatctgtgttacttaaatcaatactctatgtgtccattaagccaggggtaattcattaaatcacaaacctggaagaatttttagagtttagccatgtaagacaagccaggctattccagatcaagagtgccgtttttttgttttgcttttttttgagacagtgtctcactctgtcgccaggctggagtgccgtggcgtgatctcggctaactgcaacctccgcctccggggtccaagcaattcccctgcctcagcctcccaagtagctgggactacaagcgcgcaccactacgcctggttaattttttttattttagtagagaagggttttcatcatgttggccaggatggtcacgatctcctgaccttgtgatccgcctgccttggcctcccaaagtgctgggattacaggcgtgagccaccgcaccaggcctagacggacccattttaaaaatcattagaaaagatgatttcaaaatatctttttcataactcacttcaatgtcaagttgttaaaaagaaaggatttacttctatgtttaaaaaactattgacaccaagtggaattatctttttttacactggaaatgtttaatctactactaccaacaagaattcctgaaaacaacaagagtaacaaatgatagctactagtgtttcagggtctatttatgtgcatttaccttatattaattacatttatttaaaaaatccttgtaaaataagtattattagaatcccatcttacaggtgatgaaactgagcgtcagaacgcttatctgtccaaaattaaacagctaatgagtagagaaataaaaatgtaaatatagcagcagctgatgtcaagtgttatttttcactattttacaacgtcttaggatacctttttctccatctttcctcagaaatcctttgttgagactgttggggataaagccagcactctcgttcagcacaattaatcccacaggatgtgaagcctactacttttcaattgcaggtgcagaggctggctttctccagagaggcaggtagagaagcaagaggcatagagagagacatctattggaaaaaaatgaagaagaatatccctcacttcatagggggctaaagaacctattctgtaagtgccctgtatttcccaagacctgccttctctccttccatgcataaatacctgtaaagcactgactcacttctatgcttactaagcagcaacctgactcgggaaaaaaagctaggtatgtctagtttcagaagggccctgagagcatcattaataaagccctaaataaaaaaaagtacagggatgtcaacaaatcgaggatctgcagtgacacctgcaccactcttgaaggcagcttcctgcaccacatgttcccccaccccccgccaggcatccacctgcaccacatccccagggcttcctcctgaaccactacccgggacatccacctgcagcacgcccctgagcatctgcctgcactccccatctccccagcagccaagcatggcgttggtgttccctttaggactagaggaaacaaagattctgacaagatgttaacaggtggctgatcaggttgattttctctggggacaaggtgacctgaataattctgtgaaaacattcaagttttgacctaatatgtctcataaaggacaattcctctcctgctgttgttcagaacggaaaaaggacaagctgagttttcaaacctgctgctacagcatctgctaatgggcagatgatgcctgggccactggggccaatccagagaaggaaactgtcaggttggctctttcctgtgtcccatgtatattttcacggatatatgtcactaagtgtaaaggacatgaaataaagactgcaggacatacacagaatgttctttgtggggctctcgggggagcaactggtagacacagcagctgaaaccaaggctcaacctctgtgactgaggaggccaagatgttaagactcttaggacaaagtcagaagttgagaaaataaattcaagagctgatggcatcatatcatggctaactcaacaggcaagaatactgatttgtggtggtgcctgaaaatgtgcatgtataacaacctccactgggtactgcacctgatggctggggttcaccctttaagagctcctgctatagaacaatccactttggcttcaaagtttcaaagatttcctttccctgaattcagcctatcctccctactgaagtttactttttgtaaatacactgcaggtccttattttcacactcaaacacaagtcaactcttctcttccttgggtagtttaaaatatgtcaaaatactccaaattacttagaagtatcagccaaagagtatcaggttgggtaagtcatgcaggaaacaggaaatcaagtgacacactattactaatgtcagcagaggcacttcaaaatggttaatgatcagatccaaagtttcatttatttcagttagaggtggagccaaaccaattcctattatagctcacaacacaaaactcctttgtcaaaacgggttctacaatttttcagttaataatcacagaccctggttggatgaaaggtgtgaaagaagcttaaatcttttaacctcatctttgcattcttaaaattactttctttgcaaaaaccatgctgcttattctgtatagaacaaaaaggccacaactgccagtaaaaacagatccagaacaaaagtaccaggcactacactaggcatgagaaagtattttttttccttctgagttttctgcttataaaatttagaagaattacacttattgtcagactgagaatttagtgatcaagaactagtgatatttaatcattagtgtgtgtcagcagcatctggagatcttctttaaaaagcataatcccgttgatcatagggaagttgatccacttccctatgattaactaaaatgtacctggaaaatgtaggttgaacttttaaaatgcagaaaatataatgtaatttgacccagataatgacaaatctaattatttaactttcattttttaaacttggtattacaataatgctgaatgttatctatgtttgaaaagaaaagccatgtttttagcttaaaatatgccttaacaatttttaaatgataggtaatatttcaccatgcatgctttaaaatacatacaaaaattccgatgacaaagtttccctcccccattgactatattcctgccaaattctaaactatattttaaggctgcaggcagcaagggcccagcaatctatattttaacaagcacctaggtgatttaagcaccacactgaggggacacagacagggagagtaaagtgccagggttccttgagagaaagtagcctcagcacttacacaatccaatagcagggggctactgattacagctttcagagaacactaaaatatatcatcccttttggcgataactgaacttcaccactctttggccaataagtacctaatcagaagtcaatgtcttcatgtaatctagctatgataatattaacactcctttaggacattaagatgcataagaggtcatagttaaactcacatctatattatttataatgtttcatttaatccactaaattttaggaaattacttttaaattggtgaacaaaacaggtttgtcagaaacagatatctctatttatattattaatgttaggaactaaaatataataatctcacacattcacttagcagagtcattttcaaagtaacaaagaaaatgccttatttgctcttcaagaaaactatgggaagcaggccgggaagacatggttaattctattttacagatgagaacgattcagacagggtgaaatgacattttcaaggtcacttggcccatgaacatcagaatcggatctcaaagccaattttttttaacattaggatgttaccattgtagagtattgcttttttaattattaaaaagcactgaattggtaaaaagttgctttgcaaaaagaaaaattagaggaagtaaaaagaagacagtcaaaaggaccattagagtccataatgttatgtctgtagccagcagcaaatggagtctggcttatttttttcaccacatctctcaccaaaatttccctgtctcccaaagcaattatttggaatgcttacaggtcaagccagccttaatggagattgtacagatttatagatgtccttatctccaacaatattgtacactctgaaatctttcacttagtattatattgcaaaagataatggctcaatatatgaattatggtagaactctgaccatgactaatactaggtttaaagatattcttaccatttctttttcttctgaataatattgcaaactaaaggtgtattttctacattaattaatggtaggtattattagttctgatttagaaatgttggcaaaatttaaagttgatatgttataggccctactgctgtttaaaagtgtccattgtaatgtgtgagtggttgctcattaatgtggattgagagcatataatgcttacctgatctataaaccaagtactgaagttccaccaaaaagtccacttccctatgatcaactaaaatatacctggaatatataggttgaatttttaaaattcagaaaatgcaatgtaattttacccacataatgaaaattctacttatttaattttcattttcaaaactcggtattacaataataatgcttaatgttatctatgtttgaaaagaaaataaaagatgtttttagcaaaaaattctccttaacaaaacaatttttaaatgataggcaatatttcgccatgcatgctttaaattacgcacaaaaattctgatgacaaagtttccctcccccattgattatattcctgccaaattataaattatattttaagaaatgttttaataatgcaaatcaaagtcttgttacattttaaaatggagaaatttgttcctatgtgcatgcaaatttttaaataattatttaaaaggctgagattgtcccttggaatggaaatagcttttgattcctttctttctttttattatgttttttcttgccaaactccagttgagtgtccatgggttatttgcaagatctatttgctattctggagaaggtttcacacttaagtaattaggctatgaaatatcaagaagaagaattgggtctcacttatattgtttctccctggctcccttctgcagccctttttcccacttgctcagagagtgtgggaagacagttcctccccaaactatctggtcatcaacctttaaacttcccagtcccagtcaaaagtcctctgccaaattgctctcaggatcagcgcctgcagagataccacatgccagacaccaaagtcacaggacttttgaggaaggaaagtgcaaaaggtgtggtgaagggaagatggtgataaaaatgttccttatccaacagtttgttgtttttataaccatatgagtatttcactgtatatgacttggaaagaatagataactctttaggatattaattaatgaatcagagcaagtgaaatctcatttaatagcattagataactcaaaattcagttctagctgagtttgaaatacattttgatttttttcctgtgaagtcagttttccttcctaataattatttgactgagtttacatttgctgagcacacactagctgctctggagaccgcaagaaaacatggcaaggaagaagttggaataaagcttaaacaacaacaaaatataaatgccacaggtaatagccaaggtagacaataaaagcacagctatcatgagctgacaaaaacatacaatattacataaagatgaaaactaatttactcttacatacattactgggaaatagctttgagggttaaaataaatctaatgaatttgaatggagtctgtattttcttattctacataatttttttctgtatttcttttcaaagtctttcaaaggaaaatgtcaatttaaaaggaaatcctatgaaatcagagattataataatatgaggaaaacgcataaaggccagacaaatacagcaaagtcacagaagactctggcaggacagtaaaatagtcccacatgctagacatgggctgattatgtaaggcacctaatagtttgattttaaaacaaaaataataacaacaaaaaaggcttctccccatgccctcctatgatcttgaaataaatgctaaaaatagaagcaactatatcctactagttctttgagaaaataactaagatagagaataatcgtggtagagaatggtaccttcattgtacggggaaagaacaagaatataagcaactacttaagtttaagtacattcaattacacacagttggaaaagtattcacattcataagtgaggtttcagcacttcagtcagtggttgaaaaagaaaagggatttttcttgcaattataaactataactcaaaattgggtttacatcagcagctagaacactcgcaccaaagcaggagtattaatgccataggtatccctcagggcaatccaaatcagagggcaacgtggtggtccattttccactggtggagaaagcatatatcaatacaacatagatgacagatttacaatacctcctatgtcattttatctggatagtttctggaattcagacactactttgaaacattcataattaattgcaagtgaaaggaagggagaaaaaaaaacatatttccttaactccagcacagtgtcaggaattattcaaagaacaacacaatgagcattttttcaaagtgccattttttttctttctcagcaagtttgccactttctgagaattaaactataaatatacatgtatatgcataatgataaaaatagacagtgagaggggacacaatacgtccctattgttctgaagattgacattttacactcttacacttaatacaaagtggctttcactgtttctcacctaactgacttatcttgtgcgcttagaagactatctcaagacaaagatgggtccagggagttcacttaaaacactagaatcactggtgccaccaacaggggctccaaactagcttcagagaatagacttgctaccgggggaaggttttgactaccagttgtccaagttctttgcgttttgaacaaagaattggacaaaaagtacaaacaaagcaactaaagaacgaaggaatgaaagcacagatctattgatgtgaaagtacactccacaatgtgggcgcaggctcagctcaagagccctggttatggaattttctggggtatttaaaccgtagaggattcccattagttacttggtttacgccctatgtaagtgaaggcgtggcctgcaaccaatcagagacttacgttacaaagttacaccttatgcaaacgtctgattggttgtgagaggggaccaatcagaggctgaagtggttacaaagttattgccctatgcagatgaaaactaggcccaccaccagtctgattggttgtgggagtggaccaatcagaagtagtttccatttttcatctgtgatgcagaaagggaggggagtttgcaaaggcagtaacccctggtcctattgttacttgagcatggaaacttggggttttccttctgatttagttctaggaagtcagcatgaatcagccttaggttccctgcctccagaccctattctcctgcctcaagagaatttaacataaagccttgcagagttgtaagggtgtttttatgcacatattttaatcggtgaaacaactctgtgaggtggggaaggtattatcatgcttcataactgagaacactgaggttaacagaggtttgtgaatgtccaaggtcacactgctaggaaaaggcaagtctctttttgccaggtgggaagagaggcagcgcataagtagatatccttttttagccactaattctctctatacactagaattcgagtaggatattgggagtggttgtgtcagggaatgaattagaggacaaccagcaagccagttagaagagtcctgcaatagtaaatggagagaaagagggactaattgatcttgaaatcgggagaaatcttataagcatgagaactgtataaaatataaaattagtggctttatgagaaagtgcaaactgagacagtgtagtcaaaagctgggtaaatatatttctgcaatgttgactttggttggcaatttgaataaaaagcaatttctgtggtctcttctcactcaaaagaagttgatgattttatgatcattgggagctttccttttaaaattgcactctcctgtcacattaagttagatttttgttagttgctgaaccatgaaatctatttactttatgtaagaaggtggcttactccatgcaattctagccacaaaacaataacagttaagtttaatcccactttagcaatgcaaattttaccaaccagaaaaaataacgggcaaaacacaatttagttaaagggaaaaaaagtagcatttgctgtaaaaaaacaaggtaattggggatgggaagacttttaattctagccacccaaaagtactatttggctgcccaagtttttccctttagagaaagagatgtcatctttacacaggtaaattaaataagttctagctagatgaaagctagataatgaaagagggaatttgaatgtaaactttctggatttagttatctgtacaaaggatatgcttactgatcctcattactgactccacttgcaagtagagtagcagtaacgcaaagcagtcaacagaacctagcattggcattaggcttggctatgctccctaggagctttctgggtctcggcaaatcccttccctcaatcatgtatctaaaagtatctaacaggccgagtgcgctggctcacgcctgtaatcccagcactttgggaggctgaggcggtaggatcacttcaggtcaggagttcaagaccagcctggccaacatggtgatacccagtctctactaaaaacacacaaaaaaattagctgggagtggtggcatgtgtctgtaatcccagctactcggaaggctgaggcaggagaattgcttgaatccaaaagggggaggttgcagtgagccgagattacgccagagtgagactcagtctctaaataaataaataaataaataaataaatatataaataaataagaaaagtatctaacaggcactcaacagacatttattgtccaactctcctgcagcaggtgctatcatacactctgggggtatggagatgaacgtgagttttgtcaaagaatttagagttgagtaagatcatacaaatctgtaatcaagtttgggccttaaagtatttgaggtgttgtgatagatactttgaggtggtagaaggaaagaagaaaaaaagaacagtcaactttacagagaggagaaagggaggcgagtcaggaaaggctccaaagaaaagttattcttgatcagagtcttcccaaaagggtcgatatttatcaggtgcatattcacggtagtggttacaatgctgtgcgtattcgtgtgggtgtgttgcagggggtgggagaacagaggtactatgccagccatagaaaataccataaaaagcacagaactaaaatagtaggcagttcactattgttactacatccaactggaggctaaaatcagcagaaaaaccagggattgaaaaggtttttttataagcataaggccaaaccagaaaccataaatgataaacaaacagaaaaccaaaaaagaatatgtcaaaattacaataagagttgaaaaacaatggcaagatataaacatgacgttggtataagggatatggcatacgagacgtattggcatttgggacagcaaaaggtttatagttgatagaaattgataaaagatgaacaaaccaattaagaatgaacaaaacaaaatgtacaaaattaataatatgtccattataagtctgcgaaaaattcagtctcactactaaggaagaaataaaaattaaagtaataacatatattattcatatattagattggcaaaggtgattcattgttaaaactgtgtatcagccaaagtgtagaaaaatcatatactcaaaagcagaggtaggtatatcactgtcaaataagaatatttctggggttaatttgacaacatctaggaaaacgctctaacctagactagcaattccttctagaatttaagctcaattggcaaatgaaaccattatacacacacacacacacacaaacacacacacacacacacacattgtattttgtagaagccaaaaaataaaaacaacccaaatgtccagcaataggttatttaaataaattataatattatgatatatctactacatggaaactataaaataatttaaaaaatggtaacttagggttttgttttttgataaagaaactagttattataaaatattaggcaagaaaaggtggttactgacagtattccatttttctaagttataaagagaaaaatgatgctgaaaagagaatgatacatgtgactacagttaatttttttatttatttccctcttttgcagtttctataattctttttttccaagtagattaaaatatttggaaaacttcctatgtggaaggcagtaagcagtaatatgctatctgcaaatttgggtatcttacagataatgtgatgttgagaaatagcaaccttttggtcttcttatctctatcacagaattcacaaatcttgaaaataaaatcaacacatttttctttctgaagatagtgagggatataaaattaatatcgatgagagacaacgactttagttatttctgttaaagctttatgcaggttaaagtttaactggttctttgattatcgccattcttacaggagtaagatggtatcgcattgtggttttgatttggatttccctgatcattagtgatgttgataattttttcatgtttgttggcgatttgtatatcttcttttgggaattctctattcatgttcttagcccagtttttgatgggattgatttttttttcttactgatttgtttgaccctctactgggtatctacccagaggaaaaaagaagtccttatttgaaaaaagatacttgcacacgcaagtttgtagcagcacaattcacaatagcaaaattgtggaaccaaaccaatgaccgtcagtcaacgagtggataaaaaaatctctggtatatatataggatggaatactactcagccataaaaaggaatgaattaacagcatttgcaataacctggaagagatcggagactattattctaagtgaagtaactcaggaatggaaaaccaaacatggtatgttctcactgatatgtgggaggtatgctatgaggacacaaaggcataagaatgatacaatagacttcgggtacttgggaagagtgggagaggggcaaaggataaaagacaacaaatatggtgcagtgtatactgcttgggtgatgggtgcaccaggttctcacaaatcttcactaaagaactcactcatgtaaccaagtaccacatgtaccccaataacttatggaaaaataaaaaaattggtagaaaaattcaataagtctagctagattttcaatattaaaatagtcaaaacaatcaaataaagttagcttccatttttaaagtagattctaaataattccaaataatatagcattctgagaattatcagaagcatacatacaggtacatacatataaagtatatatgcatatattaagtatcccatttccaaacattaaaatggaatatgaaagtataaaactatatataacagaactctcatacattgctgatggaagtataaattgcttaaaacattttggaaaactgtttgctataaatggaattacatatacagtatccgctgatccagcaattttattttcagacatacaattccccccaaatatatatatatatatataatcaaaagatggaatcaagaacattcatagcaacaaaagcaatcaaaaaagtttaagatagtgacacaatgagaacaaactattgctatgcacgacaacatcgatggatctcacaattataaccaacaaaagatgctgtcccatgtgacatggtgtaccacagagaatccccacttcaacctgaggtaatcgttttcccagctccaggagttttgcctgctgaaggctcatgcctgacttcctctggcaaaagcagcaaccccccaataagtgggtgatatgggcctgcccttttgcctcaatatgggacatctctggagaacagtccttactccagagcacctcacgggtttggctgaggcctttggtgcaactgcatcttagttcaaattctccctctgaccaacctacttctctcagccccttggagatggtgttgccaagagggctctccaacaaatttttttttcatgcaactctctgagtttcacagtctgtttcctggagaactcaagaaaagagggttggtacaaggaatagtccaaacatcacccaccacacagctaacaatggagacccatcatcagtagagaactgatagcccctgggatgagataatggtacagttattaaaacttttaatggcagaaaatacactggaggatacaacatcatggctgtttgcaaggtttgggtggactcataattacagtaatgggatcagatggctcttgcttagggtatagcgggcagagaaagtcaatgaaaaactgaaagcagcaatttagagcaaagtgaatagatcagagcgagtcaatttctattttccattgctgcataacaaatcacccccaaaactttgtcttaaaataatgccattttattatctttcataatctggaggttgatgggctcagcgaggcagcttttcttctccacgtgagattggctggagtcatctgaaggctccacattctgcaacaaccaatatggttcactcatgcaactggcattggattctggccataggctaggatatcagcttaggattttgactagagcacccagtcctccttcatgtgacctcttcatgttgctcgggcacctaacagcatgatggctgggttccaagaggagaaagagaaatctgccagtcctttaatgggcttggaagtccgagaacataaccatcacttctgccacatttgattgatcacagcctgtcaaaagtccagctcaggttcaaggggagcaaaaaataagctcaatttctggatgcgacatgcttatatagggagaatgtcaggggagttaaagcagggaaggacgtccttatcttgtaagactaactactacagtctccttagtatcgtgtaaagatactcatttcctatagtcagatgcagaataggctgatgataaggctcagggcttaatgatgagggaaactggacatctcagccagccccagcaagtcagctgtgccaaggcctggtcctgtgttagtgaagagggggactgtgagatttgcaatatctcaatggatgcacttgaaaatcgcttatcactagattccccacaacctcctgggcctaaacaagtaccccactccactctgttaaggctatcatctctgcctggcataaacatgatgcagagggctctgccttgcaagatagcaagtgccctcatcaagatatagtcagcttctcctccaggctgccagacaaataactaggtcaggtaacaacataatccagctggataagtgctggctctgctaacagagaagggtgtttacactgaaggagctgtggcacctgcccaacatgcatggctagagctgagaggatgggttcagggtctaggaccaagtatggagaaacataaagtttaataaggaacagcttattgacatgagaacaaccacctgttatataggatttaactcttaaaaaggacaccagaagacagaattcatgttgctaaggtggctctctgaaatttggaggtggcaatggtccaaagcaaggccaacaacagaaaaagaaaaagaaaaacatacagagaagtgaacacgatagagtatagattccaggatacacaaaggccagcaaacccaccaggtccccacactctgtcctggataatacatgatttgccaaagtcctaagaaatgtgctgcctagacatgcacaggcaatgctgcgatgctcagtggtgctgcctttttaggtgatggcagatcggaggggatgctattacagagcgccaagcccatgatattcacaaggaggcagggaaggacatgtctggcatcagggaattcactggggcgtttttgatactccctgcccaactgtgatggagtatggagaagtgccacagcctgagacaggcatggtgttcagatggagatctggatcactttacctcgttatccatctagacaaacagagatgctaacagaggatgtggggaatctagtattggtaggagagaaaggacatgaggaggagcagtgcagcccagagaccagctgctgcagctagggattcattccactccctggaggaactcttccccatgagtttaaatgaagcaagtggatcccaacagcccggcaggtggactatagcacatgcaagtgcacctcctccatcccctctccaagagagagatggtcaaggcctggcccccttgctcatttgtgccatgaagctccgaagtcctgtgtgggcctggataaggactctggggcaactacatctccattcaattcctccttctgacagaacctccctcccctactcccttacgggctattctgccacgagggctccccagtcaacttcttgtttgtcaatctccatctcaggattgaattctaggaaagttaatcttagtcagaaaccaaacacaaaaggacacacacagtataatcattatttccataaagctcaaacataggcagaaataaaatctagtgttaggtattaggacggggtttcctttgtaggaaggcagtggctcaaaggaaagataaaagggtttctggagaaatgataatgttctctttcttatctgggggttactgacatggatataaattctgaaaattcatcaagctgggccatcatgattacagcatggccacactttatttatatactctatacttcaagaaaacggtttttggaaactgatatttcacagtccttcttaacaattcagaaataatttcactttgaggtggcacgaggtcatcaaattaaatatgaatgaccgtccctcatccttaggctctgaatccaacaggctgcattcaatgccagactgagacactgactatgtgaagctggtcaaatcttcaattcagtgaacttagtttcttcatctccaatgtgaatgaaaagtgattactaaataagataatccatttaaagaacatataacattgctaaaatagaatacaaacattcaataatatggcaactatctgcatcaggaaaataagatagagagaaaagtaaatttaaactatttatatgaaatgtcttggaagtgctttgcaaaataaagatgaaattgttttgttttacacataacaatcaataaaagttacttgatagtttagatttggtgtacacagaataattgtatttatatgatgcttagcatataaataagcaatgtcattatgacataatttggtctgttataagaatcatgataagggctgcgcatgctggttcatgcctgtaatcccagcactttggaaggctgagatgggtggatcacttgaagtcaggagttgcagaccagcctggccaacatagtgaaacccaatctctactaaataaatacaaaaattagccaggcatggtggcacacacctgtaatcccagctactcgggaggctgaggcaggagaatcactggaacccggaaggcagaggctgcagtgagccgagatcaagccactgcactccagcctgggcaacagagcaagactctgtcaaaaaaaaaaaaagaatcatgataagtaatgtagtaatatagagactacattctctctcagcaaagtgagaataggtggcaccttcatattgtcaaatgaacatggtttataaaatttgatattcttatatttgaattctgactttgccaattactagcagtgtcaatttgcataagttacttatcttctgaatcttcagtccttaatttctgaaggaagatgatgtgctcattctacaggactttcagtgatattatacaaaacaacattgtgtttaaaacattgggtcaattgaaatatacatatatatatatacacacacacacacatacacatatatatatatataatgactgttgatattagaggaacaatctataatcaatgagtagtttacaaagtgaatttaaatcaaatactgtttctcatactctataaaccttagcacccagagcaaacacttgtataatatattatcagttagtatttttgatggataacacacaaattgtatgaaaatgtaatccacaattgaaaaatgaaaagtatcatgttctggacaactttcttaattagtatcttaaaatctgagtcattgaattgatttggcacatgtgatatgacaatgtttataaaataaaagctacaaaaatattgtggtgtttgtaatattaaaatttattacttgccttataaaataaacattcaaaaaatgaaaaattgttaaatcggtaagacttgcatgcaatgaatcaggttacagatttgtaaagttcattagaacataattcctcatactgaattgccttttaacagtagattcagctcaagtttctaaaaacaaatattaactttttttactataattggttcacttattttctactgttaataaatcagctttgtggaatgtaaatggtataggttttgcacttcagctgatatagattcaaaaattggctctgtcacttactagctttatgtcttgggctaagtttttttactctctgaaccttagtgttttcatctataaaatgggattatcatgtgcctcagaaagtcattgtgaagaacagaaacaatgtcagggaagaatctaacacactgaaatacaactggaattcaataaagacagggtgtttatatcatgatatttgcattattaattatattggtaagtgcctgagaattggttttagtttttcagaacttgtgagtcctctttctctctctccctctcatttgatcgctttgaggtttcacagtagaatataaaactgcagtcctatttattatgtttatgctcttcaataaacacattgcagtatttcaattctggcactagtatcttggcaagcattctggctagaatatattgtatgcttcagaacctaaattgtagtgacatattaatacatcatgaaattcaacaaagattcagtggcctttaaggaagaacaaagaatatgttcacacttcatcatacaatattatctatcctgtcattatttattttcaagcatcctggcaatagtgtcctttgtggatcaattataatagtttcaaattccatagatgagcttataccaaggtcagatgataataggttgctattgagttatgcctatattagaagggattatcaaaattggcacattttattaataacaattttgaattccttttattcatgaaaaataaaggaattacaggttgacctcaaccattttctagttcaagtaagatatgcatcataagacattttagaacaacatacaccatgagcttttaaaaagtattaaagatgtttggttaatgagagagtcagaagtctatgaactacctgtgtatatacaaacctctagaactctaaatgcccaaaggcaaagctcatctaactttctataagatccaataatcttaatatttgtttactgccaaagaggctaagagatgttgttatcagtttttggaagaccaatatgagatgctataggaaatatgcattaatcaaaaagtgctcttgggcttgcctgttttccaacccatcacagacagaatggcatgggggaaagaacacaggctctacagtcagaagacctgggttcaaacacaagttcagacactgactaggttcactttcactcttttatttttctctttcttaagtcctacaaaatgaagtataacaaaactaaactgaactttctgtcactctggggcttgatatatatattcagtagtgtgagggtcagaagtcaggagcatagtgtgtttattccttattgcagtcattctatacccattgaaggaagtcaaccccggtcttgttcagggagtctgtaagatcaaaactatttttgtaatattactaagatgccatttccatttttcactctccctcatgagtttgcagtgggattttccagaggttttatgatgtgtgactgtgacatggcaacccactggttgcagagaatccagctgtgtggtctctgaaatcaggcagtaaacagatttggaaaattataaaacaatcactaaaatatttatcactaaatatattttgttctagaaatagatttaattttcaaaaaatgttttgttaatatataatgggtttattattattttaaaatgaattgataaatattttaaaatatttcggttgtatttctaatacagtaaatatggggttttcaataattgttgagtgtaaacaggtcctgagacagaaacgtttgcttactgctgtctttagtgtaatgatttagtaaaaaataagagttctagagacttctagttttcgctttaaggtaaagaaagctgggaagagatctttctctcacttacaatgaaaagctggagaaactgaaaaatatcataaacctattggagaaagtttaagtaaagtgtccagagtgaagggcaattaacactgcctctcttgggcacaggaaaaaaccaatttcagctgagggaagaaaacagaaaacaaaacaaaacaacttaaccctggggaagatagagaggcagattctgggctgagaactgcagatgggaaggggcaggagaactaaggaagccacacttcaatatcgagggatacactgtctgtctaatagtgtggtgaaatgagaacaacagagaacactccgctgctgccacttctcactgccaagctaagatatcttaagtaatccacagtgctgcttggagagaaacacaagtgtggaaggagaccttctctaaggttcagtgcaaaggaaagacttaaagctggcgatagagcaagcattgagagaaaacaaaacaaaacacgtttgacaacccagcctcaatcctaaaaacaagttgttactagaggaatttgaaacctatggtatactgagtgaaataacaattataacacacttcacacctaacccaactcctaactagttttactcaaacccctgcactaaaggcccagcagagggaaaggcatgtccactactaggcagaaaaaactgttaacttcagtttccattgaactacagaaggtgtccaattttcaacagcaataaaaacataaagtatatagaaaggcaaaaagtaaaaaacagaaaccaccaacacactcccaacagacaaagtaagcagcaaaaccagactcaactatgacacagatgttggaagtaactgataaggaatttaaaataactatgatgaaaatgttaaaggatttaactgaaaagaaggatatgataaaagatcaggttggaagtttagcagaaagccagaaactataaaaaaatcaaatgaaaatgttagaactgaatacaaccactgtaacagagacgaagaatgctttcacagcttcattagtagactcaacatagttgaagaaagaatcaaggaatttgaagatagatcaatagaaactactcaaatagaaatatatagagaaaaatgtttggaaaaaatgcagcagagtatccaagagaggtgaaaaaatatcaaatggtctaactgacatgtaaatagaataacagaaagagaagagaaacaacagggcagaacaaacatttgaagaaatcatggctgtgaatttttaaaaattaaagacaaacaccaaactacagagccaaaaacaaaacaaaaaaaaaacctcagagagcgcaaagcatgatagataaaaagcaaacaaaatccacccaggtatatcatattcaaactgctaaaaacaaaggacaaagaggaaatcttggaggcaactatagaaaaagatacattacatgctgaagaacaaagataagaactatagcagacttgtagctagaagacaatggagtgctaaaaaaaatgtgaattcagaaaatattttgaagtgtttttcaaaaatgaagaagtaatatgtattagtctgttttcatgctgtttataaagacacacccaagactgggcaaattacaaaagaaagaagtttatttaaaaccatcagatctcgtgagacccatttactatcatgagaacagcacgggaaagacccacccccatgatgcaatcatctcccactgggtccctcccacaacacgtgggaattatgggagctacaagatgagatttgggtgggtacacagtgccaaaccatatcataataacaaagaaaaactgaaataattaattgccagcagacctacccttcaaaaagtggtaaaggaagttctataggcagaaagaatatgatagcaaacaggaacttcaatctacacaaagaaataaagagtgctgaaaatagaatcaatgaatggaaaataaatttttttcatattttaattgtgctaaaatataactgactctctaaagccaaaatggtaccaacatattgtatgtttgtagcatatttcaatgttaaatttatgaaaataataagataaaggatgggagggaaattcagattatttaaggtccttacataatgcatgcagtgggattataatatttgtaggtagactctacttgatatttattgcaaatcacagagcaaacactaaaaaaattaacaaaattgagtaaataatatagggaaaaatagaaacataaaaatgctaaatttttacaagaagtaagtaaaagagaaaagaaacaaacaacaggtaagacaaatagaaaacagctaacatagaaggccaaaaaaatcaaaacccaagtatatgctgtccacaagaaacacactttacatatgtacagacaggtcaaatagatacagacagcttaaaaataagtagatggaagaagttaaagcatggaaacactaacccaagaaagcaagggtagctatgctaataggtaaagtagacttcaggatgagaaatattatcagtgataaataaggatactatgtcttgcaaaaagagtcaattctctaagaagacataacaattctaaatatgtaccctagagctttaaaagatgtaaagcaaaatctgataaaaatgaaaacaaacaaatctgcatttatagttagagacttcaacacttttctctcataattgacagaacaagtacatagtaaatcagtaaggatatagaacacccgagcaatattatcaaccaactcagcataattcacatttatagaccactcctcccaacaacagcagaatacacaatcttttccattggacatgaaacattcaaccaaaatagactggctatattctggcttataaaaatctcttaacattttaaaataatataaagtcaagttcctactttatctttcgtttctacttatagttctctctctctttctcctcacctcagtggtcagtcaatgggtccctgagcattgggctccatcattgactctgtcctcacctaagttttctcactaggaagacctcatccatacccaaggatttagttattgctatgcactgataaatctcagattcataattttgcctaatatcacactactggactgtagactactagacagttgctctctggatagtttattggcacctcaaacccaacatactattgctaaattcaacatcttgttccacttccttaattacctaccgtggtgattcatatttccctccattaagatatttaagccagaattgtgcatcttatcatttatcacctccacatgaaatcaaccatgaggcattattgataaggtacccttagtatctctctttccactccgtctgttatacatgatgatacatatatatctgatgattcttgagaatttggttcagagatttttcccttgaaactattattagtatcttcaaaaacagtgaagtctgtatagcactgtattaaattcctggagctgctgtaacaaattatcacaaaccaggtgtcttaaaataacagaaagttatactctccctcttcttgaggccagaagtctgaaccaaggtgttggtagaaccatgctccctcagaaggcttttggggagaatcctttccttgccttttccagctctggtggctgtcagtattccttggcttgtagccacatctctctctctctctgctctgtcttcacttcaccttctcctctatgcatctacctcaaaactccctcaatctttcaactctaaggatacatgcaattacacttaaggcccacacagagaatctagtatagtccagtgtaaacctcttttcaagatcattaatttaatcacatctttgccatataaggtaatgttcactcttgccgtacgagttgctattgacaagttccaggattaggacatgaacatgtcttttaggggattactattcagcctactacaagcactctgtcatatatttaaaataacatccacagttcacaagactatggagttaaagaggattcatacacgtttgaaaaaatttaaattagcatgatgtcttcagagaacatttggcaaagtcaagcaaaagtcttggaaaaaatgtgcatattgcctttatagttttttagtttttatttttattttttgggggatggagtctcactctgtcacctaggctggagtgcagtagcgggatcttggctcactgcaacctccgcctcctaggttcaagcaactctcctgcctcagcctcccgagtagctgggattataggcacccgccaccatcacattcagctaatttttttgtagttctagtagagacaggatttcaccacgttggccaggctggtttcgaactcctgacctcaagcaatctgcctgtgtcagcctcccaaagtgctaggattacaggtgtgagccaccatgcctggcctgcatattgcctttagcacagcaatgacaatttcagaactctagcataaaaatatttggttcatatgtgaatgtgcaagtgtgttcaccgcagtcttttttatttgaaaagaaaggttgaatctagtataaaatgcccaataataggggcttacctgaggcttaatttataatatatatataaacaagtgtatatataaaaatatatgtacgcacatgtagtatatttatacaatgacatgatgtgtagccattaaatttggtaatataatgccatgtttactgacatataaaataattcaccatattgtcaaatgaaaagtttataaaatggtatgtgtagtataataacattttagtaaaaatatgtatttaaaacaatctggataaattgatcccaaaaatattaatactggaattgtatccaactcatttttacctatgggtttaaatgttgtgcagtgagtttatttacaatattttaaaataactaaaaagtgaatatatttgttaaacacatattaatttttcttcaaagtacatttataattcttaaaacttcagacatttcaatgtaatttagatatgaattgtcttctgataaagaaaaaactatatagaaatatataaaaataaatttgaaatatttatttcctaaacatcacaaagtccaaacatcgaagaaatgtgaaccaccttagcaaaaatattaatactagcattatccatgtattgtcctaacaaatgggagaaaatcttttatttctgaatgtaacaaactttcattatatttaagaaaaagcgagcctacagttgtcagtatactctatgagccatttaaaagccaattatgcatgcctggtaaagtaaatgagaccatgaatgaataacatccacaaacgtaaattatacacataaattataaaatttaaatgtttctggaagaggcactaaccttaacataatgattagcataatgattagtgctgctgtccacaaaatacgtcttccaagatatttttatttatatatacctcacaaaataatgatattttatatactactactagaaagtaacttttgtagctcaaacctaaaaaaattcccatgaaattgttatttcactatcattaaatgggatctaccaattcttcccaaagcaataaatattcagtttctctggtatttgcttcttcacctggaaaatggattaatcaaaaaatgtcctgttagagttttatggagaattttatgtagctcttcataaaataaacaatgaaaattgtgcagtgctcacaggcagaacatctgcattaatattaaggtgagaaatggcacacaattaatttaacaactatgaaattgattaggttgttaaaattttcgtaattcactgtatgactctctctttgcctactaagtgcacggcatttcacatcaaattacagaaatagttttcctaaatggttgttgtaggttggaattttcaacattttacaacaaagtatagtaaatgattcaactttgttagaattataaataatctaaaagaaatttttcaagatttatgttttatcaacagaatttgctagattattctaacatctgatagaaaactagggttgatatgtcattaccacctgtcactgagagaatgcagtgctcctcttctaacacatacctaattatgagagaactgtttcaattctgccaactcacagacttctttaaaggttgcctaccccaggacaacatatatagacatcctgggaatggtgatacacctcccatatcctgggagcatgagacactagttaagtggaaagtgcccaggaatttaaaaaaaaaaaaaaaaaaaaagtcaggcacgttggctcccgcctgtaatcccagcactttgggaggcttaggcgggtagatcatgaggtcaggagttcaagaccagcctgaactacatggtgaaactccatctctactaaaaatacaaaaattagccaggcgtggtggcatgcacctgtaatcccagctactcaggcggctgaggcaggagaatcacttgaagctggaggtggaggttgcagtgagccgagatcatgccactgcactttagcctgggcaacagagcgagactccatcttaaaaaaaaatttttttaacaattcctggggaagtatagggcaaagaatatgaagtcatatgaatttactgggcatagtggaagttggcaaagagtcctaaaaggatgcagtcagatctttgaatattaaatagggaactaagcaaacttttctcctttttagtttacttgactcctgataagcaactgtgttaacagcatgcaaattcttaatttcaatttgcagaaagctaaaagatttacattttccagaattcacctcctctatttctgatttttacaccatcctcctagttttattattaagaaaatcttttactataagtttaaatttatgtatacttgatgtaaagataatacaagctggccagtcattgagataaggggaccattaatactttcaaggataaaattagtcatttatatcacagtctcttaaaattcgtttttctttaaaaccatctgggaatgccttcaaactgtgaccaaactgttctctgtgggattctgatttaattcatggcatatctgaaagagaaaagttattaatcacaaattggaaaagataaaagcagtagtttggttgaagtacttatttcttagtcatgatttttttctttttgtttttgaggggagaggaaattgcgaatacaagagatggtcaaattgactactaaatttgcaccttattcttcatttacttcacaaaaccaatttattgctaaatttccctagcagcatccatctaacatttactgcattgtttattccactgaaagaaacttcttttaaatctaaaatataattacttccacctatccatttactccaacacatatttactgcctagtatatacaaaaatctttgcaagaatccagggagatgcaacataaccacgcattccttggtggggcggggggcggggcgctaaaatttgatttttattttctttcctttttcattgttgtcatttcttgaagctcaaaatctagaaaaaatatttcaaaaccaaaaaaaattgttataaaatggttccacaaatcatcactataagagtttagctgactcatatttcagcaaagcaacatactttacattattttgaaatccaactgtaaaactaactgtttaatatttggccactttggtctgaagttggatactggtgactaaccatgttcatgcttttatttgaggtaaacttgaactcaggctccaactgtcctcctgttgatgtgagggtgaaggaaggtgccacgtccacttcccagggactggcgtagtggtacagtcatgatgacaggacacactgaacacaaacctgcaaatggaactgaatctgtgccaaggacacttccatatctgcctaaagacccagagtttagtcagttccccggacaggaatatgatattgatttcaagaatgcagaaaacaacttccctctatttttcagcctgaaattcttattcattcacacattccaacatttattgaatacctgctattgtctagatgttatgataggtgctaaggacaatgcagtgatcaaaatagacatggccagcaccttcatggaatttaaactacaggatagactgaggggaggttagaaagaaagaggacaacccttctccctacttctctccccctgcaactcccccaatatgaccatatcttagtggttttagagttactttcataaagtcattcattaaagtttctctctttcccactgaatttgattgcatgatagtaaattccttgagggcaggaatcctatagcataataggttgtacatcctcttctaacagccaattgcctagtgattcacattgtgcaggctttttttttctgcaaaatggataaagtcacattcacttccaggaaaagcaatagcaaaaggaagttatgacacccagaacactataaaaacacagtgaaaggcaaaagataaaagttctccatagagcagcatggctgtgtggtagtgatgtagttctgtttcagcgttcagacattccatgtgcacaagagctgctgatcctttcttgtagccctgctaccctaacccccatctccacacccttagtgcatgtagaaaatcagtatggcctgatttgaggccacgatagaagaagatatcttccccttaaaaagttctccccaaatggtcttgataaaggattgtcttattcatgctctgaattaaagtccagaatgccttctcttaaatacaaatgctggcggtgactgcttgtgcttttgaattcttgtactaccagatttattgatttagaaggtctatcttgttcagaaaggatttcaagaggataaaacatgtgtcatattgataaggaggtagagaatagtgttaagaatggtgggtcaggagccagacatcttgcctttgcaccaccttgctatttgtttcacaagttactccctgtatgactatgacaattctgtgcctcagtttccataaaatgtggacaagaatattactacactataggttattctaagaggtaagtgaaaatacatctaacacacgaagtatcatctgcctagaacaaaatacgatctcagcaaatgctagatattattaaattattgttttcctcttataaatgaattatctcaattagacctgaaatcacgtaaaaccaataaaatgagattgggtcccttcaagaataccaagtaaaaatggtttgaagggacataactgtaatgaaggagaaaatatattaggttaaataataaacatatgaagtgactttggttaagaagatcaactattgagatataattatgaacttactaatgttaaaggcattatagattttgaattagtagaaatagaatgccttgccataatggattttggaaactgtagtttgtttggtgtgatatatgaagatgcatgaaaactaagaaagaaaactttcagagtttttatcatcttgtaaacataagaacaaggtgagccacagacacagtcggagattaattaaccaaatggagcagagagactgttcccgtgtggtagtgatatcatattgagcaaagccacatgcagaagtgaagaataaatggggacagagcaacctagcagatggggtaagtccaccttgggagaaggttggaggtggagttgggaggggagttatgcaataaacaaaggatgggacttggagggataccttagctctattgaatatgtgagtctgggatcttgaattatgcaaattcaccagcattagtaaaacagaagtttgggaatccacatcttctcagttctctaccgggcctcctaatgcaacgaaggaaccttagattggaagagcttgttcttcagggaggttttgtaaattggcatggcaactagcaaatctcagaacctgaaatttagattgagtcccttgctgccatcaaagatagtagaacgcactcaaagacagtagggagtaggagagacaaatcaacaaaggcagtgcccgggcctggtcaatccagcctcagacagaaaaccatttgctgtctgtcatccattattttgagatactctgggatggccacaggtttgaattgtaagtcatggggaaaatgctgagttctgagtagatcacaagataaatgtggttgccaaatgttatcatttttgattactgataggtgactgtccagagctcacagtttttatgggaaaaataatgcttaaagtgacctcattgtgtcaatgctcactgtgttattgcaaaatcatttcagaatacaaagatggtctttactgtcaagcctggatgtaaattgttcagatctctgatcaaagaaggtatgtattaaatttcacttaactttgggcactcactggatctttaccaaaagatgttccacttctctgagtttattcatctatttttggtaacaagattttatagcaaagctgcttgatacagtttaaatctgggtccccccctcaaatctcatgtcaaattgtaatctccagtgttggtggtggggcctggtgggaggtgagtggatcatgggggcagtttctcctgaatggtttaccaccacgcgccttggtcttgtcatcaagataatgcattaccagagatctagtgtttaaaagtgtgtagctggggccaggtatggtggctcacgcctgtaatcccagcactttgggaggccaaggcggacggatcacttgaggccagaagttcgagaccagctatggcctacacggcaaaaccccgtctctactaaaaatacaaaaattagctgggcatggtggcgcacacctgtaatcccagctacttgggaggctgagccatgagaaatgcttgaacctgggaggcgaaggttgcagcgaaccgagatcacatcactgcactccagcctgggggacagagtgagactctgttttaaaaaaagtgtgtagcacctcccccgtctctctcttggtcctgcttctgtcacataagacacctgctcccactttgcctcccaccatgagtaaaagtttcctgaggcctctccagaggcagatgttgccatgcttcctgtacagctgtggaaccatgagccaattcaacctcttttcttcataaattacccagtctcaggtatttcttcataacagtgagaaaactgactaatacactgcttctatttgtttcagtggagggtgaaagtggggttctagggtttctaaaattcttccaccacattaaaatagaaaatgagccttaacaaatcagatcccatgggggcagaaaacaatctataatgtaagccgggagaggccatgccacgtcactagtgtcaggaaatgtcatataattagcacagccagggcatttgtcaaccaaggatctaaaaggatttttcaaattgtgaaaatctcaaaacagtcctaagagttactgtgttattacctctataatacctttgcaatgaaatctatttaggtcagtatatgaaattctatgagtcatttatatataaaggcaatttctctttcactctattctcttccaggatgagttagaacagcaggatataatgaataactatcaataaattgaacttcatttaattaattcgacattatcatttaatattaataaacataaaggtattattgctgaatttatcaacagccaccacttggaaggtgtgaaaatacccagccaataacaaaagcattacagattttctttatgtaaaatgcattatgtttttctcattcattttttataaagtgaacatttataaagtattttgatttttgcatgttcttataacattgtacatgcatttcttacagaaaaaatattggactccaaatcacaataaaaataacttttcaatgctattatccactggccagattggtaaaaattaagaagcctggtgacactaagtgttggcaaggatttaggacactggggatgcttctttaccacttgtgtgagtctaaactggcaataccacgtagcaaaacagctgctcatgatcttgtaaagctggcactttgcatagcctggcctcttgcacgtatttatcatgaaacaggcataaagacatatgtggcagcccagttgataatagaaaaaaaaagccaggaaatcttccaacaaaccaaatacacaaaaatgagggaataaatggatgaacaaattgtggaatagtcataaactgtaattagtacaacactgaaaatatgatcagtgtgcatcagtatgcatagatcttcaaaacaatattaaatgaaaaaaagcaagtggcagaagaatataaacattttgctgccattttcataaaatttgaaagcaagcaaaatccaacaaaaagaacgactttaggaataatgcatgtaatggtaaaacgacacagaaaagtgaaagaaagacaacaaagtaaatttcaagagaaacattcatcatggaggacaggagggcgctgagattaggaagcagagagcacatggggtatttcaatgttgctgatgatgttctatctgcagatggatggtgtggttagggtatttgttgagttgttatgtcttctatcataagtagacatggaagtttaatatattttttaaacacatcaccttaaacttaaatattacctttaaggatgtatagtttatagctaaaaagcgatattcacttcccccaaattaaaagttctagatcccagtttttatacagtcattaatagttttgtgaccttggacatgttacttaatctctctggggatattctttttccaatctgaaaatacagattctttgataggaaatcccttaggtcttttctggtaaatagtcttgtgtgtctgtgtgtgtgtgtgtgtgtgtgtgtgtgtgtgtgtgtgtctgtgattcaaatgttttcttttgattgttttttcttttcccgcagttttattgaggtataattcaccagtaaaacctgtatacatttatgtgagagtgagggtctgagctgctggtcctccacttgatgtaggggaggctgatggcaactgttgtggtatggccaagcctggattcctgggaccagcacttgccaaggctgagggactggggtgaatgtaatccctgtgatcagctgccattaggaatttaaacctactctcagaagtgtacagcagaactaaagaagagaaacaaccaagagtcatctgaaattgtgattggctcattaataatccaaggtcaatgacagagatcattgctcaagcatgttttcctatggctcctatgaagacgattgctctgcaggcttaggctgagtatgttgtggaatggactgtgaaggaccggtgtggcttccttacaatagcgactttgtctcctacttcacggctcctaacatgtgccctgttgtcctggaaactggccaagatgattgaggctagggaaaaggtgcaaaagaagaaacaaaatgtcaagaaaatattgctgaagctaatgattcaaaaaggacaaacggaatgagaaggctctgtaacaagagacaaaccatttggaaaattctgcagttttgaaaggacccactaagatctcttctttggatttcatgatactgtggtgtcatttaatacacaaagtctcgccatatgggaaaattatattggttctgaccttagtactgcagtaacttttagacttgggtataaacacttgttggtgtttgttggaagttattgtaaattagcatttattatcctacaaagattttataactgacttagtcatttcccattttgcatcttatgtactgaaatgaaaatatcctgcagataaaaatgacttcagtcaataaactctattcaaataatggtttaaaacgggatcctcttctggacaaaggtaattaagaatgtaatagtcaaaaccatcctctttgaggtgaaaaatatgctttggcttaaaagacaccatatgttaatcacatcttttatcattattgcttatttttcggaatagaatcattctggctttctcaaggcaactcatattattaatgagtacttctattttctgtactttttctgattttcacctttgagattactggtaatgatcaagacactctgaatttttaacctagttttacaaagagttctcttattagattggctatgtagaatcccacctgctggatataacaatttttgtattgatgaacactgccattttcttcgagataacttgttgagaacagtgccacttgcagtaaagatgtcaggcacactgcaatgttttagaaccagtttatttttgtgctaaacagaaatgtgaaatagtttaaatgtcttatcaaataatttgctgattgtatagatacaacttccgtttttttattccagtctttgttttaactcatgtggtggtgtcttatactttttgatcaactagattcaacgtgaaagttaaaatctcaaatttcttttagaaaacacttaaagggcaatagtcaagtcatactttataagtggtgaggaaaagcttaaactttgcaagaattttgttgggcatggtagtaattggctaaaatgggtaaattatgttgaaatgagaatgtgcaattattagaagtaaggagctgaaggatatttccttcagttaagtagtgtaactgaaacgttttactattaaacataggttttataaatgcatcatccagttattttattcactggcagtatctgatatttgttaatgttttccccacctctgatattaaattttaaattacaaaaaaaactgtccaatagctctaattttaaaaggaaactagatattgaaataaatttttttaaaaattatatatatttacagtgcacaagttgatgttttgatatatgtgtccactgtaaaatgatacagtcaagctaacacatccatcacctcacatagtgtgtgtgtgtgtgtgtgtgtgtgtgtgtgtgtgtggtgagaatatttaagatctactttcttaaagtatacattattattaactatagtcacaatgctgtacaatagatctccagaatttattcatcctgtctaactgaatctttgcactcttaatcaacacctccctattgcactcccctctctatgcccctcaccagctctaaggaatattcttataattctataaagatctaagccttcttccatagacaaagtccagtctacttgaattcagttctcccaaacaggccctcgagaagttacttaagtgtacaatcagttcatataggtctttttaaaaaaaacactaagttatttaactataccacaacattaatttcctttcctttcctgagttctgccaccctaggatataaatttttcagcagccacataaagtggagggcccctctggggattcagcagagccagctggagatttttttccccatacagttcaagccgagatttgactttaaaatcaaagtggcacgtggtattacgcagtcaaaataatatgggactgaatactagaagcctattcctaatcatggcctcacattaaggagttagttggataactggggctaagtcatttaatttctgtgagtctcaatttattcatctgtaataaggtgccagaaagggactaatgctctttgggaacattttctcttccagcttactataattctacctaatttaagtttactgttgagggctgtttgacataatgatcaactattttaaaaagtgttcaattatctcgtagaaatcagttaccaaaaccaaacttctaaaaaccacttagctctaccaggaatttttgttttttgaagaagttagagggagtgtgtccatacactgatggatacacatttaaaaatcctctaattcacttgttcatctaatgttaacatagtaggcactgttatagtcagtgcagacatagctgccctcatggacctcacactcttgcatgaataaggagaacctatcctgaaagactaatgatgggttgagagcaaagacatgcttatcactttgactcatttactctctaatctcatcaccagaaccttaatgcattttatctgttagagatttcagggcataagacctatgcaaatatatgtgactgtcatctatttattcttcagtcatttccagaatatgctagtatcacaatgtggataggctctaaaagagaaagctctgccaaaaaaaatcagtgattcattgctgcgtaaggaataaaatcaaactctttagtttatgtgctgaagctcctctgtgggctcctctgtgattcacatctggtcacacaccctacattccagccatcacaaattcctcatggtaatccaaatagctcagccctttcagttactcacttagcccttcagcttgaacctgggtataaacttctccttcaaaagccaacccaaaaggtatccctttcctaaagacttctccaacctgttttctattttatgaattaaaacctcttccttacaccgaaaatattgcatccctatacaacagcatttttttttactgctttatatcatagactctcatctacatacacctcccccgaaaaaatgctattccccatctgaattcttgaccatagcatctttgagcacaatgaaatgtgttgtagcgtcccctaagtgtggcaatgattggttaactgattggttatacaatacagagataactgatacactaacttctccttccccttgccttattttttaggttctgcacctggttttctgaacttttttccctaaaccctggttctccttgaatctgctcaaattctaaaaacagcctgcacgttactctctttcttcccctgtgctgcaaggctgccagcacccagtttgtacactgtgagtcttacatacttcctgttggttctagcattaccttcttgtgttcccaactctcaactcctctggaggaggaatgcttcctctgctggtcctgcaagaggctggttcttctcaaccaagtcacagagaaatcagcagggtgacaaaatgttgcaatacattgtaaggagtacccatgagatattgctggaacccagaggaggtggtatgtaaatctcagggaaactgtaggaatcctcaagctgtccttgaacaatgtttagaggtctgccatgcagaaaaggaagtaaggacatcccaaggaaaggaaataagagcgggaagacagagagagaaacatcataaaacaccgtgttatttaggaaatgacaaacaagcataaaacctcatgatgtagaggagtattaagagttaaggctggaaaattatacttgaccaggtcatgagagactttaaatggcacactacaaacttgaaacttcatctgacaggtcatggagggctagacatgaaatgatttaatttgggaacttagcaaaattaaacctttcaaaatgatttatataatgtaacttcagagaatagtttggaggaggataaaattgaacatggaatgagaagtaaggaggctcttggatttgcagggaaaagagatgatgcaggtatcacgtaccagagaatcccgagttgtggacaggaagcttatctgagagaaaggtaggcagttagtcagtaaaatttgatgttttgatacaaggaagtaaaagtgtaggctgccttttaagtttcttgcttgagcaactataaggatgatgtatatgaaacagaaaatatagtcacataaaaatactgacatcaaattctgagtaatggaaaggtattatggaaagatgaaaagaaaaggaagaggagtcaagaaaggtaattcctagaattgcagaaaacaatatagaagggggaagagaggggaaacggaaatagaaagttaaaatggtaacaaaggaggcagcagcattcagctgtatctcaatctccacaccgatggagggagggcactgatgtaaaatcaccatgatttagctgcatccataatttaactctggaaagagttttggtatatttgaatgcaattgctccagatgttctacataactctttaatcacagtaataaaaccactctgcaaaaatgtaattctggagagataaaagctgcccaacttctgaattctttctttcacttccctcttccaacatatgaaaagtttaaactgcaaaacattcaaagccaggttagcatcatgtcacacatataggagctggatgggaccaggaaagagaggacaggctgtaaatgcacagagagctgaggcgggcttagggactcaaacctaagcagatgcgcacacaggtgtcacaaattagacaagtaggtagttaaaggacaatagactgcaggaaaagtgatgagaactatcagcaaagaagctcaaaacatgcaagatggttttggtggtaaggagaaagttagaagctcagagaaacagtttcaaaggtagggaaggttagaaaatatccagggaagcgatctggaaagcagataaacatggtcatattagggagatactggtaatgatttcttgctttaggcagtgatcttttatgtttcttttttcttttttttctcatgcaaagaaacaattccaaagcatgattgtctgggaccagcaggcaaagatgtataaatataagtgcctgtctggagacaggaacctaaaagccagtggttctgaaactttagtgcacatcttaatcacctgaaggcttgttaaaatcctatttctgggccccgaccaccaaagtttctgattcagtatttccaaactagggcctgagaatatacatttctaacaaattcccaggtgatgcgatgttgctggtccagaacccatactttgggaaccacattagtcatcggttcttatccctaaatggacactaaaatcataggacatgctttataaacacattcatgcctgagcccactctagagatggatactgaggtggtctagaaagggtcctgagatctacacttttttaaagttctctagatgattcaatacatagctgaggttcaaattacagaattgaacttcaaattaattaacttcaaatagaattgaagttaaatgttgacgggtaagttccttcttggattcagcaagacatcttcctgaaggtgaaccagctattctctcgacacctaggggttaatatttttcattggtgtctaacagtgattatgcttatcaaaaacacattacttacagctcctgctaagctagactcaaacaaagtcctatttatgccaataaagtatttgggtaatatcactgatgatttataaattttcctagaaggtttaatttaccttgaagaaacaaagaagaaatctctaacaatagaaggaagactatggttttctccatccatgctgccaggacttagaagaaaaacaattttcccaaaacaacaataaagcagccaaggggaaaatccaataaagtttctgaggaatgacagtgctccaggaacagatgggttgattaatttctgaaattttatgaagaatattggctgactgaaacattgacagagatttttaatgcaactttagagataagaaaaataatcaataaagcctcacaacatactagccaagtggaacacctgaatgcaggcatgatgtttttatcttttttgcatttttcagaattgttaaataattgatcaattaacaataactaatggaatacagttgtccctcaatatccataagggagtagttctaggacctcctgtagataccaaaactcgaggatgcccaagtctctggtataaaatggtatggtatttgcatataacttacactttaaataatctccaggctaattataatacccaatataatgtaaatgttatctaaatagttgttacactgcgttgtttagggaatgatgacaagaaaaaaaagtttgtccatgttcagtacagatgcaaatttgtttttgaatatttccatttgtggatggctgaatctatggatgcagaaaccatggatacagaaggctgactgtacattatgctggtataatcttggttttgtttactaatctttctcttgtataataaatatggtttaaaagattatatgcaaacctggcatttctacttgcttcttataatctctgaattgtccacttaatacagttggagggttatattaaggtagggaaataggaattaacatataaagacaaatagtaattaacatatataggaattaacttataacatatagtaaatatggtttaaaagattttatgtgaaactggcatttctacttgcttcttataatctctgaattgtccacttaatatagttggaggttatgttaaggtagagaaacagaattaacatagaaaaggcatttattctttatactagggctaattttgtcatcaaaaatggactgtccacatcagaaaaaccttagcgcctccacagagctttggaagatttatgtaacacctcccatggggcccagtggtgtcacttgtatacttattatgacatattgccaaattttgcttacatactggtccttccatgacccaggatcaaacatggtgcatggcgaataaggaatcaacaaatgttgtgaagtactagactgatgttatcatctgatgggtcctacattattttaactttttggaaaattatctggctatgccacatttcagaatggtgtgaacccgggaggtggagcttgcagtgagccgagattgcgccactgcactccagcctgggtgacagagcgagactccatctcaaaaaaaaaaaaaaaaaaaaaaagaaatctcatctcatatgcccacatttttcaactgaaagcaactgtttaaatctctcatgccccctcctagagcctcatcttgtacccctagccccactccactatccccattcatttcttcatcacttttattaaccaccctccccaagagcatattcctagtccccctgagaaacacagtttatcttcagcttcatttgttacacttactccttaatgtaggttacaaaaacacactcgaacctccttgacaggcatcctagcattttgaaatttacctgattcctagcctgctcatcatcacagacataacatttataaactcattccactccagtgtttatttcatatattgctgaaatctccatgaaacgcctctctcatgggaaacttagttcaaagaatattagtgttttaaaggaagctcaaaatcacatgatgacccctgtcaattgatatatgggtaaactgagaccctgagggaggagcacgttatatgctacaaaacactgtggctagcaatgtcacgttaggaagaggaggaactttgtgcaaactggctacaatccactgaatgcctccttcctgccttgatgttcctttgacatcgctggtccccgccccaaaggagagactgacctgctgaggtgagtcacctgctcaggcccatcacagcaccccgtggcctctcagcatcctgctgcccccctgggtttaatcctacccatccttctttctcactagcccatgagttccctgtcatggggattttgccatttctattagtgagttccaagcccttttcaggagatgatatatttgtagaactcagacttcaaaccaaacctttaaatccagctccttcaacaaataatcatttaaaactttaagttaaaacatgcctagttgttattataagcaagaaattaagccattgagctttgttatttcatattcattctttagacaaatatttattaagaagttctatgctaaacagggtgctgagaaagagaataatggggacaggttgaattcctttacaaagggtgatcaagagcagcattatgctgggtgcagtggctcatgcctgtaatcccagaattttgggaagcaaaggcaggaggattgctagaggccaggagttcaagaccagcctgggcaacatagtatgaccttgtctccacaaaaaaataaaaataaactagccaggcatggtggcacacacctgtagttccaaactactcaggaggctgaggcaggaggactgcttgaggaaaagggttcaaggttatggtaagccatgatcacaccactgtattccagcctgggagatggagtgagattttgtctgtaaaaaattttaaaaaaagaaaaaaatggccgggcgcagtggctcacgcctgtaatctcagcactttgggagactgaggcgggcagatcacaaggtcaggagatcgagaccatcctggctaacacggtgaaaccccgtagctctactaaaaatacaaaaaattagccaggcgtggtggcaggtgcctgttgtctcagctactcgggaggctgaggcaggagactggcgtgaacccgggaggcagagcttgcagtgagccgagatcacaccagtgcactccagcctgggtgacagagtgagactccgtcaccaaaaaaaaaaaaaaaaaaaaaaaatagagagagagaaaaataagtgccagcaataagaaagaatcatttatgtcaagaggactggggagttatgaggggtcaaatttccaggcagatggaataaaatattttagaaaatattacttatcattcatcttatatgattgtgatgtgatgtactcaatctcaattatagaatgactaatagaatattttgactcactttcaatacatgtatataaaaattatttttacatgtccaatataaataaattgattttcagtatgggacatttgtggatttaacagtggttaaacctttggccatctatttcctatctttgactaattaatgctttactatcggtacattacttttactagtatctgtctagaactttcactaagtttatatccttcctaagtcaattaaacattcaaatttggggggaggtcaagaacataaggtaattcagaaccaaacaaaagtgccagaaataacctatatagacacacgagaagaaagatataagccatttcacttataaaatgtgtcatctgtgtgacagctaggacattataaaggacactcactattcaatcagttttacatgtgtctaatcttcatttcagcttttgttaatttacatgaaccaaatatcctcaaccaatatttatttacagaaggcagggatgcttacatatttaacgtgcctctttcttgaacaattaaggttaaaaccaaaaatatagcaacactctagtattctgtggactgactcaaacattttgctttgagctaagggtacaacaatgttgatttaacaatgtctacttaaatagactgaaggttttactttcatcggcctgaattgcaaagaattataagaggcaatgagaactttctttcaggtatatctcacaaggatattctaacatctttttttaccccttgctattaaagttcttgtctgagcggcaccaaagccaggcttgttcattgcgttctctaaattgtgtccttattgcagacctcatctgtgtttgtgcttctttctctttgaggtatctgttcatttatgctttcaaatagattactcaatgggcagcagggagctgaggtttctctagcagtgacagatcgtttcttggaaagaagagactgattctctccagggcaagcagatggtcacacccctagaaggttccacagagattcacctctgtcatgcaaaatttctctgacaagtgggaagagaaaggtgggaaaaggaaggtaaggcaaagacaattcttattccctttgtttaagatgtcatcaaaatagcctgcatcctggaagaactcattgaagtaggcactagtaaaaatcatggtaaaactcaaaaataaaaggacacatggtgatttcttaataccgcaggcattctagaacaaagcagctttgccttcagactaaaaggttgtgattttagcagaagcaattttatttctattgcatctccacatgtaagacgtatggcaacagtaggaaagaattacggaaaaaataagagaagtgacacttcaagaatttccaaataatcaccttctgggacagctaggctgtgaagtgaaataaaaccagaggagggtatatcttgcatgctactagagatacatttctgacagttatcaattcggcaatacaacaatttatttgatttccatttcactctacgattctcggatgccaaccaattgtcaggcactgggttaggcatcagcagaatatagagcctagcgctaacagaccttcgttcaattatcagctccacccatggtaggtctgtggtctgagaacatattctgtaaaccatcatatcacttttttgtttgtttgttcttttgagacagaatctcactctgtcgcccaggctggagtgcagtggcgcgatctcagctcactgaaacctccatctcctgggttcaagcaattcttctgcctcagtctcccaagtagctgggattacaggcgcacgccaccatgccgggatatttttttattattattatttttagtagaaagagggtttcaccatattggccaggctggtctcaaactcctgacttcatgatccgcccacctcggcctcccaaagtgctgggattacaggcgtgagccactttgcccagccctgaaatcactttctacataggatgagcatgaggttaaaatgagattatttacataatgtgcctagtgtatactaagcactcaaaaaaatatactcactattatttattactactagcatcattattacagaaatacaagtttgtagaaaatacgccctatgctacaattaataacctagtgggagatcaaaatacagtaacaggtatctataatgcaacgcagtagattacctggggttacatagatgtgtagagtactagacatatagactagatatactgactactattaaaacagaaaggacaaagaatgagaaagtggtaaaagtagcttcacacctcttttcaaaacctaaagctagaatatttctgctgaaggtttgaatttaaaaagaaaaaaaagttaatgtcctcatataccaggaatctatcagagcacagtaattcaatcctcctgatctggttctatttttatttatagctgttattcctttctaacactctaaaagaaacgcattatgtttattatctctattttctccgactgggacgtatgctccatggctccacaagggcatgcctttgtcttctgttgatgttcttgctcggggctgaactcaaagcacctagaatagtgcttggcacatagtagtcattcaataaatcggttttggttgaacaaataagtgaaggaatgaatgaatggattgacaatggccattctccaatagcggacatcttcagaatgtgaaatacatagaaaaatttgtcaaaaactgccaaagttgaaaagaatacatttctgtctataactcctaacttaatgaaatctgatttataaatagtctacatatcttggttctcaatgcagaacataaggataactgaacagaaggacaactgaactatcctttccttcctttgttccagtagtcaaataaagggaagtttacataaatgtagctacttagcaattattagtggccatgaataagctctgtttgctcccacttcccctcaccagttctgttcctggatcaaggcacactcatgcaggaggagctgctgatggctgagcatcatctagcaccaaccattggcagagccagggagttctgtttctgcagcagaagggatggcatgtgttcctggttaaaatttagaattcattttttcataaatatagggtcctaaacatggttttcattagagtaatactatttagtttacagaaaatgggtcaaaagactctagaagtcattaagttagaagccagtcactaccgtgtagcacaatttccatgggaaaatactgttcagtgtccaaacgtattcagttaacaaatacacctttggaacacaacctatctgtaaattggtattgccgatatttaaattgtattaagtgtgtgtttatcagctctcttcggagcaactcaagtcactttagatatgccaatatggctacccaaaagggatccgtaagaaaataaagacatgagaaaaagctttctgtcttttattctaggttttaaacctaaaccacaagatgtgaaatactgtgttaccgtaacaataaagaaaactacaaaacccaaattacttggatataactgcccagaaacctttcccttagtgaaaaccagtggaatgttcccacctaatcaatcagtaaagtgttccagttatgttttgcacatgtgctcagctactgatcccttcttctaaggaaagaaactgggttaaccgaacacacacaatagagaggcagaagataagccccagatggcagagaaggtgaatgcaattggaagacaggtgcactccacctgccggtgtgcagctaacttagagcccactgtgaccacgagggagacgctcctctttaaggatcagggcatgactgcttttcagtgttgcctcttcatttttttccccatatcccatctcaccttaagaaatatgtattctgagcacagtaaattaaaacttacattttgaatgttgctatagatgcactgaattgtttcatgagaatatcttctcatcaacacaattaaatcttccttggggagagagtcatgattttgacttcctttgtaatctcctcacagcatatggtgccatatcaggcaggactgggctgagggactatgagcctctactcattataggaacagcacatacagcctacatgcagtgcaatactgagagctgtatcctgcatgagtacaaagtccaggttgctcagtaaatatcagctattcttaaacttgttcagcaagttgctgtcagtgtcatcaaatgaatgataaaggaacatgaaataataagacagggatttttcagcagcagcagaaaaatatatcatgactagacaagtaatttttaaattctttacttggtagtactttgatgtaaaaagatggttggcagatcggtttttgcagaaaaaaaatatacagtatggttaatagcacttactaattgctcaccatgaacccaactttgaactagatacttcacataaggtgactcatttaagcctttcaaaaactttgatatgtaagacgaattatccttatttttcagatgagaaaactggactcagtaaaattaatttgtccaaagtcgtctagctagttagatgaatcatgatagtagaatctggattgtgaaggcagtaacacttcccatctggaacacagaagcaactactagtatcatgaatctgttgactatcttccaacaggtaactccttaattagcacctcaaatgttatcatttcataaattcgagtttaatattttccaagttgcttatgggctatgtccaatatcatctcaaaaatcaatataaccaaaatatagctcaattactacaaatcagttccctattccaaatgcttagatgttccagtaatgtcactactcccaatatctttacactccaaatctctattcaccctattccctctctaataactaattaccaatcatctttttttttttattatactttaagttttagggtacatgtgcaccttatgcaggttagttacatacgtatacatgtgccatgctggtgcgctgcacccactaactcgtcatctagcattaggtatatctcccaatgctatccctcccccctccccccaccccaccacagtccccagagtatgatattccccttcctgtgtccatgtgatctcaatgttcaattcccacctatgagtgagaatatgcggtgtttggttttttgttcttgcgatagtttactgagaatgatgatttccaatttcatccatgccaatcatcaagaaagcagctgctaccccttgaaaagtcactctactagctactgggctcaagcctatgagacatgcaaaaaacatcagctaattcactacttaaaagagcttaaaatctcagaatattcacataaaatgttaaaaatgtgaatattataataaagtaagtaatccagataaatgcaactggaattcagagaagagtttaccctcagctgagtagtcataaaatgtgtgctgtgagaggtgagatttggctgggccttgaaggatacaaaggacattaaaacaattattttaaaagaaatccttcctcctggtaaaacagtcaactagatagaaggacagaaagggaaagaaaacccctgaggctccttgtcctagtctctaggagcagccactgttaacaattcatcaagtagatggagcttgagtacatgcaaataaacaaagaggaaaaatagctggaacagcagagccctgacaaacaggagtggtcatggtggaggctgatgcaagagattattaggaaatgagggtaagcaatgatgagaaccaattgtgtcttcacacactcgtcccactgacacatctgaaggccaaccacgttctaggcatactcgggtctggagtaggcaggggaatactagcgaatgggattgttgctcttttggggggctccaggacaaagtttgaggagtttcatgatgacctcaagagcattttagaaaagtaaattttgatgtgagtttaatcagatcctagagattagacatcccattaagaagctgctatgtattccaggcataaaatgatgaagttgtgaagtcaagcagcagcagcagcagcagcagcagaactcatacagtacaaccaccttgctctctaacgtaatgagtaagaaattaagactaagagaagatgggtgttttgcctaaatttagaatgtaattaaaggctttataaaataactatggatataaaagtcttgaagaactaaataataatatctttgtcatttcagaattggaaaacatttctcaaacatatcttattggtaccataaagagaatttaaaatgcaactattttaaatttaaacataatcttttcatccagagacatcataaaaatgagaagacaagccaccaactgagtggagataactgaaatgcctattacagaacaaaactctggtatccagaatatataaacagctcttacaaatcaataagtttaacaaaaagaagtaggagagtggggaacatgtatgaataaggaatccacagcaactagaatattaataaagagagggaataaatcatcaacattaccaggagacatggaagaacaaattaaaactacaatgagatatcatttcatatccataagattggccaaaaataaaatgtatcaccaagtgttgacaaggatataaaacaaaaggtgttcttatagattgctgttgggatcataaataggtacaaccatttttggtaatttgcattatctgctagatgtgaagatacgactattaccctactgcaatccccctccaccctaatcagagtcccctttgttagcacaaggtgatgtacacgtgaatgttcacatcagccttatttggaaacatcttaaatgtccatcaacaaagattgatacctttatcatgatacagttctacaatggaataccatatatcagtaaaaatgaataaatcagatctacatgtcatcaaaatactgaacaattacagtaaggtaaagaagactacaagagcattattactacttataaatagtctaaaaaagcaaaacaagactatattgcttaggtacacatacatacatagcaaagaataaggaaatgcatgcataagaacaataaacacaaaactcagtgggctgagtccctctgagggaagacatgaagagtacactgaagtctcaacagtgtatgcaatgatttatttcaccatctgggtggtggacacaaaggggtttataatattatttaatttttggtgttcctgaaatatttcacaggaatttttaatgaataataaagaattaaaaagaatgtgtgacacaggtacagagtaaaagagaaaggaaagagtcaaatattgcttgaaaatttttcaaaatatttactcccatttctacttccctggacttgattcccaataatgtaagcctcactaaaacagcctcttcatgcttctctctgtcccagtctggtgttagacccatctactcctatcagtccaagaggccacttcttcacgtcactgcctattcagaatctgtcagtggttcctatcaaatctaaacattcttgtatagccattaatgaccctctcaatcaaattcatcttcaggtctaattaaagtggaggaactggaggagagaaccatcttctggaccaggaacatgccaagttcatttgcacctccacgtctatgcaaatgttttctctatctgaaagtcggtccttcttcctatgtaagtcttacaaatccatgaaaatctagcttcagatcttccctattggaagcattccaaaatgatctcattctctgttgagcccctactcctacagaaaagcccaaaataagtacatttgagcaccagtttcattctgtaacccattattactaattatttcctacattttaatcgtattctttgtattacatttcaagctacccaaggagtttaactaggtcttgctcttctatattcttcacagtaataagtacccaggagatgttacaaatattttttgtttgcccatacttggaaaggctggatatatacctaccaaaatacctgacatctatcatcaagatcccttaggattcatatcatcaaagcagagtgttttcaattatctataaagcacatgcaaatctagaggaattattatgcaccatagtttataaaaacatggtgcatgttcgcattctgtctcaccattcctcacaggccattcgaagctgaatggtagatgtggtatctacagcagggtgccacatggaaggttaacatatccccaaggctggcccacctcaccacatcattccagtagttcagaagcagatagtagaacagaatacactacatgtctggccagaaacaaaactagtataaaaaattcatgaaaatacctagaaggctgtgattccacatcagtaaagatgttagattccagtctcccctgtgagagccaacccacatctacgtacctacatagagatcagcctcaagcaagaaaggcagttgtagctgcttctctgcctcccacaacactttccacctcatccctgtgatctgatttattctttgagtccttggtgaacttttgctttcttccacttacaaaccacataggggccactgtctctggtctcccttgagcttctggtctcctagagggagacaggcatatacgcagaaaatgaaaaacaaaactaggttataattacgtatcagactcaatggagacacaaaaaggagaactcaatgtaagaggtgaggggtaggaaagaagtttatgctaagccttaaagggtcagaataaagtaagacaattaatctactaatatgttaattttgaataagaaggaggaggaagaagagggaacaggagtttgttttttctttgcttcctttttaaaatccttattgtatttcaaaaccttacctctgcttgccagcagagtgcatgttgcctagttgggaaatgtagcactgcgtagcccatcaccttatattcaggctgggatcagctcagtgtttaccaggtattaacagagtaaacttaggaccaaagaacacagcatctgacattgcaaagaagtgccatgcaaaagctgtgtaacaccatcctcagagttatggcccttatgcactaagaatacagatgtgcattcacttgtttattcattcactcaaccaatgtttacccaccatttattaagtgccaggtgctgtgctaggcatcagtgatatttggtgaacattctatatttagttcttgatctcacggaatgcacagttcagtggggaaagcaatctgacactcacaagtcaacacatcattattgaccgtaaaaggaccatgaaaaaggaataaagtgctaaaacagcattcagctggagaccttccctgattaaatgacttttcagctgaagtccaggaaagagggaacaatgtaagaaacagcattccaaggagagggggaaagatttcttagcctgctccatagaagctctagaatcaagtgagtcttatctgaactacctaggcaaggattcacaggaaagacttccaaatgcattaccacttcaagattcccctgctgaccctcccaaactctaaacggaaagcacatcctaatttgaaaggatgaaaaggtgactttgccttctgggttaatgtctacacgaaaatagctttgaagagagtgaatgtgccttgtctttttgctagtatagtatgatgaatcatatcaaagaatggttgtttgcaaagtctgagacaagatcaaaatgccattttcctctgaaactgcagcatgtgttttgtaaagaaatcttagtgatatctagcagggaaatttgcagtccagaaatagactccacactgatttctactgaaattgaaaccaagaaagaaggggtatccagggaaagggtgtaatcatgaggttagaatgagggttagtgccagtcctcctatcacatactcagatgttctccagtagtagaattaaaacagcaagttactctagcagatgttttcaaattagctaaaaccgtgtcaccagagtaaagcagcaaagctggaaatgtgcccagagagaccttcccacaagccgcctgagggagccatttaaatgtctctgagccctcctagtgcagagattcagatgcaaggctagggagataagcaagtcacagcacaatgtctcctcatccaaatgcttatccatggcttcagtaagaccacaactctgctgaatattaagaaaacctggcaagattgagcagttccaaatcacacactttgtggtttgctgttgtgctgttgcttacaaatctgataagaaaacattgagagaagacagagaaattgtcaatggcaacagatgagcaaaccatgataagtgaatatgaaaatgaacagtttggttgctggcaaatcctagggagagggaggaaggtggtttgcatcttcataacatattcagaacactgatatctagttcacaattagatatccagtgggacaatcacatcccagctatgctggttgtctatccaagaaaaagtccaaggatctgagccaaatatctgtggatatagatccacagggcttccttttgcatgagctggttttcctaagtgggatgttacttgctgcccagtaatcattaactcctataggagggagaaaataataaagcaaccaggaaaaatcttaagtcaataatggatgaagataaccctgtttctcacttatacaacagctatctgtcccctaccatttactagagagaaggatgggaaatggttgggtcaacacggctcctgtgcaataccaacctctgtacaatcagactaaagaacagaagacctcaaagggatgtcattcacctttttaactgccttataatcacacctcatttttttcttgttctcaatcacatgttttgctctgtaggtgtgtgtttggcagggttacagggaaaggtgtagcaaatatacagtatacagcattgtataagctaaatagttacatcttagaagcaaaagaactggtacctggtatctcatacaatcggttatctgtgggtgtctaatagattaaaatgaatgtcagaagactatttctaaatcctcctctgtggtaatgcaatgttttagatcttcctaggaacagcatctttggcaattcctgatagaccacacaactagagaaagtcaccttcatcgggcagtaacaagaatcgagctacaaattctcatgcttcggaaaaaagaaagaaaaaacatcttttgagggacactgtagttattcctctctgaaaatagagaactagtagcacttaggatcttaggaaataaaacagctcaagatatgggatgtttttgaacattcaggtgtttcaacaacaacataaagatttttctacaatgctagcaaagtatctttttgtgatagtgtttctttaaaataaaaaaaatgtacaaaagaccaacataccacagacataggcatagattataactatgagaagtgaggattggggaaacgtgtttaggtttttcaagagtctttttagccttcttatttcaatggtgttcctgtaccaggggaaatataattaccaatggaaaaagagaaaataaacaaaataacctaaaattgtatcattttcttaatttaagaaaagagaggtaagtgtgatttctatagagatgaaatctacataaaagtagattttaattggatgcttcctgagaggaaaccaatttcctctcctctgataaacagtggagcaatttgtgggaatggtcatgaaggtaacatgaatttgagctgatcatagaaatttcactatagaaatacacattagataacattttactattatctctgaatttgaaatattacgagatcagaatcaaaacactgaattctttgtttctgaaagagttgatgttcaaagaatatggtattcatctcgattaagttgtagatgaaactattactttgctgcatattagtgaatattgctcatattcactaaaatgagtactttgtaaaacaagtccccctcttccaagttttaattttatatttaaaaaaaatcaatctaaatggctatatggaacaaaggcacacatatttaatagagttaactcaaagtgcatgcagtttctattcccaaattgggttgaataggacacttaagcttagaaggatttaaaaagtagaacactacaattagttttaggctatttctctatatgcgctacataatattttggaaggaaggtcttgtctccatttgctttcactaatcgctaatatgcttttactgggtttttagtcctggcagaacaaagcttatgttgatggagaaattaaagatgctaaaccatgaaaattccctcctagggaaaactcatatactcattatttccccaaagcacaattgcttgtgtgagatttaagaagccttgtcagaaaattattttgacatatttaaaagaatgttaaccagttccttttgcccatatttatattgcctgtaatgtttgagataaagtattgtatttgcagactaatcttagaatgaaatatagagaaatagatagctataaatttaaaaaaatctatgtatgcaagtacattcttctttactcacacaaggtaactaacattttctcttaagtaaattagttttttaaaaattcacagaattttatatctgcgactaggggtattgcaaggcactaaccaactgaaacaactttacatttaagtactaaatctaaaggaaattaagaacagggctactgacacctgacttctatgaactttcttgtttcatgccagagtatgaattttctgaaccaagggtagcgtttataacttaaactttttaaaatcatacattttgcatagacatattcattatttctttataggcttgaatttccttttaaaaacttaaagaaaactttatattcttctggcatgaaataaattaggatcttgtaaaatttcttgcctccatgtcatttccgttcaagttttattcaaggaataaaaagtattgctttatatgcaaaatgacctaggccaatagaaagtcgtttcctgaactgaaatcgtgctataaataacagtcaaagggctgttctttttagaacagctctttcagggtaaaaaataatttgcaggatgtttgccttaggacctaaaatcgctttcctagttctcagcatttctcatctccatgtctaaccacatcttagactgatctatcctcaccttctacgaagccattcacgaagaccacaaaagctaaaagatctgtctttaattggtacttttattatatgtctttcctcgtaattccctaacttcacgtgttatggaaggaggcagggagcattcacctcccacgaccgggagtcagtctctgtgtcaggagtaaggagtgaagagtctcgcctggatccacaaaagacgtgacatctcccacccagcgtcccactgcttgccgcctggctacctttaaccccttgccctccgcacatcctccccttctctagcagaaaattccgcagcgctacggtcgggctggaggcaagccctgcagccgggggcgagcgcggcactcggacacaggcactcagtgtctccggcgccggcagccgagccacgggccaccccttcccacggcctcccggtgccacccagcgaggccgggacagcgcgccttccgcaaaaagcgcagcagccgaagtcctgaaagcagggtcttcatcgccgcgggccctccgaaggtgcctctcccagctgcagccgcccctcaatgaaagtgcaatgtgttatctcgcccagcccagaggagaggtccctgtttggccttggttccagcccggctcattcaattcgctgaatgtcgggtctcccggcccgccccgcgattctccgggaattggccttggccgcgggcagggggcgactctccagtgacctcctccttggaccccatttctctctctctctctctctctgtgcctgtctttgtgtctctgtttctttggctttctcttacaaacgcacgggggagttggtccttttccacaatgccaaaatgtcacccaaaaagctagtgcaacaacttgctttgcaaacgacccaggagcctgccgagaaagccctgcggggagcagccccctcctcccctgcaaggtgcatcgggggtggggtgggggtgcgaatttgaccggtggacatgaccgggacaggggaccggtgttctcctcccctcccccttccgggaccctgtcgcaattagaaatccttcccctgcctgggtccccgtggggagccgcgaggaccgcatggccggagaggacgcgctcgcccccgagatcccaggttacccggagggcccgggagtgcaccccgggcggctgaaagggtaaggagcgcggactctcgagccagcggccgggggagcccagcccgcagcccctccgcgggcgagggaagcggcgaccgcgcggcaggcagcagccaggagccacccagcgcgccgcgaccgccgccgccgcgcacgccccagccccgcggcgcagcccggcgttacctggccgcgtcccgcagtccggccctcgctggctgcgtccgtccgttggtcccacgagcctcggaggaaggagagagatgtccccgcgaccaggaccggctctcagcgaggtgacgggaaggactcgagagaggagccgaggcggcggcggccgttcgcgccgcctatgctgccgattccccgaggcggaaggtgtccgcgaggccgtgtcctggagattgcggcgcccgaagcgcagcgctcgcctctggagcggaggct

SEQ ID NO: 251 - DNA, 43563 bp, Homo sapiens
ttaaacaagagaggcaaggcacagtacattttttattctgtgttgaaaatgtacaaaatatccccacttcccttgagaaagagtatatctaaaatacactttgatgaacacagaatattaaaacattatatgctatagaagtgaacacaaatacattttctccaaaatttcaatagtctaaggaatatataagcattgataatatgaaggaaaatgtttggatttatttttaaattcaaaattctcctggttgtagaggtgaaaaagtaatcaggttaccaccaaaagaaatgtgtctggcatgttcttgatgtctcctctccagctgagtaaatggattactgcagtttagacctggctggagaacaaatccagagaagtcagtaaagtatccatcaagagtttcaccaattaattcttcaacattctatagtggattaattaataacaaaaataaaccgggtgcggtggtgcacacctgtagtcccagctactcgggaggctgaggtggtaggatcacttgaacccaggacttcaagaccagcccgagcaacatagcaagatcccacctcaaaaacaaacaaacaagaaacacgtaaacattttccctatataacaataaaattataaacaacaatgattatgctactttccagtagatcttatttcaaatgtatattacagttttttttattggaaaggtatattcagaatatatgtacaaaaatgtgaataatatgtaaatggactcaagcagtgtatgcagaatgaataaaactgaggctgtatcttaagccacttacatagattccataaatcctaaaccatataatagcacttaatagaccttttaatactgtgtgatcctgctgggatctttttactccctcaagccctgcttcaagttcaaattatgctactggggcaaccaataatttgggtctaaaatagacatctaaatactaatatttacagaagtgaaaaaaatatcagactaaatgataaggtattaagacttaacaatgagaacatataagataattgtgatgtactcttaatcacattactattaaaatattacgatttggtaatctctggatttacttataacaacatacattctcagaatcaatcattcagggttcgatctgggaacagggttaaatcaggtttacataagttggctttatgctgaaagccctgatcctctaggtctcagtttatgattaaagaaggctaaaaccaagaaagaatggtacgtgggtcacagtaacacatttcattctgctcctgagacacagggcagcccagagcctgaccacaaaaaaggcagctttgaaaaataatgaaagacaagatatacaagggtctttaaggaatttgtggcttatggaagctaagtatttgccaggtttcatgaagttaactaaaactgtggttgtttgatcctatacttgctttatgaatgaatttctcatattctgagattaaagaagaataaaaccaagaccgttttctgatctattctagtaattagtcctggaaaattccaaggtaaggctgtaaccacaggtgtaaaccataagaatcacttgatgaagaaaaaaatgacaaatccctaactccagatcattgaaataaaaatatcggccaggcacggtggctcacgcctgtaatcccagcactttgagaatcggggcggggggggggcatcacctgaggtcagaagttcgagaccagcctggccaacatggtgaaaccccgcatctctactaaaaaatacaaaaattagccaggtgtggtggcaagcacctgtaatcccagctactcaggaggctgaggcaggagaatcgcttgaacccaggaggcagaggttacagtgggccaagatcacaccattgtaccccagcctgggtgcaagagtgaaactctgtctcaaaaaaaaaaaaaaaaagtctgggatggggctgaaaccaatgctatatatataaacagcaggaaagagagcactatttaattcgtgccatagtgccagtatcaaaggtatgaatcagacagctctacctaatgtggaatttacagttaataaggaattttattccttaagttatatttttggaatgcgttcatattataccctgaataagagatgaaatgtaaacactgtatgcctatgtgcatctgtacctatatataaattaacatgagagagataagagcttttacagaaggcttcacaaaagggctgtttgaactagatttagaggcaagaggtcaccagaagtaaaagcagggaagtagccactaaaatagcaggacataaataaccaatgatgactgaaggtgggatagatattatttccccagaagggcagaaactttgccttatatttttcttgaatcacttagaaatatattcagatattcaagtacccagtttgtcagagcaaatttgatagaaaaaccatatagaaaaacatatcttcagggttaatattaaaacatactatattttaaagtatataaacaccaaatttttcttcattctgtgaaaaatgaagagtgagtaagcaaaacaatgacaagatatacattttaagccttgtacacaaatagaaaagcaatattcattttataaaacaaatctagaatataaagggacttgtcaagttggaaaacttactgaatcaagaaggtggcattcagtagtgagacttttattatcaaatagttctgaaaaacaacaaaaaaaaactttttaaagaatattctcacattcgagggctgttagaaatggacaaagccatgaaaaatatgaaaagttccacatatcaaatgctaagacaaaaatatagacccctatgctataatgttttttgaaagtagttaaattcttatccttaactttggtataaaagcagacttctgtaaacaaatctcatgcttgtaacattaaaggtacccagaaaatgctgatgaagaacagctggaggacattaaatgtctggccgaggttaaaaccttttgttttaccataggccccagttagaccagctacagactaactgatgaaaatggcaggtaaaactggcacacattataacaaaaatataggagccatttcctattgcagaaccatcacaacaatataggtagaactaggcagtagggaagaaaaataggatattttgaagaaagacttggggatatgtgttgaaaaggacaactaaaaaaaaagcccaggctggccaatgtggtgaaactctgtctctactaaaaataaaaaaattagctaggcgcggtggtacatgtgtaggagaatcgcctcaacctgggaggtggaggttgcagtgagctgagatcacacgactacactccagcctgggcaacagagtgagactccatctcaaaaaaaaaaaaaatcttgagggaattgttctaattcagggtcttcactaacaatgaaggatcctcaatagttagatctaatgtaaaatggaccttataggataatttataccttaatccaagttcatttctttaataaaggctcgtttaaatatattttaaatatctcacctgactgagaaattttagtttccccttcttctaagatgctattttgtgaagctgtatttttttcagggctactcatcaaaacatcctgtgatgtaattgaagaattcagttccattccttccacaacatctgaaattccttcttttttgttagtattaatatcatctgctactccaccagcaagaagaggcaaactcattctctcactggataaacaatccaccttcaagtctgtcttatttacaacctggaagtaaaaatggcattatatttaattatcaatttaattacttggaacaaattttaaaagtcttgttgctattaaatacaagaaaaacagaaggatgacatcccggacacagtcttaagaacattataaatcctactatcctgcttcttcaacaattagttcagataatattatagaaatagtatgattgaaggcaagtttctcagcaagtacctatactctagctcagggactggcaaacattttctgtaaaagatcaaatagtaaatattttaggtttgtgagtcacagggtctctgtcataagtactcaactctaccactgtattgcaaaagcagccagatagaatacataaacaaatgtgtggctattacaataaaatatgatttgtaaaaataggggccaaagtttgctgatttctgctctagttcactggttccatattcattctgatatgagttgaagaatacaaaatgacactatggttttaaacaacccaaatgtcattgaaacaagaactacaattctacatgactgatttagatttccaacggaaattctggggatgctttacaaagttactttctataatgatataaacatatgacatactgggctatctaaccacactggaattgtacttacatgattttcttcaattaaatctggtaatccaggacactgagcatcttctatgctgctcctaaagaagaaaaaaagcagcattacactcataaacatattgttattgtttcacttgtattttgagtctttcctttaatgatggcaattagtttagggaatggatcaaacatggagcctggtgcaagatcaggcgtgatccagatagattagttttggactatagctactgcaggatggccttacaaactaaatgcattcttccccagaaagctcacaagtctgttaccatggtggtcagtcagggtcaggtggctctaccagcaatactctgaatctcagccaaatccagagctatatattaaagaaaagtcaaaaagaaggtgacttctggagacagaagcaacaattcaattattgtctagctggagttagctacatttactcgttacttgttaatccaggtacctgctaagaaacttgacttcaatcatactatttctataattttatccgaaagttcaaaaagcggaacaggagttacaatgttcttaagtctgctgcttgttaacaagtaaatgtagctaactccagctagacaataattgagttagaatacaaggtattctaatcctgaagttactagcttgtatcttattagaaatatctgttttggccaggcgccttggctcacgcctgtaatcccagcacttgggaggcagcggcgggtggatcacgaggtcaggagattgagaccatcctggctaacatggtgaaaccccgtctctactaaaaatacaaaaaattagctgggcgtggtgacatgcgcctgtagtcccagctacttgggaggctgaggcaggagaatcacttgaacctgggaggcggaggttgcagtgagccgaggtagtgccactgcactccagcctcagcaacagagcgacactccgtctcaaaaaaaaaaaaaaaatttatctccacttctttcaagttactttttaaaaaagatatgctctatttttctagtgtccagctttactttgcctttattacacaaagttgcttatttgtatgatgccctttgaggatgttttggggaatccaaaacatttttaaagagtacttatgactcaaatgcaattatgaatcttcttagcaaacaatagtaaactacaagatatacaaagtaggccgggcatggtggctcacgcctgtaatcccagcactttgggaggccaaggctggcagatcatgaggtcaagagatcaagaccatcctggccaacatagtgaaaccccgtctctactaaaaatacaaaaattagctgggcgtggtggcgcgtgtctgtagtcctagctactcgggaggctgaggcagaagaatcgcttgaacccaggaggcagaggttgcagtaagccgaaatcgtaccactgcactccagcctaggcaacagagtgagactccacctccaaaaaacaaacaaaaaaatctagaagcatatctagcccataacagttgttcagtacacattaactccccccccttcaatatgctctgccatctgtcaagaaaacaatctcaaggtactttctacaaagcctggtaaaaagtgtccatctctcaaccaccttggggaggcattagcactgctgctttgtagatgatgaaagtgaagctaaagagaattaattacttgccccaaagttgcatagctagtaagtcacagagctcttctcagctcagaactgttgagcaccaaagttgtagtatgtttagcaccaaaggataccatattgcttcttttcttcttactgctgcagaatttacccaactaaacgtgaccatttagtatcctgaaaccttaagctttagtttcctcatttataaaaagggagtactgcctatatgttgcagggtcattatgaaatttattaaaaatatatgtctggcaccttttaccatcttaacaatctgaaatggtatttagtatcagcaactgttaaactcttattaacatgttaaagaaatacctgctttcaggaatactcaaaaacaaagtcttcttcacatgttcacttttcgtattctgaggaccggcattttctggtgatgtagtttgttgtggaatgcccatctcatttctactctgagatacagctttgttgacagacttaggtgttccaagtctttgagaagggccttcagaagagacagaaagtcctagaagatgagagaaatcacctcaataccaaatagttcttttgcttttcattataactaggaatacggtgaaaatcctatcaattagcctctttctcctgtcaaataatgtctgttaaagacaaatgcctgggactttctgttaaagatagtatttaaatgcatattagatgctgcttccttttgacatcccactacttttacatgaacagagataatttttttgttgttgttgagacagagtcttacactgtcacccaggctggagtgcagtggtgtgatctctcggctcactgcaacctccgcctcccagcttcaagtgattctcttgcctcagcctccccagtagctgggactacagatgcatgccaccacgcctggctaatttttgtatttttagtagagatgaggtttcaccatgttggccaggctggtctcgaactcctgacctcaggtgatccacctgcctcagattcccaaagtgctgggattagaggtgtgagccactgcgccaggcctgaacagagataacctttttttttgtttttgtttttttagagatggagtttcattcttgttgcccaggctggagtgtaatggcatgatcttggctcactgcaacctccgcctcctgggttcaagtgattctcctgcctcagcctcccgagtagctgggattacaggcacccgccaccacgcctggctaattttttgtatttttagtagagatgaggtttcaccatgttggccaggctggtctcgaactcctgacctcaggtgatccacctgcctcagcctcccaaagtactgggattacaggtgtgagccaccgtgcctggacacagataatcttaaaaagcagaactctacaaggacaaaggaaactaaagaagagatagcaacaataacaatattttggaagctataatgtagattgttgagtgggacttagcagactcaagaaaactaattctaagccaccaatcaagaaaaatgaattggccgggcgcggtggctcatgcctgtgatcccagcactttgggaggctgaggcaggtggatcacggggccagaagatcgagaccatcctggctaacatggtaaaaccccgtctctactaaaaaaataccaaaaaatcagccgggtgtggtggcaggcgcctgtagtcccagctacttgggaggctgaggtaggagaatggcgtgaacccaggaggcggagcttgcagtgtgctgagatcgtgccactgcactccagcctgggcaatagagtgagactctgcctcaaaaaaaaaaaagaaagaaaaatgagaatcaacccaatttctaccacataacccctcaaaagaactggtggctccaagtatctctgcaagtggagatgaaaatggagctaaacacagaaggaatggctcaaagtcagtttaaacaagaagagctcagattcctttcctcattctgcacagcaaagcaactgtcatcacccacccccatcaccaaaaacagaagggtctctggtttagaggataccagatacagttgagagacagggtactacatggaaaataagggaaataagtgaatatttacacaaagtgttgagacacttagctttcttcccctacatggctcctgaaagactggcagccagaatgataccttccaggaagcagatggaaagcatcttctctggggaatctgagtagactatgagaaaagtcttaaatgcagtgatgtgtaggttcccagcataatggccccgctaacagaagggccccgaaagtaaaggtcctacccatgtgcagagagtttccagtcagctttttagtgccctattcttaaccatgtgcaggcagtgagagatcaccagattcccgaggaaagcctctaaatacaagagacagaaaccaaaaacaactagatgaaagtaccctgaaacaaatactgtctatagtggatgaagaaaacataaaagctatcattaatatccttggaaagataaaacaatacactgatgaaacaagtgcagaatgttataaaatgaacatttggagagtaagaaagggctcttgggaattaaaaacatgatagccagcatgaaagttgaggaaatctccaggaagtagaagaaaacagtaagtacaggaaagaaagattaaaaagtctaccagaagaaaaatgtgtttttgaaaaagatcaaaccttgtcaagagagatggtggtaaacaacaaaactccagtaagactccagtaagtccaaaagactccagtaagaattgaaagtagttgcttctagggattggcaaatggaatgagaagggcttcttcagggactactgttttgtaattagcctcatatcaactatgtgctctgtaactaaaactcaattttaaatgaccaatttttgccataaaccttaatctccctatctataaggactgagttgagtatatgaaagaacagaatgatgagcttatagctgtaaaaaccacgaagatccttgacaagtagtagaatggagtcatgttattagcagtagtgggagattcctgggtatccagggagtgtagctgcttaaaggaaacaaaagtacaccagatttgatacctaaactaacaagaatattataatatacttgaggatcactataaatatcagatagcaggtattagagaacaatttaggtttactttgaaaaaacttcctggtggacatctatggcttataaataaataatttcaattgagataaattcaattcaagaaaaatagtctgtggaaaaaaaagctatgacaaacactgtgagaaaatcacaaaaaaatgatttcctgaatattaaaaactgcttttactggaatatttttaaattggaaaattagtacgtttactacctttcaaaaagatctgagcaaaagttttaatacaaatgcaaataaaaccaaatccactttgcataaacttccttttattttttagagatggagtcttgctctgtcactcaggctagagtgcaggggcacaatcatagctcgctgtaaccttgaactcctgggctcaagtgatcctcctgccccagcctcccaagtaggtgggactacaggcatgtactgccaggctcggttaatattttatttttttgtagagaggggatctcactaaattgcccaggctggtctcaaactcttagcttcaagtgatcctcctgccttggtctctcaaagtactgggattataggcatgaaccaacacacacagcacataagcttcattttaaagcacagctagacaagtgtgatagctggatgctcaagtttcctttgcattataaattctaaccaaacttctaactgacctgaagaaaatcagtttacttcttcatgcttccgtcatttctcttacctcttgggatcctgtgacctttctcatagactgtagggttacatggtaattacattacagatgtgaaatcacttagaaagtagaaaagcaatcttagaagacttatcgcacttaaactaatctgatcatacccatcaaaatgtgatttacagtgtttgtgagcgagcatagtctattttctaaaaatcacagaaaaacttatgtctcttcatgtaaaaaactatttttcaccttacacaagcccccatctatcccaaatatttctcttaagtagtctcaggaaaaacaaaaaaaataaaaaatcaaaaacaactaacctgagaataatttaacaggactttcaactctgaaaaatccagcatcgaacactattttatcaacttcctttggtatcacagaaactgctgtttcagcacattcttcctgcctaattctctctctcattgcattttttatggcagctaggcgatttctcgctgcaattcttccagcatcatcctgttttggtttacttgctatacctgagacaacttttttctgcaaagagaaactaacatagtaaagctgcccattaccatcttacaagaaaaacacacaacaaacacaaattcatcacttaaaaatttaatttttaaaaataaagtatacataaaatatttcacattcatcatatatttatcaagttcctagtatgtgctaaaaggtaaaaaggtaaaggacagagttgctgccctcaaggagtttgcagcttagtagaagatctgggaagaatagtaagaaggataaatgtcctgttagaaataaatttaggggacatcctttagattataaccatgacaccccccccccataaaaaagaaaaagcaaaaaaagtaaataaaaaaaaagtaaaacattaaaagaaaataaataaggatgacacctaaaccaatcttcaggcatcaggaaaggttgtaggaagtagcacctatgctgaaaccatatttcatcaaactaaaagatggggtgaggcaagtgctagagagatgtttccaaagccagaaatgaaacaaagaaaagtggatttaaacaatagctagattataataaaaatcacctgcatgtaatggtcttaagaaagtcacatttacacagaggacaagggaacagagagttattggtaatttttaagcagaagattaacatcaagctggtgttttagaaagatcactcagactaaggagtaagagatgaaaaaagtggacagattcaagagatatttgaaaggtagaattgagaggacttactcatctattggatgtgtgtggggtggagatggtgaaataaagcaagcaaagggtatcgctcaaaaggatatctcaaaagagatattgagacttctatcttgaacacctggtgggatggtaacagcattatgagacagggcaacattggtgtgtgtggagatgctgtcagtttgggatatattgatttttaaggtatattgagtcatgatatatagaattagagcttagtaagtgtggtctgcaatacagacttgagaatcatcacaggttgggtaagattgcacaggaaaattacggaaggaaagaagagagtagaggtaggaattctaaataacaaaaacatttaagggataaatggaaaacaaatatgcaaatatgactgaagaataggcaaagaagaaggaaatataatttcaaaaacaaggaagtaggccaggtacagtggctcacaactgtaatccccgcactttgggaggctgaggcaggaggatcacttgaggccaggagttccagaccagcctggccaacatggagaaacaccagctccactaaaaatacaaaaaattagctgggcaaggtggcacatgcctgtagtcccagctactcaggaggctgaggtgggagattgcttgaacctgggaggctgaggttacagtgagccaagattgtgccactgcactccagcctgggccacacacctagactctatctcaaaaaataaataaaatacaaaaataaaaatacaagaaaaaaagttagctgggcgtggtggcacacgcctgtaatcccagctacttgggaggctgagacatgagaacagcttgaacctgggaggcagaggttgcagtgagccgagatggcgccactgtactccagcctgggcaacacagcaagactctatataaaaaaaaaaaaaaagtagaccatatttaatactgcagaaaggttagatttatttactactttttgttatttttgagagagtcttgatgtgtcgcccaggctggagtgcagtggcatgatctcggttcaatgtaacctctgcctcccgggttcaagtgattctcctaccccagcctcctgagtagctgggattacaggcgcccgccaccatgcctggctaattttttatttttagtagagacagggtacaccatgctggccaggctggtcttgaactgacctcaggtgatctgcctgcctcagcctcccaaagtgctgggattacaggcttaagccaccacgcctggcctagaagagttagaatttaaaattaagtgcctaataacttaagcaactagtggattaataatttagataactattctaaagttataggggggtaaaactgaattgcaatgagttggagaaataaaggaacaaaaataatagagtatagaaaacattttaggatgcttgtcagtgactggatagaaagaaaaaatgggggtgtacaagtaattaaagggagaagcagacaccacaggtttgttttaatgtaaacaatgataagacacttaaacatgtttaaagactgatggaaaaaagggaggaaaggaaaacaagactaactgatggaatgagggattaataaataagaggtagtagggagtggtatccaagtatagtataaaagattagctttgtttgataatcttaaaggtagcctataaaataaagtaggagagagacacctggtgataacaggcagaattacaaatctctataggacatagccatgatctgcatcactgatgatattaatatttccaggactaaatccttaataagaaatacccacagtagctttaataatgaagtagcatccttcactatttagtagttttgaaatccattcaatcaatttagtcactgtcctcagggtccttgtcatgagactttattagtaaaaaaaaaattttttttttttttttttttgagactgagttttgctcgttgcccaggctggaatgcaatggcgtgatctcagctcaccacaacctctgcctcccaggatcaagtgattctcctgcctcagcctcctgagtagctgggattacaggcatgcgccacctcgcccagctaatttttgtatttttagtagagacggggtttctccacgatggtcaggctggtctcgaactcccgacctcaggtgatctgcccgcctcagccgcccaaagtgctgggattatagacgtgaaccactgtgcctggcctagtaaaatattttttaaggccgagcgcagtggctcatgcctgtaatcccagcactttggaggctgaggcaggagaatcacttgaactcaggagtcagaggttgtggtgaaccaaggtcacgccactgcactccagcctgggcaaaaagagccaaactctgtctcaaaaaaaaaaaaaaaaaaaaaaaaaagaattttttaaaaataaggtttaaaaaacaatactttaacaagttaaactcttaagataggatttaagacagtttttatttggattacatagtataataaaataccaatctagacaacctgagtttataactacaggcatttttctcatatcataaagaaaaactgacaatgcttagtttgaaaagtgtccacccaaaccaaaaactttgaattcaaaaacattactagaaagataattactagaaacaagaacaaaatctgtcatgttaacaaagcacaagaataacagcatccatttcatacgactgttgtaaggattaatatatataaagtaattggaataatatttgacacatactaagcattatataagttacctactactattactattataacaaaatgtgtaagtacagtttaaagaataaaacctttaggccgggcacggtggctcatgcctgtaatcccagcactttgggaggccgaggtgggtggatcatgaggtcagcagatggagaccatcctggctaacacagtgaaaccccgtctctactaaaaatacaaaaaattagccgggtgtggtggctggcgcctgtattcccagctacttgggaggctgaggcaggagaatggcgtgaacccgggaggcggagctggcagtgagctgagatcacgccactgtactgcagccttggtgatagagcgggattccatctcaaaaaaaaaaaaagaagaagaagaataaaaccaacactcatatatccagtatgtggtaacttagaagccctctgggtaccccaattcaatcacagcccctcctttcttctctctagacataactatcctaaattttatgttgatcgatttccttgctctttcttcaaaggcaatcaagtacactctaagtagtataaagacttaactttgtaaaataatgagaaatctaaacctaaatgtttttaaaacttaaaaacaagaagtagaagaatctatattagaaatttggatgtatgtataacagttccttaactaaaaaaaaaaaaattggatataaaacccacaaacttaccctaaagacatttttgttcatattatgattcatattattattgacttgccacccagattcctcaagtttgatcagattgttgaatttgtggattacatcttctatctgttaataaagcacaagtttaccagattaatgctagccatattaaagttataaacgaatgagctgaagactaaaaaaaaattaaaaatagtgattcagaaatgatgagttattaaaactggactgagtcattctcaatttagtgttcaaataatttttatggtaaagtttttcattatctttcgtcttacaaacctccaaaatctacataaagaatatcatacatgaataactctcctagattatttttgactaaaatgctaaaatggtagaaaagatatcctaaatgttgtttcttaaattacacaatgtgaacacaatctaattttttttttatttatccattcctccactgaaggacatcttggttgcttccatgttttggcaattatgaataaagctgctatattgctaaaaacatccgtgtgcaggtttttatatggacataagttttcaactcatttggagcgcaattgctagatcgtatggtaggagtatgtttagttttgcgagtgactgccaaactgtcttctaaagtggatataacattttgcattcccataggcaatgaatggaaagttcgtattgctccataccctccccagcacttgctgttggcagtgttttgaattttcactgttccctagtaggtatgtggtagtatctcactgttgttttgatttgtagttcactaatgacatatgatgttgagcatcttttcatatgcgtatttgccatctgtatatcttctatggtgaggtaactgttcaggtcttttgcccatttttaattgggttgttcgtttccttcttgctgggttttaagagctctttgtatcttttggataacagtcttttatcagatacatcttttgcaaatatttctccgaatctgtgccttgtcttctcattttcttgacataatctcattttaaaagatacaagtgtatttaataggatggaaatataatccccatctttctgatacttccagtctcctacgaagagttacgccactgacaacagtttggtaaccatgcttttagtctccatgctatgcacttatacacacatatcctcttagctttgctctccctcaaaaatatgtaaatgtctctgggcactgtggcatatgcctataatccaagctacttggtaggctgaggcagggggattgcttgaaccgagaaggtcgagactagcctgggcaacaaggcaagactccatctcaaaggaaaaaaaaaagtaaatgtcaaaatgactcagaattacactcatgaccaactgattttcaacaaaggtgccaatacaattcagcggggaaaagacagtcttttcaacaaacagtgctgggaaaattggttatccataagcaaaaagatgaatttagactcacaatctcataccatacacaaaaactaaccaaatggatcatagacttaactgtaagtactaaaaccgtaagactgttaggagaaaacacaggagaaaatctttgtgacttgtggttaggtaagagttcttagatgtggtgtcaaaatcacaacataaaagaaaaaaaaaatggccgggtgcagtggcacacccctgtaatcccaggactttgggaggcagaggcaggtggatcacttgaggtcaggagttcaagaccagcccggccaacgtagtgaaacctcatctctactaaaaatacaaaaattagccaggcatggtggcatgcacctgtaatcccagctattcgggaggctgaggcatgagaattgcttgaacccggaaggcagaggctgcagtgagccgagatcatgccactgcactctagcctgggcgacagagtgagactctgtctcaaaaaaaaaaaaaaaagagaaatttgataaatttaactttaaaataaaaatatttgcacttcaaaacatgccattaagaggattaaaagtcaagctacaaactcaaagaatatttgcaaataatatttctcataagggacttttatccagaatacataaagaatacttaaaactcaataataaagacaatgaaatttaaaaatgggtgcaaaagatttacacagacatctcagtaaaagatacatgaatggcgaataagctcacaaaaagatacttaatatcattactcattagagaaattcaaatcaaaactacaatgaggtcaggcatggtgacacctgtaatcctagcattttgggaggctgagaagggtggatcgcttgagctcaggagtaagacctggccacctgggtaacatgatgacaccccacctctacaaaaaaatataaaaattagccagtcgtggtggcacatgcctgtagtctcagcaacttgggaggctgaagcaggagggttgtttgagcccaggaagtggaggttgcagtgaggtgagattgtgccaatgcactccagcctgggttgacagagcgagaccctgacttaaaaaacaaaaaaaaaaaccccaaaaaaaccctacaatgagatacctcatacccactaggatggctatgcaacaattcccccttatcttcaaagaatctgttccaagacccccaggggatgcctgaaatgcagatagtactgaaccctatatatatgttttttcctattcatacatacctatgataaagtttcatttataaattaagcatagacatcaatcaacaataaaatagaacaattataacaatattccgtaataagttatatgaatgtggtctctcctccctgccaaatatcttattgtactatacctcaggtaactaaaaccacagaaagcaagactgctgataagggggggctactataataaaaaagacaataagtattagtgaggatgtcgaaaaacagaacactcatacattgttggtgggactgtaaaatggtataatcactttggaaaatagtttgggcagtttcttaaaaagttaaacataaatttacaatatgacctaccaatatctaggcatctgcccaagagaaatttaaaaagatacatccacactaagatttgtgtggaaatattcacaggttattcataatcaccaaaaagtggaagcaatttaaatgaccatcaattggtgaatagtgatatatccatacaatggaaaaccactcagcagtaaaaaggtgtgaagtacacaaggcaagctacaatatggataaaactcagaaagatgctaagtgaaagaagccagatgcaaaagaccaccataaggtatgattctatttatatgaaatatcccaaaaaaaggcaaatctacagagacagtaagtagattagtggttgcctaggtctaggagtagaaatggggattgactgcaaacaggcaggaggcatctttttatactgatgaaaatgttctggctgggtgtactggctcacacctgtaatcccagcactttgggaggccgaggcgggtggatcacttgaggtcaggagtttaagaccagcctgaccaacatggtgaaaccccgtctctactaaaaatacaaaattagacaggcacggtggcacatgactgtaatcccagctacttgggagactgaggcaggagaatcgcttgaactcaggaggcacaggttgcagtaaactgagattgtgccattgcactccagtctgggcaacaagagtgaaactccatctcaaaaaaaaaaatacatatatatattctaaatttggattgtggtgatggttgcataactctgtaaatttactaaaaatgattgaactgtacatttcaaatgaatgaattttatcatatgtaaattatacctcatatagctcttttgtgtttaaaaaaaaaaaaaaaagtgccccaatggccaacttgaagtggctcccactaagccaaagctgggaaatgagcatcagtcaagataatgactataggccaggcacagtggctcacacctgtaatcccagcactttgggggccgaggcaggcaggtcacttgaggtcaggagtttaagacaagcctgaccaacatggcgaaccccatctctactaaaaatacaaaaattagcctggcgtggtggtgggcatctgtaatcccagctactcgggaggcagaggcaggagaatcgcttgaacccaggaggcagaggttacagtgagccaagatcacgccaccgctctccagcctgggtgacaaagcaagactccatctcaaaaaaaaaaaaaaaagactataaacaatgtaaacatatcatacttttaaatctgcaactaataatgatacaaaaatcaccacagaatctaacaatcagaattgaagggtgctagtgaaccaactattatgaaaactggtaaatatataaaaactcatcataaagtaatgcttaattatgactaaacactattcatgtctgggccatacagctgctgagattccatttccttcctcacaacgttttctttagacttaataattgttttgctttttgtttgctcagggttttggtttggttgagacagggtctcgcctctttctgggaatggagcccactctcctcttttcttgggtaactctctcatctttgtgaaggacattctcattttcctgagaaagggtacatggaaggaggtgaactttgagatcttgtgtgtctgaaaattgcctttccaccctcatgcttgattggttcggtatagaaatccaggttggaagttaatttccctcagaattttcagagtattgttctagttcataatattgctgttgagagatcaatgctactctaaccattgatgctttgtataaaatttgttttctttccctggatgctttagcctaccctctttatcccagagttacataacagtatctaattatgtaagttgctgtgggtctactcagtgctaaacactcaacaggctccttcattgttcacttgctccccaatttttttttctgttctctttttctggaattcctataatttggctatatttcctggactggtccatgtaattttcttatctaatctcttctgtcttacagcttgtactacaggcatgtgcaaccatgcctggctaagtttattttctgtagagatgggctctcactatgttgcgcaggctggtcttgaactcctgggctcaagtgatcctcccatctcagcctcccaaagtgctaggattacaggcttgagccactgtgcctggctgagatttccttaacttcatattctacctattgtatcttacatttctgttctcatattgcttaacttcaaagagctatttattctctgaatgttctttttctaacaggtatttttacttgacagatgaaacgtctggtctctttgagaatatgaatacttgcatttaaaagtccatccaaatagctctcttcctagatgtttgctttggcctttttcttttaggtttgaagcttttttcaatgtctattgttggctgttggttcttgaaatgctattttatatgcttatttctaaaataagttcaaaacgctagagtcatcttcccccatacctttactgatcttcctagtaacttcttctatcacagcaatttatatgttagaattatattttgtatctcagtcactaatcaaattacaaactcctctgggacagggaatgcactattttatcaactcctaatacaatactcctaacacaataagagattaatacaatacgggcacacaacaggaactcagtaactgttagctgaactcaactaccaaaggccagttgactcatttctcacaggtcgaatcattatagactattaaagagttgaaaataatttcagttttcaacctatatagaaattatcctggccgggcgcggtggctcatgcctgtaatcctagcactttgggaggccgaggtgggtggatcacgaggtcagaagatcgagaccatcctggctaacacggtgaaactccgtctctactaaaaatacaaaaaattagccagatgaggtggcaggcgcctgtagtcccagctactcgggaggctgaggcaagagaatggtgtgaacctggggggcagagacagcagtgagccgagatcacaccactgcactccagcctgggtgacagagtgagactccgtctcaaaaaaaaaaaaaaaaaaaaaattatcctgagaatatatgggagaagaggacatcagtcataaaatttagatcatgttttacagtttatcaaagtgctttataacatcttatttaatattacaggtacataagcagctactattaccccattttactcctgctacttaaaaaaaaaaaaaaaaaagccctaagttaatatatttgaaatattgaaccacatacctgaaaactaaccatatcccaaaatccatccagatctgtacaggtagtctcctttatacctcgtttatattcacaatcatcaaccagtccttcaaactgtttaaacctttccttcataaggagtcttgtttgaccaactgctgtgcgaataagatctttagctgaaggaaataagagattttttaaaattaaaggacaaaacgggacattcattgcaagtcagcccactgataagacttcactccaaacatcctagggcctacaggttgttaagcaaaacaaaaaatatctaccacaaaactttgtcatacaaatactgagtactaactatttgcttcaattcctgctcaaaattaacaatattttctcatacatattgctatatactaaatagcattctacttcttgttgtactttataagaactcaacgtcagccggtgtggtggctcatgcctgcgggcgcggtggctcatgcctacaatcccagcactttgggaggccaaggtgggcggctcacctgaggtcaggagttcgagaccagcctggccaacatggtgaaaccccatccctactaaaaatacaaaaatcagctgggcctggtggcaggcacctataatcccagccacttgggaggctgaggcaggagaatcgcttgaacccaggaggcagaggttgcagggagccgatatggcgccattgcactccagcctgggcaacaagagcaacactcatcttaaaataataataataataaataaattaaaaaaaaaaaactcaacgtcaaacaactcactgcaaataattatctaagaaggacttcatactgacagcacataattttttctaaacagcttcccaaataaatcagattaagaaactcttcagaaaatcttttccatattgatttaggtaattttcattcagagtatatttttgtgtaaacaatatcagatatcaattgatatcacccataaagtcatatttaaaaagctaataatattcactgttacttgcttggttggttagaaaaatgtctaagtcaaaggaacgacagtcaatattctaattacttacatcttttaagttatataccattttagcacagatgttagggaacatatgttgagatatgaaaaacacttgctactttattgtagacatcaagttaaaaaagaaaaaattcttgctactttgaatgataatgaaacaataaagttaggcaatgctatatttttatgtttcagataaacgtaaccatagtaaaagaaacaaagcaaacaaaaaatacaaatgttgcctcaccatcatctggaatgtccaattcaagtttcctgtcccactcgaagcaatgtgaagttaatttctcagtttctgactggaggatatttctaaaattatgacatacatttcagttctacaagtggtttttacactagtagctaagtattagcataacatcatgatacataacattaggaagttataaaagggagccacaatattttcccaaagttgatactgaattatttataaactgtgatatattaaaatccataaatacaagttgataccctttgtatgtacatccttttatacctaaaacttatgtggctggataataccaagaacctactttttaagctaacatttctagtttgttctgttctttttcagaggttgatcaaagtcagacattcctaaatgtgcatcagattctcagcattgtctatgaaactaaagccaactcaactgtcaagagtaaattaaagctaaaaactgttaatcccaggattatagtgatggggcctcacagatcctaattattaggctttgcttgcttaaaggtagtggttctcaactgggtcaattttgccccattctagggaacatttggtggtgtttggaaatatttttgattgtcatgactggaggagtgctactggccagggatgctacaaaacatcctacgatgtataggatatatacccacaacaagtatacaatctaaaatgtcaataatgctaagattgagaaacccaggcctaaaagaagtttaatttgtgtctatggaaaaagtatcctagcatgtagagaaactggaacccttgtatgctgttgatgggaatgtaaaacggcaaagccactgtagaaaacagtatggcagctcctcaaaaaattaaaaatagacttaccacacaacccagcaattctacttctgggtatacacccaagataatttagagcagggtctcaaagaggtatttgtacacccatgttcatagctgttcacaacagttaaaacatggaagcaacccaagtgtccactgacagacaaagggataagcaaaatgtggtatatacatacaatgaaatattattcggccttaaaaaggaaagtctgacacatgctacaatgaatgaaccttgaggacattatgctaagtgaaataagccagtaaaacaagacaaatactacataattctacttaaataagatacttagcagagtcaaaatcagagacagaaagtagaatggtatttaccaggggctaggagggaatggctgaggaatggggagttattttttagtaggtacagagtttcaggcacctaccaccacgcccagataatttttgtatttttagtagagatggggtttcaccaagttggccaggctactagtcctgaactcctgacctcaggtgatctgcaagcctcagcctcccaaagtgctgggattacaggtgggagccaccgaacccggcaggttttgtttctttaaaaaaaaaaaaaaaaatttagggccagactcagtggctcatgcctgtaattccagccagcactttgtgaggctgaggcaggcagatcacttgagcctaggagttccagaccagcctgggaaacatggcgaaaaccaatctctacttaaaaaaaaaaatacaaaaaaaaaaaaaagtatttaaaagataaatgaaaatcacctaacatcagtttccctccactgtattaaggttataaatattttagttttggttttaaatgtctagatattagtacaaaattctttatttttattttttttaaatacaaaattcttacgctagaaacagacatagtcccagctcctcaggaggctgaggtgggaggtcgggaagtcaaggctgcagtgagccaagagcgagacactgcactccagcctgggtgacagagtgagaccctgtctcaaaaaacagaaacaaaaacaaaaaatttgagttgttcatattcaatgacacaacatgacgattaataaggaggcagagggtcgggcacggtggctctcgcctgtaataccagcactttgggaggctgaggcaagcggatcacaaggtcaggagttcgagaccagcttgaccaacatggtgaaaccccgtctctactaaaaatataaacattagctgggtgtggtggcacacgcctgtaatcctggctactcaggaggctgaggcctgagaattgcttgaacctgggaggcagaggttgcaaagagccaagatcgcgccattgcactccggcctgggcaacagagcgagactccgtctcaaaaaaaaaaaaaaaaaaaaaaagaagagatagcagaaatggtttagttctgacattatctagttaggtagattgcttaatatttcaataactcagtggaatgacacaatggattagctacctctaaaatcccttataattctaaaacccagtgctctaaaaaagaaattaagctggacatagtggctcatgcctgtaatcctaacagtatgggaggctgaggcaaaaggatcgcttgagcctgtgagttcgagaccagcttgggcaatatcataagacccccgtctctacaaaaaaaaaaaaaaacaaaaaaaaaaacacacacacaccaaaattagccacccactggcaggaggatggcttgagctcaggacagagaggctgcggtgagctgagatcacatcactgtactccagcctgggcaacagagtgcaaccatttcaaaacaaaagaaaagaaagaaatgaagtcactctcaaaaagtatatttataatagaacaaatgaatagtaaaactataatgagatacttacttctcatctatttgatttgcaaacagaatagtgtgtattgtatgatattgtctctctctatagatatatgttgtctctctctctctctctatatatatatatacatgttgcaggaagtcagggaccccaaacggagggactggctgaagccatggcagaagaacgtggattatgaagatttcatggacatttattagttccccaaattaatacttttgtaatatcttatgcctgtctttactgcaatctctaaatataaattgtaaagatttcatggacacttatcacttccccagtcaatacccttgtgatttcctatgcctgtctttacttactttaatctcttaatcctgtcagctgaggaggatgtatgtcacctcaggaccctgtaataactgtattaactgcacaaattgtacagcatgtgtgtttgagcaatatgaaatgtgggcaccttgaaaaaacaggataacagcgattgttcagggaataagagagataaccttaaactctggccgccggtgagccgggcggaacagagccatatttctcttctttcaaaagcaaatgggagaaatatcactgaattctttttctcagcaaggaacatccctgagaaagagaatgcgcacctgggggtgggtctcttaactggccccctgggcgtggccgtctcttactgtcgaaactgcaggggtgaaatagaccccagtctcccatagcgctcccaggcttattaggaagaggaaattcccgcctaataaattttggtcagactggttgatctcaaaaccctgtctcctgataagatgttatcaatgacaatggtgcccgaaacttcatttagcaattttaatttcgccctggtcccgtgatctcaccctgcctccacttgccttgtgatattctattaccttgtaaagtacttgatgtctgtgacccacacctattcgcacactccctccccttttgaaaatccctaataaaaacttgctggtttttgcagcttgtggggcatcacggaacctaccgacatgtgatgtctcccccggatgcccagctttaaaatttctttttgtactctgtccctttacttctcaagctggccaatgcttaaggaaaacagaaaagaacctacgtgaatatcagggcagattccccgatatatatatgtatatagatatatatatattttgagatggagtctcactctgttgccaggctggagtgcagtggtgcaatcttggctaactgcaacctccgcctcccaggttcaagcaattctcctgccttagcctcatgagtagctgggactacaggcgtgcaccaccacgcccggataatttttacagttttagtagagatggggtttcaccatgttagacaggatggtctcgatttcttgaccttgtgatccacccacctcggcctcccaaagtgctgggattacaggcgtgagccaccgcgcccagcctattgtccatattttttaaaaaagaaaaaaatgtacatgttatatttgtctacatatgcatgaactatccatggaagtattcacaagaaatgagtaacacttgccttcatgaaaggttcaaactatgtggttgggtcacagtgctgagaagaagtcttctcacttgtaccttttcctaccctttgaattaggaaccacatgaatgtactagttatcaaaaaaataattaaaatttaaacgtgaaaatcacctaacaccagttttcccccactatattaaggttaaaaatttttagttttggttttaaatgtctagatattaatacaaaattcttacactagaaacacacagacatacctgaaatatggcacaccatggtggggctgagcaattcgaccttcatttctttcaagtgatgggacttcttttattggaaggccatttaaatttttagtagtagcttcatttttatttaaaacatgttctataaattaaagaaaatcttacatataaatttcaaagcaacaattcctaaaatgacagcccctaaaaagacattttaaaaatccttttcaatgtttaattttaaaattttatttctgcctcaatcacttcacatttcctctaaagtagctctcaatattttttctttaaatttacatttatttcccctcttctgtctgtattcttcattccaatattctcttcagatatctttacccatgctttcccgtcttttctgaccctgagttcacatccccaaatgatatggtgaaaaagagctccaaacaaatctgacaagtaataatccagaaaagtaaaaatgtaattactatacctgaaagcaaaatattttttgtattaacattattctaaaaaatgaataaattaattaaatactataccttcatgccaaacagttagaggacccaaaggacatggcaatttatttgaatcttgctgtattgtcttggtagagtaagttttacatttttgtgccaaaatttcttttgttgcttgagactcatcactaaaaacaatagcaaaaatatacttcatgaaacatgaactccatatatctaatataaagggtttcaaaattgtgtcacttgtagatctgggctaaaatagaaatgtttctatttttttaaaatgtgtattctggaggggagaaaatgtaaacacctatagtgtgaatgtccatttttactaattaattgtaatcagattcaaagattttgaagatttcttaatggaacataaacacttaacagtcttagatgctgctgagcagtttttagtatatttgctgccagccagtctttgcaaaatgatcttgccttttcttttaaaggttccaactgatttttcccttgttttgcaaattaatcatttttgtcttcagggccagtttttctaaatactaagccagaagaaaatgaggaaaaagtcgtatctgagctaaagcagtatagcaattttcttcttttgaaaaatgtatgtgttataattaagtcatttattaaaaacaaaaaacccaaattgtatagtgaaaataacaatgcataggaaatataaaaactgtcaattacattattgtaccttctgaagaattttttttaaagaaaaaaattgcatgattcctaattaacacagttcactaataataactttttaagagcatagaccaaatataagaaagacatttggccgggcgcggtggctcacgcctgtaatcccagcactttgggaggccgaggcgggcggatcacgaggtcaggagatcgagaccatcctggctaacatggtgaaaccccgtctctactaaagatacaaaaaattagccgggcgtggtgacgggcgcctgtagtcccagctacttgagaggctgaggcagaagaatggcgtgaacccgggtggcggagcttacagtgaggggagatcacgccactgcactccagcctgggcgacagagcgaactccgtctgaaaaaaaaaaaaaaaaaaaaaaaaaaaagaaaggcatttattacccatcttagcaagagacttattattaagatcatattcttacacttctgtttttaaaggagtccaggtgtaactgggtgtcaaaaaagcattggcacttctgggagtcataggtgttacttgataggtcttcagaccatccagtggctgaaacataaaatccttaggtgcaaaggaattcttcccttttatttttgcagtatttatctcaggtaagttttccatttttgataagactccatctggattcattccacttgttgcattagtttgtgaattcaaagtattttcttcactatcgactttacaagaaataccctaggatgtgagttaacaaagtagagtaagatttctctcttctgaggatatattcaaccaatttttataggtctgaaaatatgacaacagaaatatatgttctatgtacataatttgagagacaaaaacagatacaattaagtgtatacatggaatcagaagaccagttacgctaaatccattgctattacccgggaatagaatcttttttttttttttgatacggagtagccctccgtcgcccaggctggagtgcagtcgcgcgatctcggctccctgcaagctccgcctcccgggttcacgccattctcctgcctcagcctcccaagtagctgggactacagacgcccgccaccacgcccggctaattttttgtatttttagtggagacggggtttcgctgtgttagccaggatggtctcaatctcctgacctcgtcatccgcccgcctaggcctcccaaagtgctgggattacaggcgggagccaccgcacccaccccgaaccaattcttatttaaagactaactaataccttttgggtattacaacaaattaaaagataatggaaaattaatatggaaaaacttattcaacaaatacgtatctttttacttaaattatgttgataattacggccaggcacggtggctcatgcctgtaatcccagcactttgggaggctgaggcgggcggatcacaaggtcgggagatcgagaccatcctggctaacacagcaaaaccccgtctttgctaaaaatacaaaaaattattggggcgtggtggcaggcgcctatagtcccagctacttgggaggctgaggcaggagaatggtgagaaaccgggaggtggagcttgcagtgagccgagatcgtgtcactgcacttcagcctgggcgacagagcgagactctgtctcaaaaaaaaaattatgttgataattacaatggtttaaaatcagaaatctaacattatggaatgactatcattaaggaccaaattcttaagttaaataaccttagattataaataaccttaacacaagagcaatactttcaatgtgacacaaaagattaaccatataaaatacaaagcatatttactatttcaagtcaatttgttacttggtatttaaataatttctagaggtttccaggtttctgatttttaataagatatgaactcaaacccaggtatttcaacctggacaagagtttaagtggtaacactgttgaagccagcatggcagtcaaagcaaaaactagtgataatccttaagggttaatcttaaggggggacctataaggtccagctgctttatctgtgaagattcactgtgtgtttcctttcttgatctgtgtttgattttttactaagaatctagccaggttacttaatctttggtactttttttaaattaagaaattatactggccaggcgtggtggctcacgcctgtaatcccagcactttgggaggccgaagtaggtggatcacctgaggtcgggagttcaagaccagcctggccaacatggtgaaacctcgtctctactaaaaatacaaaaatcagatgggcgtggtggtgcacgtctgtaatcccaactactcgggaggctgaggcaggagaatcacttgaacccggggagcggaaggtgcagtgagccaagatcgcgccattgcactcgagcctgggcgacagagtgagactctgtctcaaaaaataaaataaaagaaaataaactatatcatagattataggccaaggggttgggtcctcaaatggggcatcttttttgaagaccttattagaaaccatgctagatgcaggcagaaattttagtttatttaattcttacaactactctatgcaggtattccatgttaggaataagaaaagaagctcataaactacataacttgcccagggttatgcaactaattggaagcagagagagtattcaaacccaggcctaaatgaatccaaagtcaatgcatttcaccccacttcaccctatgtcttggctaattcccacatacaggtttctctcagctgtgtttttattatttttctccatcttctaacaaaattatgctttctctacctataaagctctgaaaataagatacctgaaaaataacaagagtaaatcctcttgatgctttcttatggttcaggaagttttaacacacatgtaggttaaccttttgaagcagttctttatgtttaatttcaactttatgaaagtagcaatgagattttcaaagcatctagaattaaaaagatgtttattctctaccttgtcgggttttgtttctacatttttggcaggtcttcctttacttggcacctttccttctggttcgttttctaaaacaacaataaaatatttattttactagatagaaatgctacatgaaaatactaggtaacttgggaaaggaaaagaagcaacagtaggaatatatgtcttgaaggatttttttattaaaagccatattataaaaagggttatggaatttcctgccaaatacaaaccatctcttttcaaaaccagagtgttttacccttttcatctgaataccaaatacagattgagtatcccttatccaaaatgcttgggaccagagatattttagattccagattttggaatatttacattatacttacaggttcagcatacttgatacaaatatctaaaatctgaaatgctccaagagcatttcctttgaggatgacctttgaacttcatgtcaatgctcagaattttggatgttttgattagggttgctcagcctgtacatatttattacagacaattagaaaaataacagaaaactacaaagaacaataatgacaaatcacccaggattccattactcagctgtcacttcagggtatggttttccagtcctatgtccacatattcccataatgctttttagaactgcgatcctactgttcagagtttgacctgcttttctttgcccacttaatatatcatgaaccatgtcattaagtgttctttaataatattattcttaatggctacgttgtattgcaccaaataaatgaactgtgatttactcggaccattaatttttcactttgaaacactgcttatactaattaaggtcttcaatgattgggcacccattgtgtgctaaccagatgtcagggcacagaatctattttcaggtattagaatttcctgtttccttctctcctactcaaagaagtacttgttgatttttgaaacggaacacaaaaacctcaaggaccaaacattctagttcagtcactgatcaaggaatagttctcaccattagcagctcttgtgactggctttcttgctgtggtagatgagactgttctgggaacctgctttgctgcttgagtagctgatcgagtcattctcaacgacgtgggcattacaggctgcacaactgtgggaaaaaaaaataactacatcaaatgtcccttgtagttatgaaattattgctgtgaagccaggcatggtagtgcaatgcctgtagtcccagctacttgggaggcaggaggattacttcagcccaggagttcgaaaccagcctaggcaacatagtgagaccccgtctctacaaaaaatataaaaatcagctgggcatggtggcaagtctgtagttgcagctactcaggaggctgaggtgggaggatcacttgagcccaggaggtggaggctccagtgagctatgattgtgccactgcactccaacctgggcaacagagcaagactctgtcacaaacaaacgaacaaattccagttgaccttcaagacacttaaaaaaaattatggctgtggtagcctcagaggatttatagtaattgctaatattcctaccttttttctctttgtctgacactttcttttcagaagtttgtcttggaccaggtcggattgctcgaacatcactctcgttatcaatctatttaagagattaggtgctatgtgatttaattgcataatgaatcagaccatcatatttttaatctgtaaattgattcctcatatgaaatctgatcatcgtaaatgacccaacaacaacaacaaaaaactaccccaaataaaatgagataaagaaaagctttccattaagcttccaaaaaagcttacatcctttttcacaatcacagaatttggaaaatgctaataacccaagctattaaaaacagctcactataacttgccttctgaaggtccttaaacactcctagacatactttcacttcaagaccttttaattttgcctagaaaatacttctcctggataaaaagcgctttcccatggttctcttctccacttccataatgacttcactcaaaaggctttcatctcagggaggccttccttaactgcccaatcaaaattctaccccatacctatttctagtacaccccatctcccctttttaaaatctcttccataatacttatcatcttctggcatattatgtatttttttaaatgccttacatgtaagttccacaaagagaatttagtttattatatccaaaagcctacaacaccaggaacatcatagcaatgcaaaatatatatgcatacgtggaacttagcttcctcacctgataaagaggcatattatttcccttcttgcccacttcactttgttttagtaaccctcctgatatctctattacagtattttgaagacccgtaagtttataacacctaccctgtgtgctttcctccccatatgcatttcatgcaggtaacttggaatgcataataggagcccactaaacaaaacaagagtgtgacacaaagacagtttgccatggatctcatacggaatgttggagcaaatattttaagtgaaattgctctacatcaccatactaaaaacagtgactttggtacctgttaactctagtaaattaatcattatgtttgaatctgatactagatttaaaatgaatttacttactaaaaaagtgcaatttatcattttagtaacaattatctactatcaactataccttagtctgctccatttggtctttggcctttgaccttgtaatccgtacagaagatggaatagccttagaacagtcaaaagaagatgaacttaaaatatgaactggtaaaggtttacttccatatcttattacaaaataaagttcccattttaaagttaaattttatccttaatctcttatagcaaaaagatacttaaattcctttttctggttctagcttgatttaaattaagttagtaacttcaaaaattactcacatttctcagtgagaaagaaatttcaaaccgtattttccaggtattggaatcatcattaatatgagcttctatcctctcttagttctcctgcctctctgaccagtcctcagcctggtacctggcttctgcctacctaaaagtgctctctagagcccactttttcataattttatatatccttattggaatggtctcatttagtcctacagcttaaacactcatccatattcccaatattatatcctaaatcgacatcttagcaccaatttccatccttctttccaaatttttactaatatctaggtggcccacacaagtttaagatttttaaaaaggttattaacatgcacccacttaagcttgttccttatcttccttatctcttttagcagcagagcttctctctgctttttcaatttcctttacccctcaccatctacttggccaccagtcctgtcaaatgcctttatttagatgtcttacacctattttttccttttaaaacccactgcccctttccatctattctattacaatagtctcacaattggtctccctatctataaatgcttccctttccagactaaaatctttagggctatggtattttcctgaattattaatttgacaacggcactacccttatttataaacttctcctgattctgcaaaacctacaggataaacaccaaatcctttgcataacattgttcagcctgattctaccaattttcctagttttatcctatctcaacttacctacagctatcttaagagacctgattttcattcttctgagctactattatgtcattcccaccttctaccaaccagttaataatgagactaagggaaaggggttagtcacttaatgtcttgaagaaaataccaaataaaagaaactattcctttatattaagacactaaatttaccttttttggctcagctttcacagcattctggtttgataaaagaaaacaaggcatatcaggtctataacgacccactttaaatattcctcgtttagctttctctctctgctctttcaatttttgaagttgcttttcttctttgtatttttggagcatctgttttcgttgatcacctagaatagttttcattgcccctaggcagaaaaaaaaccaaaaccacacagtatataaaacatttcagatgaaaagttatgcaaatgtataaacaattatttttgtgtcatttcaactgctgctaaaaaatgctttcaggccaggcacggtggctcacgcctgtaatcccagcactttgggaggctgaggagggcggatcatctgaggtcaggagtttgagaccagcctggccaacgtggtgaaatcccatctctactaaaaattcaaaaattagctgggtgtggtggcggtcacctgtaatcccagctattcgggaggttgaggtaggagaattgcttgaacccaggagatggaggttgcagtgagccaagattgcgcccctgcactccagcctaagcaacagagcaagactccgtctcaagaaaaaaaaaaaggctttcaataagccaggcacagtaacacacctgtagtcccatctactgggaaggctgaggtggaaggatcatttgagcccaggagttcaagttcagcttgagtaacaaagcaagacctctccgcacaaagggaaatgcttttaatatttcttgttaattctttagcactctaaccacaagttatttcaacccctagtcttttaaaatttgtattcattttgccttcatgtgttcaaatattaactgcttgctatgtaataggcatttattacttcacttttaaattaattaacttgtatgatagccagcatccaagctgccctctactgatcctcacttcctggtagtcttgccctgtgtcatcccctcacactgaatagggctgacttgtgtgaccaagagagtattacaggaataatggaatatgacttctaaaactagggtagtgtttgccttgctctctcttgaagcgtcgcttgctctgggagaagccaggtgccatgtggggccttaagaagactcaagcagtcctatggagatgtccacatgacaaagaactacagcctccttccaaaagccagcatcaacttgctgttcatgtgagtcagtcatcttggaggcagatcctccagtctcagttaaggcttcagatatatctctggatgacatcttggctgctatcttcagaatcacccagctcagccatacccaagttcctgacccacaaaaattgtatgaaataatcaatatttattgttttaagctgctaagttttgggataactaatacaattataggtgctatttattataatagatgtactctatttcttctcacctactcaaggacattcttccagcaacttatcctcttactcatctattttttcctctactgaattgttgccattatgaagttacaagcatgcggtaatttctcccaacctacatcctcatctagcacttatttttctagtcccatttaaggcaaaattcttcaagagagttacctgtatctctactatcaacacttttatttatttatttatttgaggcagagtctcgcactgtcgccttggctggaatgcagcggcgtgatctcggctcaatgcatcctcggcctcccgggttcaagcgattctactgcctcagcctcccgagtagctgggattacaggcgcccaccaccatgcccagctaattttttgcatttttagtagagacggagtttcaccattttggccagggtggtctcgaactcctgacctcatgattcacccacctcggcctcccaaagtgctgggagtacaggtgtgagccaccacgcctggccttttttgagacagagtctcactctgtcgcccaggttggagtgcagtggcgcaatcttggctcactgcaacctccacctcctgagttcaagcaattctgcctcagcctccctagtagctaggattacaggcatgcgccactgcgcctggctaatttttgtattttgagtagagatggggtttcaccatgttggacaggctggtcttgaactcctgacctcaggtgatccacccaccttggcatcccaaagtgctggaattacaggtgtgagccaccaagcccagcctatttccaacactctttacattccctctcttttcaaaattatgaaaaacttctaatatacacacaattataatgaaccccatatacctattaccaagattcaataattatgaacattttgctgcagttgtttaaaacaaattatgcttagaagatttcatctctaaatactttagtatatacttctaaaaaataaagacatttctggaagggtgcgatagctcacgcctgtactcctagcactttgggagactgaggtgggcggttcatctgaggttgggagtttgagaccagcctgaccaacatggagaaaccctgtctctactaaaaatacaaaattagccaggcgtggtggtgcatgcctgtaatcccagctactcaggaaggctgaggcaggagaatcacttgaacccgggaggcagaggttgcggtgagccgagatcgtgccattgcactccagcctgggcaagaagagcaaaactccgtctcaaaaaataaaaataaaataaaataaagacatttcctttcatagccacgatatcatcatcacacttaacaaaatcagcagtaattccttgttatctattacagggtccagatttaaacgtctctatttgtttcaaagaggtcttttaaaccatctgtttacttaaatcaagaaccaagtaagagcaacacgttttatttgaatgtctttttaaatctcttcatctaaaacagatcctcctccccactcttcttttcatgccattgtcttactgacaaaaggtagtcagttttcctattgaatgtctttgcaagctgtatttgtttatttactcattcctccaggctccatgttttctacagactacaaattatatctaagggtttgattatactcatccattccaatctttcactccctgaacctcactccaccaaaactattcaagatcaccagtgacctccacagtggtgaagtccaaattctcacctctattatacttgatctaacaagcagtactgactaacatagttaatcagtctctcctcgatatgcacttttctactcggtttctaggatagcacgttcttctggttatcctcttacattactttgcattgttccttggttctttactagttttcccttgtcttttttttgagacggagtctcactttgttgcccaggctggagtgcagtggtgtgattggctcactgcaacctccacctcctgggttcaggtgattctcctgcctcagccgcccaagtagctgggactacaggcacgcgccacacccagctgatttttgtatttttagtagagatggggtttcaccatgttggccagaatggtcttgatctcttgacctcgtgatccactcaccttagcctggggtactgggattataggtatgagccaccgcatctggccccttgtcttttaatactttagtatcaactaagttattgcagtagtctacttactgctctccctgatgtcatacataccaccctataatctattctcaacacagcagccaaagtgatccttttttttttttttttttgagatggagtctcgctctgttgcccaggctggagtacaatagcgtgatctcagctaactgcaacgtccacctcctgggttcaagcgattctcctgcctcggcctcctgagtaggtgggattacaggtgtgtgtcaccacacccagctaatttttttatttttagtagagatggggtttcaccatgttggtcaggctggtttcgaactcttgacctcgccatccacccgccttggcctcccaaagtgctgggattacaggcatgagccactgtgcccgacctgatccttttcttttttttttttttaggagacaggatctccatgtgtggccgaggccagagtgcagtgacttttcacaggcaccattgtagcacactgaagcttcaaactcctgagctcaagatttcctgcctcagcctctggagtagctagggctacaggcctgactccaaagcgatccttttaaaacatgaatcagattacataaacacccattaatggcctctcatttcagagtaaaagccaatgtccttataatgatggtccttaggattctatgtaatctatctcccttgctcattcttttctacccagttacctacttgcattcactaaaacatatcaggcacactcctacctctaagcctttgcaaacgggaaataaaggatattttaatagcatactgagatagttagactttaatttgaaagatttttggttaagaaatggagcatttgagaggacaagatgagaaaggaaccaccctttctcagataaaaaatgtttggttctttctgccattccctatttatcctagcattatttcaatgccatctagctcctaacgcctgctatatgaacacaacaaataggagtagggtgactcctgactaaacacaagtcatttctcagtttgctttctcttttctgtagcatcctttgccttctaagatgctctattttcatctttttctgagattattcctttcttctttagttggttctttccatcctaatggtcccaatccttctgggcaaactgcaaggatgaattctttgctcttttcttactaatgtttccattgacaaagtactctcatttcatggattctttaattattctatttttacatttcttatcaatttatcttgtcaacacttatcctacccaagctccgtaagaactttaggatttctatgaagcaatatagataataaagtgttataatactccacaggtaaaggcttttgccttaaagacagtagttagttgtagataacaggttattaaggggccaggcgcggtggctcacacctgtaatccccacactttgggaggctgaggcaagataattccttgagcccaggaatttgaggttacagtgagcacaccactgcactcccgcctgggtgacacagtgagaccctgtctcttgtaatttaaaaaaaaaaaaaaaaaaaaaaggaaaaagaccaaaaaggaaagttatttatagaatggtatttcaaaactcttctggccagagttttttactcacacaggcattaaaccaactattattcactcttcaaagtacttaaaattacaacagacctttacttacttggcttaacattggtcttttctggaacaagcccttgagatgtctcatctaattcaacaagaattctaccttccaaggttggaatgtttacatctttcaaaccaaagtgtctatttcgttcgtattccttatgtctattttctttctgagacagtgatttcctatgagcaattttagttctaatcatttcagtacttatatccttcctgtgtcgactggcaaaatgtgatgaagacatcctgtcaaggaaaaggacaaaacccaacttacatgaattttcattatttaaaaaattaagattacagttcatttcctgtcccacttcagggccttctgaaataaaaatataaaatgtgcaatgaaataaatatgtaacactgaaaagtgagaagaagattatcagagaataagaagctacctatttgggggttttaaataggaacttgcttgaccagtgaagagaaagccagtaagtgatagtccagaataaaagaggctctgggcttaccacagagaacactgcaaaaagaaaagcgtgaaataaaggtgaaaataggttaagtgaaggaccatgtacacaagggtttccttacccatgatgaggaatgcaggtagtctaacatttcttctaaagccaaaagaaaaccaaaaacaaacaaaaaccccacaccaggtacctattagtcatatagggataatcaataggcaaccggatacagatagagttggatagagaggcacagggcaaagtatgtggaaaggaacaaggagcttccatgctctctcaggtagcaccactgtttaggaaccttcatgtattcacctaagaagctctccaaacacaggtgtttttttttggtttttatggcagcttcattacataagcatgagtgattaaatcattgaccactggtgatcaagtcaaccttcagctcctctcccctccccagaggttgtgaggtggggctgaaaatgccaactctcgagaaatcctgccttggtctgtctagtgaccagccccaatcctgaagctatttagaggcatccagctatcagtcaatcattagcatacaaaaaggtaccactttgaagactccaaggattttagtagttgtttgccagaaaacagaacaagaccaaatatatagttcacaataaccctatcagtttgctccattattttcatccatacaagaaatcatacagtttaggccggcacggtggcttaggcctgtaatcctaccactttgggaggtcgaggcaggactgcttgagcccaggagtttgagaccagcctgggcaacataacacgaccccgtctctataaattttaaaaaagaaaagccatacacacacacacacacacacacacacgcacaaaatcatatagtttaattggcacatgcctttttcttggaaagatctttgagaatgtattcaagcaaaacaaaagaggacaataaagacgacgtcagtagatccaactagggagaacaaagaaaattagaaagtttgagggggtcacctgtgtagctggtatagagaactaccaagccaaactggagaaaggatactgattctcagaagtcttggcagttaaaaaacaaaaacaaaaaaaggtaagggggaggctctgtgatagacacactatggtatattcttcaacaagaattaactaaatccactagaaaactccagataatagaaaaattggcacaagtaatgcaatacattgttacatgattctaagcaatcaacaaaatataaaaaacgagaatctgtctgacctgcatgctaataacattctcctctaagacccaaggaaagtgacaatggactgtgcttttcataaagaactgtcttctactatttatctcctgcaatattaattcgctaaagattgaagaaaaattaagacttatgtattaaatacaggatagcactatccacagcaagagaaagagcgagcgaggacaacattaaaggtacaattatcagaataaccctgaaaggtagttaactattatcgctctcatacagatgaggtcaattaactgctcacattagcatatctaaaaggtggtgaagctgggatcccaagcaaggcagccctggctccacacacacctaaattttgtttggctgagtggcgtttcctccagcttgaaagtccagaatgcgttaatcttgcttgactagaggttctcaaccgggcgtttttagttgccatgggacctgggaagagctacgggaatttaatgtcggagctagtgaagaacagtttcaccccaaaggtcaattacgccccggtggtgaaacgctgactattacagaggtcagggcaaacatatggactcttctaaaggctcgcattatcagcttcgggaagggcaggtaacacggtcctaaaggagcctgcctctgacttgctcccgctcgcagcccccggtcctcagacccttctagaccttcaacggaagcgggccagtgttctccgtccagctctccagcacccacctacctgagccaccttctagcgtgaaacctcaaccaaacaaaaagtaaagaacactcggtctggacgaccaccgccgactccgaagcaggaaccctcacaacccgagcctccacgaaattcaaacttgccgcaccgagccgctgattggaggggctttaaccaacacttccggggaagatcccaccccttccactcaacgaggcttgcgattggtttgct

SEQ ID NO: 252 - DNA, 43563 bp, Homo sapiens; identical to SEQ ID NO: 251

SEQ ID NO: 253 - DNA, 310650 bp, Homo sapiens
gcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctggtaagatctgtaagtacaaaattgtgctgtgtctgctgcaatgagaatattgctgggcaagctgcagcttttcttcctttcaatgtctttgtattagcataacaggtaaaagctggggttgggggagaagtcactgctttattgatgctgtgtttctatgatgctgatgtttaaaatgcatttattccttgtgtgggagaaatgtattgaatctgtattccgggaggttaggatcaaaccagggaaagaaagactacaggtatatttctcagtgtttcactagtctttgctgcagtaaaactaatgggcaagacgggatgacagtgctaattctgggactttcagatggctacacgccctttctgtaacggcagatgggaaaatgtgatcgctaaatgttttttgtcttttttttttttttaatcaaagggatgaggggtggggtttgcagttctcaccggatgatttaaaagaatggttataaagtttcctaggggagaatttggtaaggggagcaaagcaagactggaggtcatatgggctcaccaaattttgtctggcattttgctttatacccagcttctagataacagcctctggagtttcctttaccatttacaccagttaagttgtcagtattaaggttcttataatactttatgaaaactttcagaagttgatgacttgggaacaaaacttttaagagctctgagattagccacgtataacccattatgttaatgggatactgtaacattggggtttggggggaaaattggaattcatagtttttgcttctccaaatgaaaactacttatgtttaaataatcagcatcctgactatgtcctctgagaaacattcacagaatgactaaatagaagttatactgagaaaaaatagagtgaacagtagaatcacacagaatcaatttggaaaatgaggtattcataattttatctacagtggcaatgttttctgaagatgtctgtaaaagaagaagcatatgctgaatattgaattgcttgttttgagcaattttcatttatctgatgggtttatcatctttttatttttgttgttgaaggtttcaccaatttatgtgcattgtattttataaggaaagaaatgtttaagcagactctttttccctcctccttcacacacatgtgtaaacatacgcatgttcacaaaacaaacataaacatacaaaaatacttacacaatttgtgtaaaaaaaaagaaatacagaagcatttcatctttgatgtttcagtggggtttctttttctttttttaagcaataatcatggctgtgcagtccaaagatttcaaatatataaatgtggaaacttttatataaagctttatgtgaggttatataaatgcataacttatcacatcttagcaaaaaagtcaatcatttataaatgacttcattgcattacttcctttgaatatttgtagtgaaggaccagaatttttttttagaatttttatgtagctttccttaatgaaaacaaattcacttgtttacttagaaaaggatcacatattttctctgagtttagaaccccctctaaaaaaaatcaattatgttgtgaaaaggatgtgtggtatattaaattgattgcatacttctgggttttttttttagtaagtaaaaatgctcagtagtataatagtaaatttgtaccttttaaattcttttatgtgaggagaaggaatacaaaatatttgcttatttattcactgtttattttaataacatattaattggaatgcagaagtataagttctacctattaaaaatgactcaaactatacataaaagttcaaaagggaaaacccatcacctgtaaataacaatcatgaaatttggcgactatcattggagacatactggtgcctaaattcagataagatgagagataaatacttttgtaagaatggtttcttactatacaccttttaaaaaataaataataaatatttagataatatagtcaataatagatactcttctgtaagaatgagatcttatcctacacttaaaaaaaaacagaaatattggccgcgcgcggtggttcacacctataatcccagcactttgggaggccgaggcgggcggatcacgaggtcaagagattgagaccatcctggccaacatggtgaaaccccatttctactaaaaatacaaaaattagctgggcgttttggcgtgtgcctgtagtcacagctactcaggaagctgaggcaggagaatcacttgaccccgggaggcggagcttgcagtgagcagagatcgcgccattgccctccagcctgggtgacagagtgaaactccatctcaaacaaacaaacaaacaaacagaaaacagaaaacagaaacattgagtttaatttttgattttagattttaattaaactgaaaaaagagaagttgaaacaacattgaagaaattgttaaatttcatgtatagatttctctccaatggagatattatgtccagaataatacccttacagttaagaccaaaaattttgaaaatagaaatagtttgaagatttttttggatgcacgtttaaatagtaaacaaacttttataacccttgttatgatagttaaatgcatttgcaatgtgacttgtcatcaactccacccataccacctcaatttaaactacatcagttttacattactgagtacatacattctggctgaattcccatggtctcagtttaaacttatttcaaatttgtaaggaattatcctttatcaacaggcttttactacccaattcaccatttctgtgttctttattttcaattattttttgggttgttagatttcagtaagtagtacctctccaccaaagaaatagtcataggtgctatattttctatgagtttgcatcttgaacatgtatttcttttgccttagacatgcaagatacgttatctttcttggatcaagcttaattttttcttttggaaatgtgtaaatgtttaaacatttttggagacccttcctgtactgaaagttgttttgcaacatttttaggtctgtctgcaatttccgtcattgaatgtgacttgctttttttctgataaatgcctacatgattcttttgttgtgtgtgtgtgtgtgagtgtgtgtatgggtgtttgcttttacagaatattcctggatttgttccattttcattaactttttttgaggtttgccccattaatttaagattcttttattttaggatttgttgtactatttcttttttgtcccttaactgggcgtggccaaattgtggttatcttgcttctttcttttcttcaggatcaccaattttgtacatgttgtatctcatttgtctactttccacatctttcatatccaaatttcttttcaattttaattgacaaattggttatcttctttatttgagaaccacttgttctcttgtttgccacttgaatgaatagtatagcttgcaataaacctattaaggcacaaccttctgtattgtgatcttgtaaatacatgtttccttctcttaacactctagcaatttcctcagctggcaggtttttgggcaatctgtatcctcctgaaagtaagagaaaaagaaagtactgatcggttttctctgatgtcccccaaaggtccatgatttttagtatttggctacagtggaaatgggcttcaagtcgtgttttggggttttgtccactaacattttcactgaagacggagggtttttgcttcgttttttatctgcaccacgaccactgccaccttttatatttctctttattgtttctgtgggacaatagaggacatttaaaaatctctttatttaaggagttttaaatagcaatctttcagtttggaggaattctttgaatgaaaattttattagaatgttgttattctcagtattcatattgaaaagagctgttctagttaagactgagttcatctgcatgatgtgttgtagtattaaacatttattacggtaaaggcgtaacacaggacatagtagaggaaaaacagagccattgggcatgccttctgataatgtcccctattagtttatattgatgaagtctgtggcctacttaactattttgcaatgagtcctaaggtaatttacagaaacgttacatcatagtaacatgaatcaaaatctgtagactcaaatcctttttgaaagtatactgagtagaaaacttatatgtattaggtttacaattaaatgaataaatgaatgaataaataactgaatttccctatatttcaaatccttaaaagaggcaataaaagaacatgatgtgtcgtatgaagtattataaaaaacgaatgatcttactaaaaagcaaatagcaatttctcagtgtcaataaaatgatagtgagagcaagattcaggaggcaagctcttgagctgaagtgccgcccattgtagatttccttccctatatctagcacagaatagctctgtggtcttaggcaagtttcttagcctctttgtacttcagtttccccattcatagtggagataatattagtattgactttacagtattttcaagagaattcagcaggtaaatatgtaaaaaatcttggaagaaagcctggcaattaagaagcactctatgtgttagttgtttagttattgttatattattattgctattataacatttatatatgagccttaggatcaattgggtaaaaataatataaaacaatgaaaagactaaaattataattatcatctaatcaattgtattgggtatttaatagagaattaaatttggagtgtaaatcataagtggatattaaaatagagctcaggaaaaatggtgagaagatatagagatgctggtctctggatccaactagattaaaaatagaaatggtatttctgtatacaccaagcaattggacatgatcaagaaaaagggtatatttgcgggggggggagggatagcattgggagatatacctaatgctagatgacgagttagtgggtgcagtgcaccagcatgtcacatgtatacatatgtaactaacctgcacattgtgcacatgtaccctaaaacttaaagtataataatactaataataaaataaaaataaaaaaaagagaaagggtatatttgattttttgattataaaagcaatgaacagaaaagcacgagaacaaataagccagaatttctttcttcaaagaaaaacatcacaaatacttgtacatttctttcctgttgttttatgttgttgttgttctttttttatgataatgccttaatcaagtaatgtatgcacctggaaacaacaacaataaaatttgaaattatagagaaaacaataaaataaaaaataaagacctttccatgatttcctgtcttatttcacagagatattttctatagtttattttattgtaatgttttccttctggccaccattatacatttgaataatatatttgacttctattgcagaatctataaactcaacatcatgtctgctgactccatttttttaaagatgggcagtttttcctattttcacactttcacaagacaattttaggtgttacataagtctttgaattcttttggcagtaatgcacacacacacacacacacacacacacacacacatatatatatatatatatatatatatatagtgggaaattttaagtattcaggtaaggattaaatttaataatgaccaattcccacccccagaattaccaaatgctaaattttattggagatttaacatcttcagtattcataaaatgaaaatactaatacaatatataataagggcctacgttgtaactctacctagtccattcctcattctacattaccatgaattgtatatttacatataattgttatatatgtatgcctatataaaatattattttaaaatattatggaaatagtatattgaaagcaaacttatttaacttgtgtaactcattccatattagactatttagactcattcttataaataaacacatttcgccgggctcagtggctcacgcctgtaatcccagcactttgggaggccgaggcgggcggatcacgaggtcaggagatcgagaccatcctggctaacacggtgaaaccccgtctctaccaaaaatacaaaaaattagcagggtgtggtggcgggcgcctgtagtcccagctactggggaggctgaggcgggagaatggcgggaacccggggggcggagcttgcagtgagccgagattgagccattacactccagcctgggtgacagagccagactctgtctcaaaaaattaattaattaatttaaataaataaatacagttctaggatatatttcaccttatgtgttttatattcttattattcattcccttattgagggatatttaatttattgaaaatattcactattgcagtgttctattatcacatacattgaaaacttatacacattaagtgagattttcattaagaatatcaagtccgtgctgcatgtcaacaatttcatgtttgttatttctggtctcagaattcctatgtttcaacaaatgtacttaattcatccgcacctactatgatgttgatgaagttggacttatttcttacttcttacttcatattcaaccaaagtgttttttagtaaacagtcttttattggtttgaggaaatattctttattcattttttcaacttttattagttaaaaatggtatactccctttatcgtattttagtaaataactattttaacataaaatgtacttttatattttcaaataaagactaaagatagtgtatatatcttcttcataaacaggacaatgacttgtttaaatttactctgagatatttctcccagtgctcatatttgcactatttatttttaaactgcccccaatatttttgtcaaggtttttttagacttatgacgtgatttcctgagttctttatttaccatattcttgctatttatgtgcatctcctagattctcttcttgtgctctgaagaccattttaaggtcattcaaaaattgttttaaactcccttaaaatttatttgttgaaaatcgcttatgttagtcacattctaaaataatactgtagttcatcagagcactctatgtggaagatacttttctctcaacaatttttgcatattctgttccatgatcttctggaatataattttgctcatgaggggactgtttatgatgtaattatcacacttttgaataaatattcgtcttttcactcggacagattttaagaatttctctttgtcattgatttcttcaagttcactgcaatgtatgtagttgtggagttgtttcaaatttatctcatttaggcctctgcaagctcctaaatctttcttccattctgaaaaattctcagctattatatatttcaatcttgcgtcttttaaatccctttattttctccttcaggaatgctcattcattatttctaggcttctgtctttgatttctttgcatttctttcattttctagtgttgcagtcagtgtaatttctaccaatctgtattttatacttttattttttaaaaaacagttttaatttctataatttatattgctcttttaaaaattatcctgctattctgcttgttcttaatagtttctctcccattcttaagctctcaaaaaaatttcagtaagtttattttagattgtgattgttttactattttaatttttagagtcaaatttctttattacttatgtctgctggatttccctcatggtggttcattcttcctggtgctcataatttttttatgacaaattcaccttcaacagatgttgttttctatgggagaccaaccttgtttgagttgtgtatgcttttgcatagcatcgcattgctattgattctacagtggctctacaaatatctctggttctggactattttatatgtgaattttttggcttcaaattatattaccatatagacagaatgaatttgggccctacaaccaagcatagtacacattctgggttctgattgcctttttcggattcttttttctaccagatcaccaagtttccataaggtcagctatgtaatgcaaaggacccctttttgggaggttattccaactttacaatctccttgccagtctgagtttctctccatttggtgcctctgagggcttacctctttaacatttaacctcggctatgtgtacttcttaaagagttttatacttacatagcatttacatgtgtttgtagtggaaaagaaatccctcttcacgttgcatggtgccgtgtacttccctatacttccatgttggctggacttgttcccatccgctttccatcatttagaaagtcatcaaactctcacttgctggtattttatttttatcaggtactcttatggtttcatggagttattttgtaataggcaatggaacatttgctaatttttttctggaaacattgtcaagtctcaggtatataatctaataagaaatggttaatgtcaattgtatatgtctttccattggctccacaaacattactgtaacaaattaaagtgcttgttttagtccaatgacagaatatgttagggagctctagaatttagttagaaaagcaagccagtggatgttattagtttatatattctttgggagtggcagctctattaattccttaagtttaatggtatgcaaattcttaaaatctagaggcaattattcaaaaactttgttagcacagcaattcctagtgacacagtacaagctgaatgctaaacggaccatatttttaagatgatttctgctgaataaaagtgagaatattggatgggtccttttaaaatccttttttaaaagtcttcttttaaggcgggaaggagagatcaaataagatatttggtgaagtttctagtaatttatcattcatgcatgtaagaggccaacatgaatgagctctcaaaagaatgtagacattttattttcaatgccttttttgcatattgtttcaaggtttatttggtttcccatatttgtatgtctaatgtggttgtgtaaggagctctatatggagaccgctgagctatctttctaaatagcaggagtgcaatatacttgctggaatagagcttttagtgaaagaacatgattttcctctctggcatctatcagggtctcccaatcactaaagcacagtaaatgaaagagaaactcagaaatcaggtgtgccgctaattttctatcaacagagttaagaataaattaagaacagtcctgccgggcgcggtggctcccgcctgtaatcccagcactttgggaggccgaggtgggcggatcaccaggtcaggagatcgagaccatcctggctaacacggtgaaaccccgtctctactaaaaatacaaaaatgagccgggcgtggtggcggcgcctgtagtcccagctactcgggaggctgaggcaggagaatggcgggaacccggggggcggagcttgcagtgagcagagatggcgccaccgccctccagcctgggcgacagggcgagactccgtctcaaaaaataaataaatacataaataagaaatagacatgcattaaaataataggtaggctatataatacacagaaaacatttatacaaaattaatgtccaggccgggagctgtggctcacgcctgtaatcccagcacttttggaggccgaggcgggcggatcacgagatcaggagatcgagaccatcctggctaacacggtgaaaccccgtctctaccaaaaatacaagaaattagccgggcgtggtggcggcgcctgtggtcccagctactcgggaggctgaggcaggagaatggcgggaacccgggaggcggagcttgcagtgagccaagatggcgccaccgcactccagcctgggcgacagagccagactccgtctcaaaaaataaaaataaaaaaaaaagaaagtccttaaagttgtgctgagatgaaaaagtttctgttattctagacttgatagaacacacttgtttaaagtggaacatgaaggtgttttctaggcatttaatgtcgttagtcaattcctaaacatgctcagttgtgaatctgtgttgctgacaggtagaattttgacagccctatatataaatttaccacaaaagtatatgctgaaaatggttctattagaattagccggtgcttataaaatataattttttcagagttgccgactttccttttttgttgtccctttgtgcagactgtgcctatgcggtttgtagaaaagagaaggaagttttctatctgctttctttagggcacttaggtggcaaaagtattatttttactgacttcactcttattctgtcttttgtcatgcagatgtacggagtgattttgcaataaacagaaacaactttctcatagaaaaagagagactggagtttaaaggaaaataatctattcgttatgcgtagttcaacataggaagccaaacagcagtttttaagaaattacacacacaagacacaatgcctgagccaattgcttttaccattagggggctccttttacttatgaggcaaaagtcatttttccaaagaaacatggaacaaaaattcattttctgccagtgaagtttcaagattcacatatatctttaggtatccaaaaataatgttagtctttgagtattagcccccggatgttattttcttttatgattttttttctacatgaaacggtcttcaattcgtacaaaaattctagttaattctgataaataatttaacgtactaaattaccaatattaataatatttttattcaacaatatatattagtaataattccacaaatattggctgaatacttactatgtaatagatgctatttcaggcactagtgatgcaactatgaacaagacagagaagagttctgctcctgtaaaattcacatctgatgcgtattcttgaattcaatgaagtatacaactctaccaggtggaaaggggggctaacattgttaattttcggtctcacctgacaaatgagcattagaagccattaaattatttaattccaagatgattattttagtaaagtaaacttgcatagtgagatgcaccaaaaagactaaataaaaagaaacatatatttactaagaataataattattcctctgtttttatagagagtgagatattctgggtttttcagaggattaacaaaaataggatctcacattatacacatgtttatggaatttcctaatcacagacccaactctttccctgaaaggtattcattttcgtcaagtgaatagtaccagtggatttactaagaaggtaaaatttgttcaaaatttgcaaactacactaaattattgaataaccttggtaaattagtacgtatataacaagtgaaggaaaattaataaccaacagaatatcatttaatacatttttccagttataaaatcatatatgtttattattacaaaatttggagaagacaaaatatgcatagattgttattctattactctgcatgtggcatcctttcagtcatcttgtatatgtgtgtacgtgtgtgcgtgtgtgtgcatttaaaatacaaaattgaaattaatgcatatgttctgctttatagcttgtttttattaattaacatcttataaacattctcaagtatcattaaatattctcctaatgctgaaggatttttcaccagatgggtgttccctttttactcaaaccaataacctattgttagatatttatcttttacacaatttattgaacaatgctatggtacatatccttgtacctgaatcttttaatatgtgtctgattatttcttaaaaacaaattcctagtagtacaatttgcatgtcaaattgtgggtttttaaaaatgtgagtgtgtatattactaaattgtcctttaggaagacaactccctctgtacttgcaggcaggtgagtgctctttgtgaccatccttgttaatactaaatattattaattgtaaatactctccgattggattacaaaacaaatacacagataacagtatttcagtattgctctatattacattttttggaaaatgcatgcctgaatgaatatttcatgagtgtttgaaccattcatatctgctcattttgctgaagtcagcctctgtcctttgtttattcttttgatattttacattttttcttatgctcaggaagttcatcagatatcggtgagataacttgtaattttcacttttcttcaagtttataagacatttaacttattacattttaagtgtgaaaccttgaaaaatgttttataaattatttgaacctcagttttcaaatgtacacagtgcagccggtaatacctgacctggctttcacaaactcagaatggtcagataaaaactgaaatagttaatgtttctaaatgtatttttatagctacaagtgatataaagttattgttctagtcttattaaagataaatcagtgtttgtccctaattgcacatctggtcataagcaagtctacaacttaaagtttcctaaatataggtccagtgttatcaactttttacctccggcacctagcattgtctggcctgtggtgtgtgatcattaagtgcctgcttaatgaatgtagattctaagtatactagagaaacataaattaaatacatctgtgctcattccaagtatgctattacagtgtcatctaaatctaatggtgaacaaaatagcacatattaagatgatattaatgttaaacttcaatttatgcctctgcccttggtaaccatgataatccactccatgatgaagcagtcaggaaatgtaagtagttatttatttcatcactacaaattgtatttgagacctgtgttttggaggtaatctatattgtgggctcttcaggaatttggtatgttaggaaaattcaggactgcataaggggaacaggaataggtttgagggtaaaaggaaattgtaatcatccctgaattaaaaaataatttatatgttacagacaggtaaagtatacacaaggtgtgtgatattttcttcttcaaaaaccctccccaaatgtgagatatataacttgcttttccagatagtcagaacaagaaagaacttcttatttttgttttagcttgcatttacgttgccataacacattatgttaatatttgatgttatttgactttggcagaacataatgaaataaggtgtttgactttgccaaagagagtttttggaacaaacctgtgtttgatttagatctgaggccaggtgttcaagacgagcctaggcaacaaagtgagacccctgtctgtaatacacacacacacacacacacacgcacaatctctctctctctcaaactttggcatatttagtaataaatattaaagccatgaaacaaacatattttacttatagcttagaataatcacctttataaatttcttaagtgatttgtagtacactgtggacttgactgttacttttatatcaggttataagtaatgttggctagacgtctatccaatgaactttccctttcacttcacatattctctgggctcatggttagccagaacaatttagaagccaaaaacataaccaaaattatcacatgtatttttactgcatggtgggattattttgttttattgacatatatcattttggtcaataataataataacaataaaacagcgttgagttactcaaatattagttggggctcttcagagaaatagaacgaatagtgccacattatctatctatctatctctctaaatatatgaattttccctttctccattttctgttttattaagggtctcaatggattacatgatacctacattggaaatggtaatctactttactgagtcccctgactcaaatgctagttttatctggaaacaccctcacagacacgtccaaaatattatttaatatgggcaaaccatagcctagtcaagttgacacataaatgtaatgatcacaatgatactagtaagagaaattcagttgaccttgctgataaataggtatttttcacacaaaagccagaaaatgatcataaaatatgtcatatggtttaaaattataattgttgagtacccatttcaaaatatgattgttcatttgaagaataaattttaagttggttcaattctatagataattatgacatgactgaatatttattcatggcaaatccaagagcattcatttgcaattgccattcatgtagatgtcaaagatgccactttttattgcacatattgtgagagggtaaaacaaataacctttcctccttaaaattagattgctcattaaatgtgtcattaatcatattttagactccaaaagatcaaagtaaaatggctctgaattttaaattttccagggtgacaaaagctgaacagtttattaatgtttgaccatgctccaggtgtggtggctaatttctgaagatgatgttcctctcctttcaattgcctttcagctctcatggtaggtgctaatgtgtataattagcatgatttcagagttgtgacctgaacgacagaccaatatctataagggttgtggtccagccaggttagaataataccaaattgatatgcaattaattgagcttgcaaagaggttactgaaaggagttaggtctaaattgcagtttcaaaataaatcacccgaaattatttaagagtataactgggactccccaaaagttacctccatctgaaaggtttagatttggaatctccagttgtgatgataaatataattataattaaggctctgggtgttaatgtcagtgttatgcagaaaattaccctagacatagatagctcccagcatctacatcccgttttcaattttatttctaataaaaaaatttaatccatttgaggtgacaaaattccttagagaataaatgttttttaaccttgggtagtagaataaaatatagagacaatgacatatatcaaactcatggtattagaagttgtgtatcccttatccaaaatgcttgagaccaaaaatgttttagagtttgaaattttctgaattttggaatattcgcatatatataatgagatatcttggggattgggacccaagtgtaaaaacaaaattcatttgtattttatataagctttatacatataacctgaatgcatttctatatggtatttttaataattttgagcaggaaacaaagttttgactacattttgactgtgatgtgtcacatgaggtcaggtgtggaatttttcagtttggagtcctgttggtgctcaaaaaattgtagatcttgaagcgtttcagattttggatattgagctcttgagtgctcaaactgtaatatcattgagctgtttagaattaagtttgtattaattagaatagtttctacatgtttggtgtaaaaagtgcttgttatatttaaggctctaaggagtctttgccagatttgatttgtatttgcacttttaattttgtaaataaataactgattttagacttacccgtttaagttgaaaagtactgtatataaaaattaactaactttttagaaaaagttttgaaatatttaaaagaagttaagatttactattttgtaagggtaaatacaagaattaaattcttaggtttttcttgttaaggacctactgttgatttgtcagactgtttagacactttaagagaacataataattcaattttagaattaccatttaaaatatttaaagcaattgtagtaaagtaagtcaaaagtcctgattgtttatgtgtgtttagtctgttcaacatgaaataattgaattttaattgtggcaaaagagaagaaagtttttcttgttttaataagattataaaaagaataacagacatataaatgaggctaaaaattttaagggggaaacagcgtttgcatttgaaattataataaatttgatattatgatccccgatgagcactggggctctaaggggattcaagggacttgcccgagactacagagcaggaattcacatacagattttcatatacgaatgcagtggctgtggtttccacattcattctcaaaaactcaatgtacctttttggagatgcatgcaaaattgtagaggaaaagaaagtaatatttagaatatagtttctaatcttttattgttaatcttcttgtttacaatttaccaaggcaaaaaagaaacacttttaaaatgtcaaaataatataaatattatctaccattgtttttctattcccagtttaatagacaagtttctctgtgtggcaataatttttaactctaaacagagccagtagctcctctattactttggactttttaaaagatatagttattttgagtttgcattcacacatattctaacttagaacacacaaaaatttacattatttattttctcttaacatatttgcaaagatttagttatatctgcaaaaatgatatattttttattcttctatttttacccaagttgttgatgatcttctgagatccatctgaacagaaaaggaagagacacatacttctatttatatacacactcatattttgtgtgtgtatacaaccttattagcttcttgacaaagaaactaaagagatttaatttttaaatgcttcttcccatactctatccttttattataatttttaagtctttaattatttttacatatctcttctatatacaggtctttatagctgggtccctactgctgactcagttttgaactacccatcgatcttatcttaaaattgttgtctagttagtggagcatttatttatcagcttttccatttgcttgaatattttacatggccaaatatatatctgaccaatgtccttctttaggaacagtgctttatgtttttcacatctgatatttacatcaggtgcattcaaaaggcagtgaaccaagtcctataaaaacagatagaagaatcacttttaagtattaatgtcagaagaagagaattgctttttgatttaggaaatgtaaatagtcaatcttattaaaagattgactttaaaacatatccaactctgctaaacaatggaagaatctaatctttttttgattgaagaaaccacataaaacaggtataccatcatggggaaggtaggtactttctgtattactgtcaaaagacaaaaattgcctcttgacttaggattccataaacttttatggaggtgtgcatggctggaagacatcaataccatgcattgttccttggatggtgggctaggcacatattctaacctttgaacatttctaaaatagtatctttcaaagctggcaaatttggggaaaaagaaattccttatacagacgaagcttgaaggaaggtgatgtatgttgtaatgggtttgctaagattttcacttaatattcagcagccctgagaagttttcttatcttctactctaagtcagtactttgaaaaaaaaaatatgaggagcaggtttgacaatgttgtcaggattgtgattgagatgaagctagaacgatgtgcagttgaagtcctcccaggtcctgattcaaatctacatctgatttcatgacctctgctgcattcctctgtcatgagaagagcagggactcttagtccgatgacagaatcaaccttaccctttggttaattagaaggggcagtagtaaagaactcgaattttagagccaggcacacctggatttgaatacttgtcagatgaaccacttactacatgattggccagagacatacactttgatttcactggcctcatttttcctatgtgtaaaattgagaaataatagttgtcccacctcatatgattgtatggaggattaagtgagattattgaatctaaaagtcttagcacaatgtctgacatacagcaactagtagtgaatttcagccagtgtagcattattgaaattattatgaataagggactattgtagatgttatgcggaaagcagtagtcccctggggccatatagtgaaccccagtgctatttagctcatttctattgtctacgcattatatacagttcaaattagtaacaatcacaacaagaacaaccatcaattgatatagtttcaggcactttctttagtactttaggctaacgtatttaattctcataaaaacctcaaaggatatgtggtatcattccccatcttatagaaaagtaaaatgagattcagagatgtaaagtaaatcggttaaatagaaaaaacagttgttagattgtagagtcagaattcaaaaccaggcaggcttttgccaaaattaacgcattttaccaccacattcttaattcccaaacagagcaccaagcaccctaggatgcaacagtgaactcagagaaggatcataggatgtaattaaatattctggtgaaacagtgatgctcaacatctgtcaattactgagtgtgaggtagtttcatttcaacacatatcttattatatttctttcaatatcatatatttattaaagctgggtttccagcggatgttgtggtaaaaaggaaatactgtgtgaaatcagtgtagaacaggaaatgaggctgggcaatcttattccaagttttgaaaagttgtgccgtgcccagtggtagtatgcttgttgtaagtagaagtgggtacttaagaataaaataagaatgctatttttcctctaatatatacatattatatttttaaagcatcctgtaagtcacttgaatataacttctttgagccaaaatacttaaaaatggaactattatgtagttattttgccctaggggtgccataaaaatgattgatccactaaggagatcatgatacgaataagctggggaacctctgaactatattattcagtttatcagggaaatatgtaaaacttaaggatcagttcatcaaacctcattaaccacctgttacttctcaagtacttagagattcctttctaaaagagctcacagcatagtaagaaagatagacactgtgttagtcagggtcctccagagagacagaatcagttaagtatgtgtatagctattatgacagaagtttattagaaaaattgagactctcgattatgcagactgaaaagtcccaggacaggccttttgcaagatggagcccttgggatgctggtagcctggctcagtctaagttcaaatgcccccaaaccagggaagcccatggtttaactcagtccaaagccaaaaacctgagaacctggagtgcttctgtgtaactccaaaagctggagtttcaatgtcggaggcaggagactagtgtagcccagctctggaggcagagaccaattcaccttttctgtttttgttccatccaggcccccagctgataggattgtgcccacccactttgaggacagatcttccccttagttcactcagactcacatgctaatttcttctggaaatgtccttgcagacacgcccaaaaataatgcttcactagttccctaggtattatttaatccgatcagattgatccctaaaattaaccatcacagacacaacgtgcatactgaaatatagtgtgtgaaccaaatttccaaggggccagactcccaggcaggtcacataaatattcaaaaggccatagcattaagaagtgagaggaagttgtattggggagaaaagcaaacataagaaattttccagaagagatgaatgaaagaggtccaaatgcatgctatttatagaataatgagtatggtaataatggagcccccactaattacactatcacttattaaatacttgttacgttccaggcaatgcattaggcactgggttgtagagatgaaagtcagagtgactttcctcaggctctgacgtctcttgaggagtctgacaagaaaaaagtacattcaggcaaatgataagagatgagactggaaagcatggctgtggtagaagtaatatattgcctgtaacttctaaagaggccagggacttttagaataattaacacaaggtctaattactttggattaactagtaaccaaatgcattcacaaatattgatgttattcaaatttgcttcatcttactaaaaaagatgctgtatttgtgtattcttctgccaaataaatgagaggcatatgtatatttttccagaatcatgacttattcagtttatggactaattattggttgagaagataagtaaataacaaattatcatatgaaaaatgtgagactgggagtaattaatgcaataaaatagattgctcaatatgcgaacaacttcattgtaaattctaggaaaagggcctgatttcagaagaaagataaagtcatcaaaagtcttaaggattaaattaaaagataattttaaacatttactgctgtagtatttaaatttaatgattctggcaatgagactattgaatatatgctgtgttatatgtttaaggggatggactcaggtagttaggatgtgattattactgtcctacgccctctagttaaatcctgatagaattctagttttaactgaagacctctatttaatcataggctgcatcaagttgcagacacaattcatgaatactcatatataatggcatcatgctactaaaacacattagttaaatactctcactcactcaaatggtagaggagaatcatctttctaagatatctctccatgactacagtatgggcacagagcaaggacaatcctgtctcctacatggtcaccattcctttatttattcattcagtagagattttcgtgcacagaggcagctactgtgatagcacaagtattacagaattcaaaagagaaagagatgatttccagctcggcaatcagggaagtctttaagaagtaggtggcattcaactaaagaatacactcttcggttctgtgtggcttgatgagtatacaccattataatcgcagactttggcagaacgggagggttgaaataagataaaagaaaggagaagagcagtggcaaaggcagaatgactggtaacattaattgaagaattctttatttgtattcaccagtgtgggcctctttcctatttagccatcacttgaatgcacgttgtcattagcttgctttactcatcctatgaatcaagccttggagatgttgagaacccagtttctgtgtgtggcagaaaagtaaagagatgaatagaagtaatgacatagaatagcatcctcttgctttttccactattaattctattctgccagcagatatttagcagcttttttgtgttaagtcctatgtggatacaaatttaagaaatgacacattttctttctcaaggggatcacaggtcaataggaacacagggatctgtcaaagatcatgataaatgtaataaataagagaacataaatgtggacatagtaaaatggtagaccagaaaaggcaaaagataattattgatgatggtcaaggaagaatacttcgcaaaagtggtatttttagtctcaagacattgagcaaagacattttttttgctctggtcatcccataaaatgactctcaataatgaatagaacaagaaacaaaaaactaaatttcattttcaatgaaacataggagaaaaaagtcacactaaagtgctttcaaaggaggacaactggaagaagcaagtgaattactgtgcagactcccctagaaggctcagaagctgggcatcttaggaggcagtggtagaaatgcttaaacctaaaatagagggctcatctgaaagtctgtcacttagaccttctttttctctcaacctacgggaggttggaaaatatttgtaggtaaattgagctgcaggagcagcacaatttcagttttaagaccaaaaaaatagcagaaagctgggagtttatatgatccttctgtgtataaggtgaaagacacataaatataaataaatgtaacatatgcacataggctcttaaatacccatgtttagaaattccccagtaaaaaccagagttagccttgataacctaagaagaaagcccacaagtcaacaagccacaatgatgagcacagataaatgaatgtattgctagggttatcacatttgaggagtcctcagtaaaagaaggtaagaccccaactaagtaattactggcattatgaagaaagattaagaacagttccaaaacatcaccattttcttcatagagattttaaagcctttttcaatcataaaagggaagcttaaacaataaacaaaagggccgggtacggtggctcatgcctgtaatcccagcactttgggaggccaaggcaagcggatcacaaggtcaggaatttgagaccagcctggccaatatggtgaaatcccgtgtctactaaaaatccaaaaaaaaattagccgggcatgaaggtgcatgcctgtaatcccaactactcaggaggctgaggcaggagaattgcttgaacccgggaggcagaggttacagtgagctgagatagtgccactgcactcccacatgggcaacagggtgatactctgtctcaaaataaataaataaataaacaaacaaaagaacaccaacagagaataagaaagaatttgaggacgtttcagttatgatagccagactcacaacaaacaaaaaaggcaacaaaacaacacttattacaagaattgtaagataaaattgaataaattatccagaaaggagactggaaataaaaataagttgatgatagtagcagtaacgtcagaatgctaaagaatttttaatcctaaataaaatgatccatatcttggaaccatagtgatacagaggacaccttcagcaaatatgagagtaaaataaaaatcctttttgtattccaaaattatgtaaaatttattccctgtaatcagaaatctgaagacatgctccaaaaatcaggaatacacaaaggaagctaaagacaaggagtgtaaaacaggagagtcaacaaggagaaggattaagggaagtccattaataatagcagtttagcaggcctggagaaaaacaaatgtgtattgtagtagtgtaggaaagggcttcaaagaaataactctagcaaaatcgaaggaatgagtggattatctgacaggaactatcatgaggaaaattgtatcaagacgattttatagagtacttgaatagcaaaaacaaacaaacaaacaaaacctcttctgtagatgccaaaacaataaaagcaatgaaacttacaaataaattattaactcttaaataaaaaagcaaaagttgtttacaatgaaaatgtgatcatactatttgaatcttcagtggacaacatttgtataggcttaagcatgaaagtactgaatatggaatatggatggaaagaaaacctgatatagaattatattggaaaactgagtggagaatagagatacaagagggtcgtattgttacctgttaaaattggatgccaatggagaatgccaagtcatcaaatcttttttttttttttttttttttttgagacagggtcttgctctgtcgcccaggctggagtgcagtggcataatctcagctcactgcaacctctgcttcccaggttcaagcgattctcataactcagtctcccgagtagctgggattacaggcgcctgccaccacgcatggctaatttttgtatttttagtagagacaaggtttcgccatgttggctgggctggtcttgaactcctgacctcaagtgatccacctccctcagtctcgcaaatttccctctgtggcttcacaggcatgagccacagcacccagccggggaatgccaagtcatgaatcaaagtatcaccgtgtcatagacattatttagagatatggaggtaaatgccagggagaataactggaaaatagagtggatgcttacagggaatggcctagggaagagatttatattgcctttgttgttctcaggtttatttggcttcttaaacacacgtgtgcattacttttatataaatataaataattgcttaaaattagaaaaatgaatctctgacaaagatttggagtaccatttggtgtttaccaggtggaccaaggacagaagaacatggtagccagagaggtaagaaaggttaaaaacaaaaatcagaaacagtaagtcctgttcagggaactgcaggtggtttgatatggctgaataattaggaggcagaaaagcaatgtgttatagtggttatgggttcaggctctggaccctatctttctagttttgtttgatcggtatgtgacttactgtgtgaccttactaagttctttaacatctctaagcttttgtatcaatttctatatgtgaaaattgggaactttaatttgtactgcaggaaatgaacctacaacctgttagtatgcatttaagttcacctgcagatactactggagagttccaagcttctctccttcaagttcctgcattgctccctgcatctttgaggttccccagaacttgctaaccaatgcatagggcaaaccagaaatgctgactggaagtagcaacaagtgatttaatgttcccagaggtattcctgaactgatgaagtaaaagagtaggttgataaatataccaggttctccatccctttatacagcaattctaaagtgtatattatatagaacctcagtgggtctacagagaaactgagcttcagttctttgcagtgtgattcacaccattctgcacattttactgaattttctcccttccctgtctcactttctccacactctgatttgtgcttctggtaatcacttcccaaataagcccttgcctcaaggcccgctgttgaagaaaggcaatctaaacaaatacctatgccatgttttcaagaggattaaattatatgctccgtacttagtaaggctaaatatgtaactctgctgcggtggttgttaaatgccagcatacgaggaaagttcatttatgcctgtattatcagttaagttattatcctaaaggtgaagagaagcctttcacaaaatgagttcaatccacaggactcggtgactcactgaacacgtgtggtgaggagcggggctagggaaagatagtgctctgaatgactcacagctttctaacctgtatatgacctgtacggaatagtaatgctcacaagcaagaagcataatagaacaattacagttttatttctaaacaaagcctaaagtcctggtttcataaatgaagaaaataatgctgtctaggtaaacaatttggccaagattcacaattcactgatccaaagtcctaagtcccccaataatgtcctttttctgtaagttttttcaactatcattcatctttattattcttgtctcttgaggtcatgattggtgcacaggtggtcaatataggtaacataattgctgaaagaattaataaagatttatttcctaaatcgatccaattcatgttgttttcttctattcaagtactggtcacttggtctttcatatagtcatgtctctctaattcataatttaatggaaattattttggcaactccagcagacatctgagagataagcatagcttttgtattgttagtgttttctgccagactgaagaccttggtgttaataagatggctgctttccaatacctcttaaaaaaaaaaaaaacaaacaaaacaaaacaaaaaaacaccattttcctctctcctttttcttttatttacaaatgtaatctctgatccatgaattcataaggtgagaacggtgagtggctagctttttatgggaccatacataaagggctaaattcagtgatccatctcccatctttctaactacttagggaaggaatttgaaaagaagtcaatgtggcagatttgaaggagaggctgttggaaagtgtgccacaggcttttttacattctgtcttcgagacaatttgagtctgcattttttaagtgaaactattagtaacgtagtgatttcaggttttttttttttaagttggtagatgtaggtcataataggactataattttatttatttattgatggtctgattttaagcccttagaatattaatgtctaggaacatttgagaaagaataacagaaaaatcgtgtgtgtgtgtgtgtgtgtgtgtgtgtgtggagaatgtctctttggcccagataaactcttcgagctttgacatcttaaaaactctatgattaccatatttttatacatagtcagatacatataggttcatagtcctgagaactggttaaactgagttgtcttattgccagggtctgaggaaatttgaaagagagcatcatagaagacagtgtgttgaacactgttaggctagtaacaaaagaatgagagccacaagactaaaagagaattccacttgtgcgtaaacagaacttcagttactagataagcatggctttttcctcatttttctaccctttcctttattcactttccatcaccccccttagttccctccaaaatatgaaattgtcattgactttattaagatataactcacatataacaaaatgcacacattttatgggtccagttaaatgaatttgaaaaacgtgtatgcccatataaatccctgttcctccctatcaaaatacagaatacttatatcacccaagaaagtactttcacacttttttgaagtcaatcctaccacatttcttgcctacaatgactgatctgattttgatcaccacaaattagtgtttttctgattctagaacgttatataaatggaagcatgtagtacggtgctttatgttggacatttagttcagcacattgtcagtttcatccatgtatttacacaaatcactacctttttcctttttattgctgagtagtattccatatgccacaatttgtttatccattcacctattgatggatgtttggtttttttcaagtttgggcttattatgaatcaaattcctattaacatttaagagcaattctttgggtagatacatgttttcatttgtcttacattctactttagagaggaattgatgggttatatgtgatgtttatcttagtaaatgtttttgaaagtggttgtgtcattttacattcctgccagcaatatacgaaaggtttagctgttctacctcgtcatcagtgtttggcatggtcagtctttttagttttagtcattattctgggtatgaagtgctatatctcattgtagctttaatttgcatttccctaatgacttatctttttatgtacctattgactctacatattttactttgtaaagtgtttatgaaaatattttgcctatttgcttctttttaatattattgttttatatattttagacacaaccttctatcagatatatgtattttgaatattttctctcagcctctgaagagcaggtagtcttaatttttataaagtcaaatttatctatatttttatggttggtcatttttgagtcctaagaaatctttgcttatcccaaggtcacaaatattttctcctatgtttccttccagaattgtatagttttagtttttatgtttactctgtgatctatttaaaattgatttttgtggatagtgtagagtttcatacagatatcttgtttttctgatgtcattttttggaaagatcatattcctggctaaattactttctttattacaaacttggaaaagcctttttaaagcctcttagcttttatctaatggtagagtacataaagtcttctaaagtttgtttggagattagcattattcctttgaatattttctacatttctgattttatttaaaatatgaacatagtagataggacacatactacataatgatcattgtttaataatatagaaagtaaattaatatagccaagtcactgagttgggaagaaagtgtgtgcagttactggcctctttattttctatgtaactccctttcctttttctgtgtcttcatatgtatgtaaatatttcttgagaggtatgtagtactgagctactctattggaacacagagttaaacaaattgacaggatcattattgataggagcttcagggaaaacattgttagaactaatcattacaagttttttgaaattgaatctcttatttataaaaaagcacagaaacatcagtattccatagctcctttataaggtctttgtgttatgaagctcatgttgcaagatggatattgagtagtttgccatattaattttgatttgtatttatttgtaaatatgatttcatcacattaaaacaagagctacaataacagaactttaagtaagagttaaaaatattcaccaccaatctatttctcctaccttactgatttcacttgcctgtattcttttgctaatctttgtatatagtcagaatgtttatataaggataaccatactacagaaatggtttgcctttctgattttttttgaaacatataagattacaaatatttttcatgttgctacacagccttcatatttatccattttaatgactacgaagtagtctagtaagtgatggatagtaagaccatcatttacctattttattactattgttgagtttaggtaggccacacatttttgcttagagctgactccaaacatgagaaaacacatgtgtattgccttttccttctttgtataatttatatttagaatatcagcataattaagtgcttgagaataaagaagctagatttttgtattgaaatcccacctttgccattttccagctatttcactttgggcaggtgttctgatctctctagacctcagttttcttatttgtaaaatagggataataacagtgcctgcctcatatatttttcatgaagattaaatgaattatttttttgcaaatcaattacagcagtaaaatgaatgtaaaaactatataaatgtcttcttaaagttctggttaatggaactagtatattaatttaatttatattgtccctgaatgtatgtgcatatccagatataccacagtatgaccccaaccttgcaggaaatatacatttacaagaaaaaagaaagagagagagaggaaaagaggaagagagaaataaataaaggaaaaaaaggaaagaaagaagggagggcgagagagagggaaggagggaaggaggaaggaaggaaggaagggaggaatgaaggaggaaagaaggggttctcaaccagcggtgatttaaaaacacagtttattgaagtataattcccatgacataaaagtaaccgttgtaaagtggacaattcggttgcatttaatacaggcacgatgttgcacaaccaccactatcctcttggaaaacatttgcatcaatccaaagaaagaagctcttaccaattagtaaatttctccccattttctccctttcactttccaggccgcaacaactaccaatctgtcctctgcctatgtagatttatcagttctggatattttgtataaatggattcatgcaatatatgacctttgtgtccagcttctttcacttagtataatattttcaaggtttatctacgtttcggcgtgtgtcagaacctcattgctctttatggctgaataatattccattttatgtacatatcacaatttgtttgttagttgagcatttgggctgtttccaccatttggctattttgaatgtgctactataagcatgtgtgtacaggtacttgtttgagtgccagttttcagttatttagggtatatacctgggactgaaatgatagggttacaaggtggttctatgtggagttttttggaaaccacaaaacgtttccagtaccacactgttttgattatcatacattcatatttagctttaaaactgggaagtataagtccttcaagtttgttctttttccaagttattttggctattcaggcccttgcaattacatagaaatttgaaaatcagcttttccataaccgttttctaaaaaagccattggaattttaacagggattgccttgaatctgcaatcacatgagtagttaacactgacatcttaaccacattaagcctcctaatccatgaacataagatatctttctatttattagatcttctttaattaatgtcagcaatattttctagttctcagtgtacaagtctttcactttctctgttacatttattcatgggtattttatccttcagaatgctattatacgttgatgtttttttcttaatgtgcttttcagataattgctggcatataggaacataactaatttttgtccttattttttatttgttttttaatttagtttataaaactaatttttatattttgatcttctacctacaactttgctgaatttgtcctttagtagctttttggaagactgagatttttatatgtaagattatgcaatctgcaaatggacatggttttgttatttattttcttcccaatttagataccttttattcagttttcttgcctacttgctctggttagaacttccagtacagtgttgaacagcaatggtgaaggagactattcaagtcttgttcccgatcagagtgggacagatgtcagtcttttaccattgagtatgatgttagttgcaggtttccctccaatgtcctttattttgagaaagtttctttgtagtcctagttttctgaatgtttttatcatgaaagtgttttggactgtgttaaatgattttctgtgcattaattgatatgatcatatgaggttttctctccccttcattctattaagatggggtattcctctgattgtttccttatgttgaaccacccctacattcctgggacaaatcccgattggccataatgtataattcttttaatattctgttggactagaggtgattttggctcccagtttatattagcaatgtcaagatatttttgattgtcataactggaggagggtgctactggcatctggtgcatgaagacaaggatgctcctggatgttctacaacagagaggaaagcgttcctttgtctcacaacaaaggattagccaggccaacgcgccaacaccacccagattgagaaaccctgaattataccaaccctgctactattcttggtataccccacccttatctctctagcctgtcattctgtcttttcccctccatctcctccaaacacataactttgtgtttcagtactccaaccacactgaacctcacttaatttcttctcttagtcaagttacctttggcctattatcttccacacctgtactttttctaatccgaacatcctgtcccataagaatgatataatcgagtttggggactcagggttgggggagattgggagggacctgagagataaaagaacacatattgggtatagtgtacactggtctagtgataggtgctctaaaatctcagacatccctgctaaagaacttatacatgtaacaaaaaaccacctgtatcctaaacattattgaaattttttttaagagaaagaacatcccttccgcttcttcactccccaacatcatcacctggttttacttattatgattcaattttcggccacttcctccatgaagattttctgactttccttagaccaaatgagttacttgtgctgcatttttcccaaacaccagcattgcccatgccatagcacttatcagagtttattaaaatcacgtgttaatttctacaaggtctgggagggtcgtattattgctcctatttgctcactattgtatcttcaagacccagatcagtgccagtcacaaagtagtcattttgttattcttgtttttaagttatagaatgaatacaagaataaatgaataaatcagcctaaatttttctgtatctggaacattcaggaaatgtgatagttaagaaatatgttaatgttttatgtgtgtacacctcagatatgcctgagaaacagaaataaccaatggaaatatttttattttagttatctaaatctttacttatctgtcttggccctaattgactaaaactatatctgattttttaaaaattctcaaatgtttgattcagtatctgtgcagactgagacacagacccaaagctttacagtgtgaatttttaaaactaaatcttgaataaattatcagatacataagcaaaatttggaagggaaatttgggacaaaagaaagcagttcattttagccttttacatcaatgggcttggaacatgacttccaaggaattgctggtgttccctggcagtgcccaatttctgaagaaagaagcaaaatgtaatctgcacacagtcaaatgccagaggcaatgtgagtattatgcaggttcaaaccaggtcagaataaaaatgactactaaccagccattcagcttgtaaaatgatagaagaactagttcttgcttattgcccttaacaaatattaaaaaataagtcagagtgtcagctactagatgcaccaagttttagtgctgctttatgggctagaagtgtttcaagtaagagttggctgtgatgtgaatttctgtaaattaaagcttagctttccacttaatctaatcaaagtaccggtaatatattctaatgatgatatgacaaccacagacatattgagatagtatcattttaggagaaaagatttgagacaaaagccaactccatgttatgatggtgaactagataatgttctgcttttcgggcactgtagttttcagtttgcttttagtttcagtttggctttagtttggatttatatttcacaggatttttcaaattgtattctctctttccaccgttaactataccccaaaacacgctagaatcgtaggaattctcctaggcctaagaatcttctcaagcaatattatttaccccagagtatttttgtctttcccatatgattgtctaaatatttaaatcaatgactgattttgagaaagttgctggttttattagcttattttccttgaaggctttctaagcctccattcctcactggaaaatggaaaggtataccgaaagttgaatcagtatgtgattttcaaaaacatgtatatacatgtattcaaatgtgtcctaattataaatgtttattaaaataaatatgattctactggttaagataaaccagattctctaatttccctcctttgtcttgccatgtagaatggtgagagtccatttggctcagagaatgttcagtttgaccttttccagtcagtttatctaaagcagcagcaatgatttccaatctcattataccccaggtcactgtcttattatcacatttattcccctcttcatacttatcacaatctttgttaattgtaactctgcctattttcctactgtctgtcaccaccatctttagaataagagctccatcatggcagtgagcatgtttgccttgttcaattttgtatcactgacatgaagagctcttagcacactcatcaatcaatatttgttaaatgagcttttcttggctgcagacaccacattttattgactggaaacaatgtcttgagccaagcctgaagagaagagaaagtcataatctttacattcagagttacttcctgtgtcccttcaacgtgattcttccaacatcaccaaggaacttcctacatgattgaagaaaagatagaaagaaagtcatctggagagttaacacatttcccattggtgctgaatattatctcctaatattctgaagatgtcatcaccaggtcaatggaatctcaatatcctaagttatatatagacatctgcatacatatgtacattatatacaaatacaatattatttaatacaaattatataaaagtatacaaattatataaaagtaaatttagtttttatatattttatatgtgctatatataatttatacatgcttctgtaaaagtgtttactatttcatttacgagcaaaatagaaaagttgaaaatgcctgtttttccctactaagggatgtggaaatagggttgcttcaaagacacattctagcacagtttaataataattactcaatcaccacagacaggaaaaagttaatttatttggaaactcaactttatataaatgttactagtatataccaatgacagtattacataatggacaaaaggataaatatttaataagtttgatacttcaggtacagtaagtaaaaatccatttttaattacataaattctttaagtttaaagttacctagtcaaatttatctgtactgatagctgctgtcagaattacatgtaaacgcatagacctctctaagtgattatgttgtattcttctataacaatgagattcagtaaaagccgtaaatgataacactagccaataatttgattcaaccaacacaaccagaagaagcctgtgaagtcaataaaccagttccatgtcttatatacaaaaataataggttgattgaatttttactttctgaatctgttactttgatacttattctagacattaaatatattttgttgattgaatttttgcacactgagaaaatacaatctaaatatagctggagggtcttttctatttttttccaaatttttcaggcctttcattcggccaaagcaacaattgatgtggtattttctaatatctgatacagcttttcaattttgtgtgtgtgtatatatacatgaaacacagattgttcaaggggaacagaagcctatgagatatagaaaccaaaggatatgccttttaaattgagtgagcacagtctttagggcctacagtttcaaagttttgtattagggaatggctgaccacagaaatttttctaaattaagtgcataccaactagaattacacaattggcttccgttttgctacttgaagctcccaccttgagctggtttcactcacttattgttgaattatagagacagttgtaactaaatttgactcttttacctcatccttttgaaattgtgatctttcttccatctccaaatataattttgcagaccatgaccttcaacattacttctgcatcataaatgtgattttggcatcttgttgcagaatgcctactctgaggccttaattctcacatctgatgataccctgaggatgacatgtgaggccaagagggagtgaagcctcatccccactttgtgcttctttattaaccaggtaacagttatagtgttctttgtcatctggtcaacatcactaatttatcctgtgcacaattggaggatcacctagtccaactgcctccccactccacaatttgtcaaagagctaacactcaatgaagcaaagtacattccaaaaatcacacagaaaattaggcatggtacctgcaccaacacttaagtatataaatcaacgattatctagagaagcctggagtgatgggatcattgagtttagaaactaagaacatagctgtgctggttttagagaaataaagtcactattcacctattctattttccttttccttttgagtgccaacatcctcctgcagatgcatatatttatttacagagcaacatgcttgtgttagctgtttgtttctaaagtttttaaaaaaatgacattagaacttccaattttctctttagcaacccaaacacatttaaattataaattgaaatatattgcacttttaatagttcaagctttctgagtactattcagttccataaaaccattttggataggtaacttttttatttcttatcttctctaatcttcacttcaatattggaacaactagatatatgccttcttttgtttgcataatttttctttttagtgtttatgtaaatacatagaaggtaaaaattagtgaactatattcaaggaagggtgttagaatactaatgtagctaatgctgtgcttgggaactacttagggagaaatagattggtttaaaaaggaagttatagaatttaatcaatcttgagagaccagcagcatgctattgtggaactataactttagagaacatctatatgacagtatgatcaccaaaaacttcagcatatgctgccaagataatgtgcatattttaagtgcaagttagagggctccaccttccctttttgcctgtggtctcctgattatagcactcaaagtattgcatctgggtaatcctccattcccaggcgacttgagaaatttgatcccgttggtgtgaccaaaatttccaagtgaaatacagaaattgtaccgtcttcatgcatataggcacaggctggggaaaggtttgggatgacttttggctttgccctttcctgttttgtgacctacagtaaattacccaactttctgcacagtcactttgcattttttcgtaaaatgtgaataataatgcctttctcacacttattttggagattaaacataaatatgaatgtgcaatgaattctaatatgcaaagtgctatatttattaaatataagatgttttctgtaactccagcaagtttccagtgtcaatgttggtatatccaacacttcctacatgacatctgctggaggcacatgtctataactgaaagttaaatgtatgtgacttctacatgaatttaagtatgaatttctatatatttatcaatagttattgatttcacgtctcaagtcatgcttttgaaaactatttacatcaagactctattcatttgtataaaatagtttgttttttaaaaacagtttttcaagacttttataaaataatatccttttgaatagatacatacatatacaggtaaatctagatatatttttaatgttgagtttaagaagtagtttaaaaagcaaatctttaatttttagtgtgatttatctattaaaagtcctgtcttctctatattctctctacttaatgaaaaagccgattgcaaaacaagaagattgattaggggtaataagcttggtattctagtaataaaaatccttgccaaagtccaatctttacacaggacattgactttatttcaaggccaatttctaaccctatatctaaaacatggcaggggtttaatcattgtagcagatgctgtctatgcccttagtgaatctcctaccctcactcccttcacccctaggatttgccactgtaaccctgaaagataacacggtgaaaacctaactaagtatccctgactgaaggctattttctggcctaggaagcgtgctttcctccaagcaagaaaaagcagaagtgcctgagagttaatgctccccagagcaactctcaagcaattatagatggggaattgataaataaatacccatctttctagccccgttgttgagttcctgagcattgttctgcaccaccttccagtggtccccagaggaactgagatccagttgatgacactggcaaatggcttgataacaaaccttcactggcttcattctctttctgagtaacccactatcctagcaatgtttcttgggatcccaactaaacttgcattcaaatccttgattcagaatctattttgggggggatctcaaatgaagacaacaatgtttgatcagtacatcaattgacatgtatgaaaaaatgtgcacatatgcagacaagaaagcttctgcctgtctgtgtcaaaataggaatgatttgtctttctttaacctggtttatagcaactattagaaatggaattcaactaagtgttgcaagaagtccatcatttataaattaagatggaacttacttactgtactttgtctccagagattctttgagtgtaaataacatagacaaaatcatggaatattaagaatggcaaaggaactgagaactctttctcacagctatcaggttgttccagcgaaataacaggcagaccctggagatgttccataaagctggctgctgctaaggtctgctctgatacctgctatgtgataaaagttcctgacacttagcaggagttgatgtcctggtattccacctgcaaatggtaggtctgcagggcacaccaagcacgatgatattcatcctggaaatgtagtgctgagctcagaagtaagtagggtgttaattatccatgactagtcacataaaatcatgtcttatactcagttctggcctggaatgcagggtacacaaagggaggtactcattgataccagcaggagctatatgcaagcttccaaaggaacaattagtccttcagtgcctcattcaaaggctgcttagggggttgctctccttgaccttgagttaatgggagtatgagtgttcaatgaatggagattagccccagaagacagggaagcaaattaaacccctattttgatttgaattgggagtgaataaagtgttcactgctcactaaactcaagtgaagttaacatgcaggaatgaatggagactaacttctctgtgtggcaaggaagacctcaaggcagttagcacctgggaacctccagggatagagctgagacagaggtggtcattcatcattctctggggtgataagagtttttcagtaaatgctgtatcaatgtagataaatcttcctagaaccaataaaaatgccctttgccttttctatcttctgttacaagtaattgctattcaccttgttatgaatatcttgaaagtagtcacagagtacttggagtgcctgcgggatggaaagtttgaaggaaaaatgtagccgtatatcattggcattcatgagaaaattcagattagatgtttgaaaggcaggtccccaggaggcaatagagaaatcaggaacaatattgtgccaaaaataccactctggccaggacatcagggagtttatgtcaggtagagtgaaggaaagcaatttggaaagaaaagatatatgtgcttttctatatgcatttagtttatttatatgcgtacatcctctgaaaaactagtatgttctgggaatcgacaagcagattgggcctgacacttctaaaatatgtaactgtgtttatgtttcttttactctaaaaactctgaataacatcttgtaatatgatcaatactttttcaaactcatgtcttttaaaaatctgtttgcaaccaataagccaaaaatgggatgtgctcaaatatcattttacatttgggaggtcaagtttatgccattggactttacgtgcagattacaaaatattttttctttctaaagacacacctactctggtgtcctaaaaatcagttatctcattgatgacacaccagagatatatgttttttaaaatgtgggctgggtatggtggttgaagcctgtgatcccagctctttgagaagctgaggcaggaggatcatttgagacaaggagtttgagaatagcctgggcaacatagaaagaccctgtttggggcaggaggatcatttgaacccaggggttcaaggttgcagtgagctgtgatcccactactgcattccagcctggataacagagggaaactctgtctaaaaaataaataaataaataaataaataaataaataacgtgaagatgttgtggatgatatcatccttgctgggggtcactttactgcacaaagaatttcacttctttccctcttctagagtgtttgaataacagtcacttgacgacagttagttcagcttaagcctacttacttttcttcattccctttatttaaaaaagtcttatgtgtctgctttcaaggagactctcctgaattctatcaagataacaagaagaacaataactcaaaattattattgcttctgagaggctttttctataatatacctgaaatacatttaaggcactcataagtagcaaccaatcacccactcattcattgaataaatataagttagtgcatcatgtatacaaggacacatacacaagatcctgaaaaatacaccaagcaatatgccgaaaaaggagacgtgccgcaaatattttgtttattcattaaagataaattgattagaagttgaaaggaaagtggaagtacttttaaatgaaggtttaatgaaaatttcgtagaataaggtcatcgaatcttgacaatgataaaaattagagaattccaaggagatggaccaacataaacaaagataagacattcttcaaataacttgatcttttcaatttggttgttttgtacttacttttgtagtaataataataataatagcagctagtatgtattgagagtgcagactgcctataaaatattgttctaagcaggttatatgagtaaacttatcctcaccttaaatgtggaaagtagctaccattattagccccattttactgatgaggaaactaaggcacagaagagttaagtaactcacacaaatccttcacctagtgagagccacaggtcagatttaaacactggcagcctggctgtatagcatggactcagctgtgactgccccctcttgaggcgctcatggagccagtcagtgactttattttcttttccattttcctacagacatgggtagactgacaaagtcaatgctgtcttggatatgtgagctcagggccatgcaagataaactcctagattaggttggtagctatgctctagaattaggacttctgattacatcatgcagggaaaaaggattactgttagggaaacatgtgttctcatattcttctttccttcctcggatcctctaagtctaatcagtagccatcaagactgaagcaaaggcagtatctggagcaacagcctgctgtggatctcactacagcccttcccttcctggatgttttctcaaaagtaccttcacaatcaatcggcctcctgtgctgtaagccagttaatcttttttttcagactaattccaaatacatatatccaggtagctaacaataatactgtgcttcctgtaaataatatggaaagaccactcactgtgaagtcaaaagatctgggtacaaggccccgatcgaccatataacgtctatgtgcttttgatccgttacttgaagtagtgttatattacttggaagtcggcctcctccttttggccacagcatctcgacttttatacttgtcgttactgagttgcctgctctcccatctcaatttggaaatctgagaccagagttgttgctccatttactcaactaatgttgctggtgatagatagtagggctgtcacggagtcctttggattcctggcccagtgttctttccactgagctagtctcctacagtgtgctctgtggaacctaagcccttggggaagctctgcagaaggtactttttcttccctctaaatgtgattttagcatcctgacataatcccctccacactgctagtagcccgtgatactcttgcctagacctggatacaaattaagatcacagttttgtcccaagtcacctacattcagagggtccaaaatgtaaaatgatgcttttaaaagaatatgaagaatttatcctctgtggttacaggaaagttagctaatctccctgaacctgagttttgttttttttgttttttgttttgttttgttttgttttgttttccgggtagtttaaaaaatcaaatgagacaatttatttaagaaagcatctttcacattataaatcagtttacaaaagcagggtactatttatataaacatgaattccagatattggaaggtggcaatgtctgctgttagtaagaatgcaggaagcacacaagcagtgtggaaaaatcttagataatattttagtcccctgcccttggagaaatgtatcatgaggtcagtgggtgaatttctttgcctgcaaattgtatctcctttggatacaatttgcaaagggctgaggaatgaggttggacccccatgccccatagcacaaagtatttctgctcagcagtcatgtattttgcaaaaataacccacccacaacgaagtattgcctgatttaaggttctgcaatttctaaaagccagggcacttaagatactgagatgaaataacattccctgttcccaaatgaataatgcattttctcactcttttttatttttattatttcaaaattcttgcctctcttttgcagagaaatttcccagagttttacagcatcactgttgacaggcaaccacattttcctcccaaggcgactcctatttctgtgaggtcaagattgacaatgggagcacatatcaggggatgggttgatggaagagaaggcaaaaggtccaattgtccaggggctgggtggggaccgtgaaccttagccaacagaaacagaatggaatcagtgtacatcctgctgtcagtgctctgtgattattttcccctttccttctcctaatggataagcttggaagaaagtgcattctttctcaggagagagctcagaactgcagggttttactgtatttattgtgctacatatacatatacacacacacatacataaatacactgtatatacactacatatatatattagtttcaataattctttcctaggtaggtcagaaaattcacattgctatgcattattaaaaagaagttatgaggccaggtgcagtggctcacgcctgtaatcccagcattttgggaggccgcaggcgagtggatcacctgaggtcagtagttcaagacctgcctgaccaacacagtgaaacgagtctctactaaaaatacaaaaattagctgggcacggtggtgagcgcctgtaatcccagctactcgggaggctaaggcaggaaaatcacttgaacctgggaggcggaggttgccgtgagccgagattgcgccactgcactccagcctgggtgacagaaccaaactctgtctcaaaatagaagaagttatgccatcgtgtgtggttagagagtcactgattggcatgaaagcaattaaaacccacccaattttcctgaccacttttataagacagagaaaatttaataagttaatcccttatggatatcttgggctctttgaaatttagagagctctattacatcctttattaattgaccctaaaaaaattaggagcagtctgtgtggtaggtagtatggtcacaagatttacagtgggcaacccaagaacagagattctaagacttactcaaactacattgttagctattgacacgattaggactctaagacctctgttattcttgtccatggctctttccccttgattagactttcccaaagtgtgttctgtgaagcgttcactgttggaaaagcactacagaaaaccgaatcccatgatcatggaagtttgggaaacagtgcaggctatacccctgtcttcaagttctgtaatgtacactggccctggagagatacagaaatcctgcaggaaaggaactgttttgccttatttagccttgcattttgcatattatttagctgcatggtgctttttttaagccccataaacacactgtaggaagccttaccctgtgccatctagctttataacaactcagggtgggagtcctcaatttgcacctctaataagtagaaatgtttctctttcaaatgttcagatttgagcaaaatctcccagagtaagctttcggcaaaattgtaaagtctgtaagattggccatcgggatgaaaaacatggactcaggattctgatgatactggtcaaatgagggatttttctgccacttatcatctgtgtgcactttgtccagttacttagttcctcccagtttcagtctcttcacctgtaaaatgaaagcaataattgtatacctcttatttgactgccgtgaagatgaaatgaggcagtgcatgtaactcctggcatagaatctcgcttctgttgggtatttgaaaaattctattattactattattctcattatcttccttttcagcctacctcctggcaccccattctgtctcttcctcctcctatttttctatcttgtcacacaatcttaaaggactctgcttccagctatcttgcttacctggtatagtgtagagatggtatacacgatgccttccaagactgggcaggtaatatgaaagagtgaagggaactaggtgtgagacaatagggggtgtcccccaaactatggcaaacacttgtgttaaagggccagtcactccggatatttgttgttgttaatgcctttttgttgtacttttaccgcatggaaatatggactagtgatgccaaattttcagataattaatgagaagtcaaatgtttatttttatatgtaattttccaatttttaaacactctttttaagaatctgttagactaccagttgatgacccctggatcaggggatttttagcatcctgttcctatatagtaataaagagctgcaaatttagaagtgtttaagaggtcatctagttgaacttcctacttgatcagaaatattatttataatatactagaaaaggtgtcatttatctattcctagtcagagagaactaagcatctcatggaaaaaaacattacactttgtatgtacaaactcactgaattctcttatgaacctcatgaggtagatgctactttttccattgtaattatcatgtcatccaggctcagaaaactaatttacttcttctaaagtcacaaagctattaagtgtctggtagattttaagaatggaattccagactgtttaggtttcaaagccagtgcacttaaccactggctaaacaattctacttgttaaaatgctcagggctgatattaagctgaaatttgctgccctgaaatgtccactatttggtcccagttttgctctcctgagacacaaataataagtttaatctttcttccacaagacagcccttcaaatatttgaagatgactctcctctgcctgctaaatcctctcttccccaggctaaacatactcatttcttttcactgaccctcataagtcatggctttcagccacttcatcatccttgcactgctccccaggagagtatttcaatttgtcaaagttcctcttaaaccgtgatgctcggaagagaacacaatccctctgtgtagttacacaagtgcaggtcaggatggaactagcacctccctggttttggccaccatgcttttattaatgcaacctaagtcatgccagatttttagcaactatgtaaaaagaaaagcaaacattgaatattggtccaacttcacactatagaattttattctctgctttttttttttccaaacttgaattgaaggaaagccacttttactcactctactcctacccaatatatttaagcaggtcatttttaaaactcaaatacattacttagtatatattcttattaaataccatctttatttatttactgttttggccgatactgatctgttttgttttttctttaatttgacaattatagcaaaacagaagagaaagaaacattttctgtagtgtgaccactttttcttaaatacattaaaaaagggttttttcctctaccactctaatattgctcacagataaatctatttatattttcccaaaaacaaaattttagaaagtgctttgcacacatttctgttttaataggaccttgctatattattgctttgtttagttttttaaaaaatttggaatatatgaagaagcaaaaacactgaaaaaatctgctgcttgccattttacttacatatatgtattatatatctatataattatatgttatatctatttgtatgtatgcatctaccttttcattcttttcattccagatatttccgatttctgctatctgatatactcactatctcttctagctttctgtgattctgaggttaatcaaatattcagtaggattgggctgagaacttaccactagaaacttctctctaggccaacctttagcccaggggtgggaaaactatggccatgaattaattattcttcacctgttttttgcaaataaagtttttattaaaaaaactgccacttccatttgtttatgtcttgagtaagactagttttgcattctaatagtacagtttagtaatggcaacagtgaccaggctggaagtatttgctatctagtcctttatggtcttttacagaaaagatttcccaatctctgctttagtcattagtaagtagtccctgcattctgttattgaattcattgctgagaattgaaactagcataaattcctatccctgtactaaaccgcactgaaagcaaaaataatttagctacttgcttcaggaaattcttgcttctagaggacaaaacttacttttcaagaccaacatcatcatctgtatcaagagcctgaccttcttgtactcatcaaattaaaactattatgccctaatctctacccacatttaatcagctcctcatcttgcaagaacaaccttaaaatcacctaacccaggtcacgaagccctaaaaatattgttttaaaaaaaaacttcagctgaattaaattgaaaggagtttaattgaacaatgaacaattcatcaatcaggcaacccctgattctggggcaaaccccagaatcacagcagatttggagagactccagggatacctcatcatcagaacaaatttgtagaaaataaaagggaagtgacttacagaaatagaaagcgaggtacagaagcagctggattggttacagattggcatttgccttacttgagcacagtttgaacactcagcagcgtatgactggttgaaacatggctgctgggattggccaagactcagctattgtttcaggcacatgttcctaagttagattttcaatcttgtctacctattaagtcaggttactgttggtcctcaaggactcaaatatagaaatatgtatttcttcaggccatttctagtttatattaacaatatcacccacttatttctccttctgagaaagtattacaactatgccaagttgtattctccctgactgtggaaagtctagcaaacttagatttgtccaatgaataagtatttcttgtcacctttttaggaacggaaagtcaacactacaaatcctcaaagctatagcagcgtcactcatccacattcttgtattctgatttatataaatacaaagagcatttctataagatataattacctgcatattgcagatagaaaaacaggtgcacacagaggctggagctatgctttggtgatgtgtgcagtgccccagatcaagaggtcacatagtagggggggaccctcaatcagggatctgccttcaagtcccaggtctcgttctaggtcatggactaaattttatttagttaactatcacctatatatgtaaataatggcaactacttatctcctctaggcctcagtttcctcagctatgaaaatagaaagctgacttctattatctatatagtttctttcaattgtgaaattcactgaaagtatgatttttcagcagtcttaaaactaatttcttcacactagtatctttcagcaagacttcatggcctcaagcaaaaggcatatgagagatactctcttgatgactgagttaagttctacagcttggtttctctgattaaaaaaaaattgtagaaatgattctgactatttccataacaaacatatttgcatttatttcatgctgttaacaacttaacatgtaatcatggctcctctaggaaaagcagtactgcttcttctatgatcacattaaacacgctgtgttacgtctttctactaatctatcatctattatggctgcctattttgagagcttggcataacaattatcataagtgatagcattatattctgaaaacaaagaatttgatggcacaatttatcttgctacttggcctaacttaatggtggtggggtttcctagtctgtactatatttttctcagatcacaaatagttcactttttaatttattattgatttagcttaaaagtaaataactccgtgaatgctaaagttggaaatctgttataaaaattattaaaaatcttctcttccttctggccatggatgtttatcacactgaaatcaaactgtggagctacctgaacaaagtgaatttgagatttttaatttatctggtgtaattaactggtcaactaaaaacaaaagggcaattagtgctgcacacatttgttctgatgatgaacatggcaactgaaaatggatcttgatcttcactatgaaatcctttagtatcaaagcaatgttgctgtaaataaggggagaacgaagcccgtgaggagtcacgcacttgcaacaatgatgtcctgataaactaaatccacaccagtaagacaactagagagagaagttggccaatatttcaaagtaatattcctccttgaccattctactgccctgtacttgaacagcaataaccaaagccttttagtagtagtttctacttttcctgctaccaatgtgagaaaatcatttcatgtactgcaaaagaggtaagaaaaaggtataatttgtaattgacctgaggatttccataaacagtatgtattaatgcacataattctccagcgtccaagtccatgtaacctagatgtatttatagaaattaaaaagcacaatgttgacagaattggacaagaataattttctattttcccccaccatagagtaagatgttttaaattattttagacattctctgtagcttctaagttaggttgggaagtaccaacccttcatgagcacctttcagaagcttattacagagctatgcatgcacatctactctgcctttttattcaagaaattgaccctagttctcactggaaaaaataaagttggaaaactcctctgtaaaagatagataagagaataacagaggtaccatctctgtttaggataactctcattgtctctcaagcctgccggacaaaccaaggtttaacatggcagccaccttccagaattttcctgatgcctgaggtccagccattatttgacttacacatttattcctggtttactggcaattgtgcacatttatagactgacgaatagttttagagccaggagatggagtgagtgacaattttccattcctaaaaaaaaaaaaaaaacatgattattctgaaccaaacaaagaaactcttaatgttgtttgggttaagcataattagcactgtgtataacctcactgtcacagcaataattgctgagttctttcatctgccttctgggatcagaagcaagtcagtgatacatggtgagaagaggtcgtataaaggcagggctcacagtctgcagctacttcaaaatacaggactgcatctttttctactacatagatggtattcttgttgagtacgtatacactgaattagaaaaatacagttggataatcctttaacagaaatcttcacagccaaatatattttagagtttagaattcattaaacgagagatcagcaaaagaaaattccagaagctcgaaagccagaaagggtcagataataaatattttcagctttgcaagccatatggtctctggagcaactattcagccctgcctttgtagcactaaaacagccatagacaatacatcaataaacaggcatgttgggttgcagtgaaattttatttaccaaaaaaaggcaaagagccagatttggtcagcaggctatggtttcctgacccttgttttagcctttagaaaggcaatggggtacgaattcgtatgtatttctatatatttataaatttgtgtgtacaaatttatatgtatttttatttgcatgcatatacatattatagacagatatgtacattaaagatacatataaatttgtgtgtgtgtgtgtatatatatatatatatatatatatatatatatatgtatatgcccaatgaacaatacacttatcatcaaccaacatctctgtttcagcagaaaaatacatcaatatttataataagctgggtaaaaagatctaagcaaccacacattgcttggtgtgtattgcctggggacagttctctgccaccaaataaattttgctaccaagctttcatgtaattttcaactttcagagattctttttaattgcaagaaaagtgattatagacctgtacatactctttccttgaagtgtttgaaattattacttttgtactgagcaatttcatgcaagaaaaagtaaatacacgttagtttatgaaccaagatactcactgctctgggccaaattatcatttaaaagacctcatctaaaacaaaatgctggtgatacatttttgagactctttttaggttctagaagtttctttaagttagatttatatactggttttcctttattacaccattttgcctcaagtgacctgtaggattctaggaacctagaattaattcctgtggctattttgcatgtcagtgactagcagaaattttactcactgaatatttctactcgattctgctgtgagtaaataactacacttttcttaactacattgttgtcattgagccagagtattctccttcctcaggcaatttaaactttcacaaatgaaacttttacaaatggcaacccatgcataaatattagctatttaggctagcagtatagaggaatgccaaataaaacatctttcgggctttggcctcattatagtatgctgataagcaatcagatgataaagggcaacatttgctatgaaattatacactggatggaatcaaaccatcttagaatattagagctggaagaaacttgaaggtgacttctaggtcaaacccttcaattttcaaaggaggaaactgacaatcaatgtgattgtacatgaatcactcaatgttactcagctggttaagagaaagagacaatagtagaagcaaaatctctagattcccaatgtagcctttttctctgtaccaccaggttgttcagctgtcaaatgcaaacctagctcatgcttgctgaatagctatgagctctgcattagacaccacgccgagtattacgagtaagtgttacacatggtgtttatcgtcaaggtaaaatgcaaaacccttggcttttggagtctttggtaagtgcaagccttaagagaaatacattgagtcagtgtgctctagaatctttaagagaaacttcatataaatttgagataaacgatacaggggactgggcactgtggctcacacctgtaaccccagcactttgggaggccaagatggacggatcactggacatcaggagttcaacaccaccctggccaacatggtgaaaccctgtctttactaaaaatacaaaattagccaggtgtagtggagtgtgcctgtaagcccagctactcgggaggctgaggcaggagaatcacttgatcccaaaaggcagaggttggagtgagccaagatcgtgccattgtactccagcctggacaacaagagcaaaactccatctcattaaaaaataataataataaaaaataaaaaataaaaaaagaatgaaggggcttggggcttgtcggattacttaggtagaaggagacaaaaacaaaatacaaacaggactaggcaaaaatttgtcttcttggctcaggtaagatgtttcatgattctacggtactgggtatgattctaggttctttggatgatggaatgaatcacagtaacactcagatacagaaaaagcagaactctgcttcttacagctccaaatgaggcaaagggcacacaggaaattgtacccaggaacagaactacagcaagcggggactgttggaggtagcttgcgaatggaaaatggcatagagatggctaggctttgcaggcctccggaggattgggtattttaaataattttctagcccaaggaagtaggggctgtttttgggtgttagagatttggagatctgtggtatttgggtctatgtgtattataacccaggattattaaagcctaataagggatatatttggggttgagtcttagcaaactgtccatgaaggggaactgaaagtttttagctgtagctgcaaactttcgtcaagataacagttgtgagatataccagatcaacgggtttattatctcttgatgacttaatggagagattatacactttttctgataatattgacagaggtcctggcttcgactgccattggtttcaattaagcaatatgctgaattttttacaaaatattatagccaaagaaatagataactgattgataatgacctggtcatatgcttgtccctggagcaagaaggtggaggcaaataactccccagctgtattgtctgatggtacatagggagatggttcctcaaaagaaagtcacagaccttttatcacaagaaggagacagaattattgggtaaaaaaataatgaatatccgttaaataagtgtaccatgtaatttacgttataagctgaggcttttttgagaaaaagagtctattgataattctgccatgacaattggatacatggaaactgtccagtgaaaacaaagatttatggccatgctaccattgtataggtttttagggagatacagaccctaaggaggaattctatgcaaattaaatgacatctatatagagataatacataatgcacgtgcacaggaagtagatctttgtcactagattggaaatatttagtagtagtctccttggaaaaggaagattagaaacctattgtgcatagtcttgaatatcattccaaagactttggatgtttgtgaaattgaaagtgattaaagtctccattgcataaactggcataattggaccaatctttgttttaggaagaaaattttggtggtaatatttaaatgagtagaaaggacaagagatttaaggcaggaagactattcagagatccaatttttttttaatcttcaaagccactactctatttaaaaccttcattattcctttcttgtactacaaaagtagcctttaattactctgtataattccagtttttactccatctctttcattctccacggtagccagagatataacataaattttgattctgttctgctcaacattctcaattatgatctgaaagtacagcattcatatgcattaacatgacctaaatgtcttgtatatttcagcctctttccctttctccaaccttgtctcatgccgcagttcttctgaatatcaaaccggactttctcatatctttgaacaggcaactcaaggcttgctataggacctgagcccactgtctctcttttgtttaggaagctagtctcatccttccttcatacctattgtaatccctacagctctgctgttttcatcccatgtacacacactctttgcctggcaaagagctactcatatttcaagcctcagctaaaaaatgctaactgaattccaccctataaatctcatacatattacatttttctttaatattatcatatttactacacaaatattttcctgtgtgcgtaaggttttttttgttttgtttctctgtttttgttaaatgtctcacaagagaacagtgcctcaaaggtagaaatgaaggattttaggctcaccattaacaccatagtgcccattgtcttgcaaagaatgtgattatataaagaaacaaacaaataaataaatgcttatgaaaatataattaatgaatgaatagatataacatatgatctaatttatgtaaggcattaaaggctgtggtatcaaaaggaatggaaagatgatgtcagatatgagaacatttgagaaaaacattgactcaatacctatgttgacccctgaatattgtttatttttcctgtgatttttatcctttgattaaatttggaaagcatttaacttaaattttatttaaacgttaagtataatcaatgtttttggtttaagatgaagtaactcatgacagaaagaaatgatttttacaatttaaaaatacatcaagaaataaaaattttattatttattatcatcacacttaaactccatacacttccaataaatatttaaggttgcaagaaaatatgtttccactatgttaaagtttccaaaggatcttatcacttgatatataatagttttatcaaatgtaacctactacatctcttgatagaaaagctgcaaaattataccataaaaaggccatagaaataataaaggcaataatagtggctgtttttgtaaacaatcaaccatagtctgttacaatcatacagttcataataactgagcttaattgtcaagattaattgttgagcttacctacatgagttgttacagaacatggacatagataagtttattctgagcttattctaaatttttatgagtttaggagtttttatgaacctcttattagatttctcttttgggctaaaggccaaactaacattttatcttgatttcatttatcactgcatagcttaaatgtcaaaataaattagagaaaattatgatgcaacccccttaggaaaagcaagtctcgtacctgaaagataacactgctagaaattgatttcttgcagaaattttgcagcacaatattaatttttctcttgtgatattaggacaaataatgttttctaatatttgaggtgtgaattgaaattaagaaaatatgagctgacattactggaactcgcagaacaaatgtatgtgtagaaagcatccatttaggttgctttattttggataataatattaatattaaattgaattaatatgcaacaaaaatatgcttattaaaatattcgtgtttgtacgtttttcatttcatgacaattttgtctttttcagactcttgagatactgactggaagatagactgttttgttccacctgattgtatgggagaaatttttgaccttagaaagtggaaatgaggttgctatggaaactggtaattctgctgccactcataaactcttctgcaggtaaagtgttctattattataagttttgattgataaatatattggcattgtatttctttctatgggtgaagcaattttcaaaatgcacaatttgtatgttatttgaatgactaagtgataatgttttgaaggtaacttctatgactcagacagggaaagtttaatccttaaaaatgtatcaaatgccagttttaaatggaaactaacattattacatttataaattggcaaatatgacatttttatacaatgtaattatgtaatatttaattatataatatactatgacattttaataaaagaatgtaattaaatatttttatcaccaataaacagtgaataattattcttattttcattatagtgaagtctttaaaaaattaaaattaaaatacatatttctctcatgtttagaaattgatatggcaaaaaaatcaaagctatattcatttagaagaaaagatgatatagaatgttacctcagaactagaaataaccttagatatattttctttttaattattttaaaagaatagacaagaacatgttcttttattcaacttgaacatattaatatctgtgtatcagttaacttttgctttgtaataagccacgccaaatgtgagtgtaataaaatatcaaataatcatgtatttagttgacaaatctgtgggttaacaacttacgatgggctcaaatgggtcttcttttggtttttgcctgggtgcactgcaacttcgatgagctgagtcatctgagacatgactagtctagaacattcgtaactgagacaactgtgctgccatggctgtggtccaaatgttaccctctgtgagtctgggttcttttacatggtggctgctcagggttccaagaaaacaaaagacagaagaatgcagcatttcttgatgccaacgcttggaactgctacattgccatttctgtgagttattttgacaattataagtcacaagacaagttcagctttaatagatgtggaatgacactacatctcttgatagaaaagctgcaaaattataccataaaaaggccatagaaataataaaggcaataatcgtggctgtttttgtaaacaaccaaccatagtctgttacaatcatagagttcataattactgagcttaattgtcaagattaattgttgagcttacctacatgagttgttacagagcatggacattgattagatcatatgattatcaaagaagcctctcttctaccataccatgcttcttccccccgactatgtgttgataggtactagtgaagtttcacgtacttataacaaagcagtaatacattgacagacatgcaggaataaacataatttaaaaggcagaaacacagtaattgtaaaggacatatattttatagcaatcctgagaaatagatatgctgatcttaaaatgaatgagaatgctaaaatatgcagaaatcaaacaggagaatcagaaaaccatacaaataaaagcaattttaccactagcaaagctagcagctagaagtgccatagttatatttactcaaagtgattacagtattttgattggtgacacctctaagtctctgtaacaaagatttggggttaaataatagtgtattctttttttggtaatagattaagaaaagacagagaaaactcatcaaggtgcccccaaatcatatatgtgtgaataagaattatattcctacccttaagtttcatcttcctgtcaaaattcaacattaacattttgccctttaaatatgtatattgaattagcataggatctctaaaagaccttttgtgttaaattaaaatgaattattagtctcagaacacgtatcaaatctgagaaatactccagctcttatattaacttttatttatacaaactggatgtgattcaacatgtcctgttgctttattctgatgggagaaatcatcatatacccttggtgcacaatttcattgtgaaagaacagattggatctattaagtagccatagctacttaaatgagataatctaagctaaacattgctccagaggtaaggatgttgataatgacatacacaagacaacactgctttaaatctgtttgttttgttagacgtttcatggtgtgtctccctattcgcagatactattttagtttagaaaattagattgtctgatgatagagttctgtgactatgcatagtgataatatcttgtttttccaaaacatactttttattcattctgaaatgccagcaaatctttcacaattacttactttttccttgctatttgaattattataatttttctaacaggttgatactttaaatctccctagactctaaattaaaacttaaaattttttgacaacctctcccctcattttctaaaaattaactacaacttctagtgcttttactatagtcatggcctcataggcctttacaatgaaacttaatccatacagtcatacatgattgattctgggacacttttaaagttttgagtacttaaaagtttaattgttctattttagtatttttaaaatattagaagaaaatgaaggcccatttaattaggaaatacagttaataattatatactttttaactgtttcattgatatgcatgacaggctaaataatggccccaaaagatatctaggtcctaatacctggaacctgtgagtgctacttgatacagtaaagtggattttgcagatgtgattaagttaaagatcttcagatggggagattaaaatagccctggactatccagattgtaagaaggaggcagagttagacctgacagaggggaaggcaatgaggcagcagagcagagggagacgtgaagatgctgcactgctagacttcaggactgaggaagggatcatgagccatggggtgtgatgaaggaagctctagatgctgggaaaggcagggggacagattctcccctctatctgtggactgagcatggctctgcctgcaccttttttcagccccgtgaatcccattttggacttctgacctccaggactctaagaaaataaatatgtactgttttaagccataacatttttggtaacttttatagaagtcataagaaactgaagtttcttcctcactatgctttaagcttccagatggcagggactatatcttgctggtacttggtagggattcagtaaatatttgttaaatgaatgaattaattaattaccaaaagttaatgttgtttgttctatttatgttatcacagtagaataaatttagtcatataatatcctctggggaactgttagtctggttcattcctttatggttgccagtgtgtattaaagttacagtcataagtttctagaaatagaattgtaataacgttttaaaagttttaaatcatgccgtatttgaaactctgtgagggcaggaaatttcatctggtttatgctttactgattctccatcccctaatacacagattctaaatatttgctaaatgaataaaagaaagcagcttcattcacttcaacaaatatagaaatatattagaaactatgatgtgccaggcaaggagcttgatgttgaccttcaacaataggtccatagtccctgccctcttcaacctgacagtctaaacagggaaaccagcaagtaagtccacttaaactgagattctgccccttgtgacaaaaaagttcttgactaatacagctttaaaaatttggttttgaggttgagttagtaacagaactctgctgggataaatgcttattcactaatgaaaatgaggaaaagagcaaataaaagaattttaagaagtcacaataattcctggaaggaaaaaaaaatcaagaggtttaatatagactaagaacgtttattctcagccctgagttactgaaaaatctacatttcttaaagtagaaaaaatatgttaatgagataatttggataaccaaattaataaacggagaaaaacttataactgtaagtctactttttgtctttgtagacaatgcacagattgttttcatgaggaaatattttatttatttatatatttgtttgtttgtttgtttgtttgttttttgagatggcgtctccctgtgttgcccaggctggagtgcagtggcgtgatatcagctcactgcaacctccacctcctgggttcatacaattctcctgcctcagcctcttgagtagctcagattacaggcacgcaccaccatgctgggctaattttttgtattttagtagagacagggtttcaccatgttgcccaggctggtctcaaactcctgagctcaggcaatccacccacctcagcctcccaaagtgctaggattacaggcatgagacatcacaaccggtccagaaatattttattttttaataaatactgaacaatgtcagtaatgggtagaagctgaaaaaccacgtagggtcaaattttgttgaccctagaatgtcacctgcctaagaaacccaagattaactgatgtgattaactgtcacattttcccacagtgaaaaattctcagaatgcacaagatgattctattttattaaatctttcaccttaccatggcttttatgtacaatttgaaaaatattagacagatttcaaaatttagttccaatctttaaaaatttgataattattaaaaatgtttaataaagacttgatgataataggttgaatcgtgtgctatatctgttcttatgagttaaccagggttagagatagcacaattttatctgcggactattagaagatctgcagtccttaagaagagtgtcagtgagtgtcaatggctgctattataactcaaacataataaacaatagcagaatagtagttacaaggagtgtgattttcctgatactaaatattcatatcatcttaagaatttctgcctaatgtattctcttttaacattcttattttaactaagtactactatttaaatggtagtttataaaacattcacttggttcataaatataaccacttttttgtcatttgtgtttgttttgccatgggttaaggacttttatatgtattttatgaaattacggactgaatacctatttggttagtcctgaagaagtaccagttattcagtatgagacttggttttatcatgaagaagtgcaataattcaagaaagtcaacatagagctagtcacatgtattggcagactagaatcaaagccctccttgagggattctaattattgtgttatgccaacagggcctaatgagctggtttctcctactgtattaattactcttgaagaataaactgagactcaaaattataataagtctttgcagccatcatttttatgtaatgtttgctgacaaatgtggttatattattttcaaaacttctcccaaagtagttgacttttaacactaaaataaagttgtttttagggctgatacccataaagaaagaaaaaatctattttgtcagtatttttacatagcttacttctttataaataacacagcctgaaagtgaatctgggagaaactgtcactctttctaaatactcacagtcaggcacctaggaaaaagggacattggaaagtatttatgattgcttgaatttcactctatttcaaacatagccttttattgaattgagaggcagagcaaacgaactacctgagagagaaaaccagaagaatgaaaatattcactatgaccaagatttcttcaaagacaacgatgtatcacacagcaaatccatgaaaattggcaggtgtaataaacctgctttgctcaaggatcccagaagcacatactggatattcctttgggtcagagtgtgaatgaatattgagtacgtcacaacccacactctgcctacggtcttgtttggatttattgttagcataatagcacctttaagaatggaacaccaggctgtatttttaagccaagtgacatcttcgcaatttctaatagaaatggtccaatttagaaatgctgaaaacaccattttcatgcaatgcttactgataaaggtggttatatgattatcaaaccttcttccaaagtaattgattcttaaaccttaaatgaaattgttaggactgataagaatgtaggaaaaaaaattatgttttgtcagcactggggggaaatgattggtatgcagactggcatactataggaaatgtaggctcttagttgaatggaatgtgagtaattgtgttttcaccatgaagtctttgaaggagagggtcaagtatgctatggaagtaataacaccaggtcatattttcactttaagggtactcaaaaatagctatgctatgacttgaaaatagcatggaaggattcataatatttttcttttcttttctttcttttttttttttgaggtggagttttgctcttgttgcccaggctacagtgcagtggcacaatcttggctcactgcaacctctgcctcccaggttcaagcaattctcctgcctcagcctcccaagtagctgggattacgggcatgcaccaccacacctggctaactttgtatttttagtagagacggggtttctccatgttggtcagactggtctcgaactcccgacctctggtgttccgcccgcctcagcctccctaagtgctgggattacaggcgtgagccaccgcgcccggcccaggattgataacatttttcttcccccgatttaaacaactccagatgcttaaaatcaaactccttgccattccatcaagtcacgaaacaatctggcttcttctgcctacctctttcatctctacttttacttaacttccctttgctcattgcattagagtcacatttttttcttatgctcatcaaaataccaagattgttctctgcttagggtctttgcatgtgctgttcagtcgtgtgaaacactcttcacatctttctatgactggctctttccattatacccatctccaatcagtcacctccatagtctgacgttcccttaggaccttgtctgggtaagtagtagcttatcccactattggtcctagtcactcttgtcaaccttttttactgttttcaatgagctcgtcgctatctggaattaacttatttatacattgtttaccagtgcactttctgcctatacctagaggaatataagttttatgtagttaaaatattgtgagtcgtataagtggctgcatcactgatgcctagtacagtgcctgacgcatggtacgcactcaataaatatttaaaataaatgagcacgttattgacctctcaaaataagaccccaagactgcttagggataaaccaatattcccaaacacctttagcaattgaactggttcttgttagaatctacttttaggcataaatgttttagtcacaatatatcttttgggcttaggattttttttttaatttttaaaaactatgctgtatactgaaagtagaaagctattcctaatttttgaaacgaatacagtttgcttagacacacttgacctaggcaggggtaacttcagtgtggtttgttcagggagtagaacatttaacatacagccagtgctgtttcagtattactgggtagcaaatacacgttgactttgtgtcacaaataatttaaatatttaaacttgtgggctgtattttatctcaagatgtatttttttattcctttttagttctgtcattaccagtcaagttgatccaccattgcctctccccccaagacatttgtaccagcctcctacagtttctctctattttgaggcatcctctgtgtcctttccaagacttagcttattgacacagatgcctatgcagagaaaacttcataaagcacggctgattttgtcattactctatgtcaagacctttacagatcccatctcctataaagttcaaactgtctaatcaagcattcaaattcaatttccttcaacaaatattggaagttctccaattaattcaattctacctgtgtcatgagccatgccttcccttactctccttcatgtatcctttattcaagtcagactgtgctacttgtaagatctctgcactttttaaaaatccccaagtctctccttatatcattgtgatattctgcattgttcttcttcagatccatttccatttattaaaggcaaatccaatctttaacacacttattcgaatgctatgttcattctgattaatcctcccagtaacatattcttccattttctcctgaaaccttgattctgtgaagaagaattttgtcatttccacactctttgcttagaatcaggtcatttctctcaaatatatgctcattctgagaaatatatagtatttacacttgttgaatttgtaactgtagaattcttagtcttaaagggaaaataaaaactcaactcaaatatttgactcgttatacctcataactagtgcattcgagtttataaagcactttatgaatagtgtttcatctgatcttgatagtgggcaaaggaagaaacgatatttgagtctcagactttctttctttctttctttttcttttctttctttctttctctttctttctttcttgctcttgctctttcccttccttccttccttcctttccctccctcccttccttccttccttccttcttctttctttttctttctttttttccagtctcgctctgttgccaaggctgaagtgcaatggcgctatcaaagctcacttactgctggcttgacctcctaggcttaaacaatcctcctacctcagcctcctgagtagctgggactataagcatgcaccatcgtgcctggctaattttttattttttgtagagactgcctctcactgtgttgctcaggctggtcttgacttcttggcccaagcaatcctcctaccttggcctcccaaagtgctgggattacaggcatgagtcactgcaccttgcctctttttttttttatttttaattttaatttttctgtgtacatagtaggtgtatatatttatggggtacatgagatattttgatataggcatgcaatgcataatcgcaatagggaaactggggtatccagtcccttaagcatttatcctttgtgtcacaaacaatctaattatactcttttatttatttatttatttatttatttaatttatttatttatttatgtacttattgtctctgttgcccaggctggagtgcggtggcacgattctggctcactgcaacctctgcctcccaggttcaagcgtttctcctgcctcagccttccaagtagctaggattacaggcatgtgccaccacacctggctaattttgtatatttagtagagacggggcttcaccacgttagctagcctgatcttgaactcctgacctcaggtgatctgcccgccttggtctcccaaagtgctgggattacagatataagccaccacgcctggccctgttattttcaaatgtgcaattaagttattattgactagagtcaccctgttgtgctatcaaatactagcttttattttttctaacttttattttgtactcattaaccatccccacctgtccccctcccgccgtcccagtttccttcctagcctctagtaaccatccttctactctctatctccatgagttcaattgttttcatttttacatcccataagtaagtgagaacatgtgaagtttgtctttctgtgcctgacttagcttaatgacctccagttccatccatgttgtttcaaatggcagaatctggttcttttttatgactgaatagtactccattttgcatacgcaccacattttctttatcaatttatctgttgatggatacttagattgtttccaaattttggctattgtgaatagtgctgcaacaaacatgggcatgcagatatatcttcgatatattgatttcctttattttgggtatatgcccaccagtgggattgctggatcatatgggggccctagttttagtcttagttactggatcatatggtaactctagttttagttttagaggaagcccaaaactgttgttgatagtggttgtactaatttacattctcaccaatggtgtatgatggttccctttacttcacatccttaccagcatttgttattgccagtcttttggatataagccatttcaactggggtgacatgatatctcattgtagttttgattcacatttctctgatgatcagtgacattgagcactttttcatatgcctgtttgctatttttatgtcttcttttgagaaatagctattcaaatcatttgcccattttttaatcgcattattagatttttccctatggagttgtttgagctccttatatattctggttattagtcccttgtcagatgggtagtttacaaatacttccttccattctgttggttgtctcttcacttcattgattgtttccttttctatatagaagcttttaaacttgatatgatcccatttaaagattgtttcttgacacagactcaattttttttggcagcgggcaggattttcctctgtcactcaggctggagtgcagtggcaagatcatagctcactgcaccctcaaatttgtgagcttgaactatcttcccacctccacctcctgactagctgaaactacaggctcataccacaatgcctggctaattttatatatatatacatatatatacacacatatatatgtgtgtatatatgtgtatatatatacacacatatatatacacacacatatatatacacacacatatatatacatacatatatatacacacatatatatacacatatatacacacatatatatacacatatatatacacacacatatatatatatacacacacacatatatatatatacacacacacacacacatatatatatatatagacaaggtcttgctaattcttaaactcctggcctcaagtgatccttttgcttaagactcccaagtaacagactcaaatttatgaaacagttaacctttaaaatctgaaaccaatttaaagggggaaatcacccagggccttgtaagtcatactaaggaactggattgtgttcaaattaccgcctaattaccatagtgggggcttattcatggaggatatgtgccaatcctcccagtggatgcctacaaccatgaacagtcccaagccctatacgcattatgtttcttcagtctgataacagagccagctactaagtgattaaaggtgggtagcatacacagcgggggtgcactggacaaagggatgatttcctttctgggtgggacagactggaatggagcaggatggtgtgggatgactggagatttcatcacactacccagaatgcaatttaaaacttatgacttgtttatttccaaaatttagcgtttaatatttttggaccttggttgagcatggtagctgaaactggggaaactgaaaccacagaaagtaaaactgtggataaggcgggactattatatatagaatttttttttattttggcaaatatactgtcattaattttatttctttttatcttataaaaataaataccttaatatatttatctagtataaattgacagaacaattaatctatataaaaataatctggttctcaaacttaacttcacattggaatcacttgaggacatttaaaaaatactgttactacaatcccacttagaaatttagagttaatttatctgtgttcaatgtaatcattcgtttgtttttctttttccccccctcaagacaaagtcttgctctgtcccccaggctggagtacagtggcgcggtctcagctcactgcaacttctgcctcccaggttcaagcaattctcctgcctcagcctcctgaatagatgggattacaggcatgcgccaccacacctggctaatttttgtatttttagtagggacaaggtttcatcatgttggccaggctggtcttgaactcctgacctcgtgatccatctgccttagcctcccaaagtgctgggattacagacatcagccaccacgcccggccaatcattcagtttttaatttttattaaaatccaaaatatctcagtaagtataatgtgcataaattgtgtcagttcaatgaattttcataaattcaacctacccatgtaagcagcacacaaatcaagatgcaaccatggctggatcccagaagccctttccaatcacagctgagacacagaagggtagccattatctgacttctcatcacacaatttacttttactgtatatatatatatatatatatatacacactacctatatggtcatttagtgtgtattctttcatttctggcttgtttcattcaatatcgggtttgtgagattcatccaagttgttgtgtataatggcaagtttgcttactctcattgctgggtagtacattattccattgtatgaatcttttacagcctgcctttccattctactcatgatggaccttggtgtttttaaaaggacctaagtgcttttaaaagctaagcaaatgattctagtatgctgtttctgaggttgagtatcaccaatgtagtcataaatgtacgtaaaaaaaaaaaaaaagaaaaattaatttgatatcccattaggcttccatagaatttgtggtagtgtttttaaatttgcataattctcatttttatttatctctagttgaaaattaccgacatatttagccagggtgtgctggagctgactcgtagcagctcatgaaagctgagtgttagtttcaggaattttgtaagcaagtcgtttaaacacagctattattaaaaattaaatagacatccaattaaaataattatattcaaaatttcataaatatttaaaattcattacttccaaattattttagaatattttcctattacttatggtcttgaggttgttcatatctattgtatttgtatggtggaaatatcatatcatggaaactactgtgcatttcttcccaaattatgtcatgttattatctggaaatcactcatgggtagtatttacaccacagcaactggcaaaagctacaaagcaggtcctcacttagtgttgatgctgaaagagtttcagtaatggatataatttgtatgacagtgagaaatagtctaagattatattgcatataatgatatatgattatatatatatgatatatatatatatataatgatagcaaatgcttactgggaataaagttagcagcagattgggatacaattccaattgtcaggtcatggttgaactgcaactgaagcttagctagagacataaatattcaataaaacttagcaaaagccttctatgaaaatcaattgacttatggaatttgtaattaattatgatattatatattttattatttttaattgtgggctacacatcacatccattgcattagtaaatttgataataaacatgtgtatatacatatatatacatttatatgcacacaaatatatgtatccacattcttttcagagacatggttgttaaataactgctagcatgctgctctgttgagctatgttttattttttagccatttttattagtggaagtatgccatgttttgcagatttattcggtacaaaaaacaaggtagagaagtaagtaccaagaccccatggtgcccttaggaatatatatatatatatgtatacacacacacacacacacacacacacacacacaaacatatatatgttctgtacatgtatatgtgtgtagatatatattttctatacatgttacattacactaaatgatattgtaattgttttgtctattttagcactaatttagattttgatattttatttttcatacagaattagtactaaattgaagaacaaagataacatatttggactcagttaaaaaaaaatctcaatctgaagatacctaatagtttaccagaaaacagatgaagagtttctttcctccctcataaaaaatcaaacttggtttaccgaaccttgcagctaacaacaggtgctgtctgctcactttgccagaagctcacaatagaacagattgggtacacacagaactaaaaacaacatttgagtaaggaacaaaaccctcccaaatattctgaccagctctataatcagttcttaatattgagcctggaaacaataatgatttctttaatgtcaaaatgggcaaagaaccttgtttgtattgttttgttttgttttacctgtatttgtgcacatgggaatttcagaaagcacttataatcaaacacaaaagtgctacatttggggttgtacagctcagaagggaggggaaaaaaaaccccttcttcttcgtaaaagtcttacagagaatcaccaatcacagagggagaagtgtgttctaatatcaaatctgtgtggctgcaccatcccttcttaattgccaattgtcttttccactttgtcctctttctgtaacattgctaaactgaatctgaggccagggctttaacttgatatatctaagttcatggccatacatttattttacttactcaaacacttagtctctcaaatagaattgatgatttgtcaaatgatttgttgttgcataatgacatagctgtggaagccggatcttgctttatgtttgagaacacatttccagagtccaaaagcacgtgaggattgatggcacagatgggcttgaagaactggtttcagaagtgccatcttctactcaactgccagtttttctgtttatcatctagctagacattctgaccctttgtatcctcccattgcttatatttttacaacgtcaaaatcactccaaatgagaaatgtgggaacagaaaagcaaagcaaagagtattcagaccacagaaaatcatctgtgcctagggactggcctggcagcctcttgttttctgtttgtcccttgaagacaatggaattgtaatccttgtaccaggagatcacaccatcctttccagttctgattacccaatgattctaagatgagaagcgttacacagttttacaatttcttaatagttctgatgaaagaatatatgaggacaacgcagcttgttttagctaaaaggcaatttgggactcttctgtgaattttatttatccatcttatgctattcccttgggtaattatgagtgaattgctctgtgctgtgtttcatcaaactttttctgactgttattttgaaattattatcaagagcatcactgaaggaacatagtcacaaatggataatgcttattaaactgcagtgttatatttgaatgccactattctatggctaaggttgtgctatgccctcatgtgccagccttgaaagctcattaatttgtttggttctgccagtcaggctggagtgcagtgacgcgatcatagctcactacagcctcgaacccctgggctcaagagatcctcctgcctcagcctcccaagtagctgggactgcaggcacatgccaccacacctggctaattttttaaattattactactttacagatgaggttttgctatgctgcccaggatgatctggaactactggcttcaagtgtcttcccacctcagcttccctagttgctgggattacaggcatgagctactgtgcccagcaaagctcattgattagtctgcctgtctgtcaatgcggtcaatcagttaattcagtgagatactcagacactccaaacaaactattaatctgaggagacaacctgaaacacatgattagcagctgatgtcgtaagaacataaacacttagccaatctgtaatcaatggattcatctcaatttaaactactgcttcttttagtggtaaacattgaagagcaggggaaatctgcaccaggaaacaacaagtttcactagactgacaaccttggctgagctagaactatgttttcagaatttctcttccctatccagatctggattagagatgaacaaaaaggaaatttgtgtgagatttggaaggtggaaatgatgctactctgtgaaagctgcatgtaagtttgtctggtgagaaagagacacaggttaacagagagctcgtcctctgtttccttcttcatatccaggttttggcccaactggtggcactactgaccaacattgaccttaggtccactccagttttagaggcaacagttcacaaacgcttccccttcacatgcccattctggcagctgaacttgctggcttccttgcaagatctgacttgaccacctgctccagtgcccaagagggcttgttagcagtatcactgtgatatttcccctctcacttttgtaccatcatcttctcttacaattacataaggtcttcctcctaaaatgaatcctctattttacatgattcacagtagttttgctttcctgattgaaccttaactagtatctgtacagttcaaatttgtcatacatgacaggggaatgatatccaaatcactatactttggtttttcctatgatagctggtgaatatggaggctttggaggggctatagttttcatgtagaatgtgattaggatactgaagaaattcttgacatatattaggactcagaagcctatgcaacttggcataggtattttttgtctcttcctctgtattgtgaagcctccctgtgccatttagtttttaggcagcagttcctgcttaccatccaaaccccttttgaaccttacagaatccccaaaagtcagccttggccttaagtcccacagtactgtgctttacctagggagcatgttaattcatgcataaaaattaaggactcaaggtacattatatcactgtacatctgagtggatttttttgtggcttaaccttgatttttagtgctataacccaaataaagaaaaatgcaagcatgcattggagggtattgggctgtaataaggtaataaagactgtttcagtggtatcatatatagtgctttacagaatatagggtattttcacacctcacctcatttacagttcatgatctctcatgacattattagagggtcagagatgttacatgcttgtccatggttatttgtgtggcttggaggaaccagaaaccaaccaagtgttcatatcctagtgttcatttcactgaaagatctggctttttaatgaagccgttggctcttcccattcccattctcattaccgctcatctaggctgttgcggaagactctgcaatcctcttttctcctattatcagccccactcttcctcccattacaccaataggaaatcataatagttttatgtttctcattttgcaaatgagtttcaatggtccatctgcttggatcaaacgcttcaagtgctgtccctttgctgcagaaccagatagattcttctcaaccttgtattgaagctctagcaggattccaatgagctttttcaaacttttttcctacctttcttctataaagacactttgtgctggccaaactgagtgcatcacccccactacacacacacactcacttctacaaggacttataataataataatcacaacagctacctgcattgaccatttagtagctgctgagtatctcactagttctttatctatattacccaggcaataaccatgagatgtgcattactattgtttccatttgtaatgaagaaatcaaagctgaagaggttaagtgacttactcaagataacatggcaggtcagtaacagaagttgtattttagcacggactgaattttaaaatggcactctcaaactctctgtgccactgcctttcttcgagcactccccatttcttacagtgcctgatccctctgaacacacattttcatttcttccttcccttcaagggccactccaaaatcagtaagtcttccatcatctccacattaccacttacccacagaaagtctccctctcttgaattcctacatctctgagaagatgcatgaggaaagagaagtataacttatgagtcggtaacattcagtgctcatttctcagtgcgttgcttggatcctggcatgcaggggcagctcattggcatcaactgttctaagtactggctaaacaagagacaagctctgaggcatatagtcacaaatatgggcagtaaggagttatcgtgggagtggtgaatgtggaggggctctgagtgggaaatagttcaacctcattttatagatcccacatctaggatacaaatcagttaagccacttgcccaatgtcattcagataacacaagagtacccgggagtgctgagatctgaacccaagtacacatatattcttcctgcattttgccaaacacaaggcaatttctaggcttagtggagttaatgatgagcaaaaaaaaggcacatcctagaagcttctggtcaaatggcagagatgctaagatacagattaaaattttttttaagaaaatacaagtttttaaaattgttttaaaggaatcaaactacacatctcatccagatgacagatgctactggggaaggaagcacagcacttatctatcagtagggctagggagctcttaagctgattaaggacacaggctccgcaattaaagacacctgtggcacatatacaccacagaatactatgcagtcataaaaaagaatgagttcatgtcctttgcagggacatggatgaagctggaagccatcattcttagcagactaatacaggaagagaaaaaccaaacactgcatgttctcactcataagtgggagttgagctatgagaacacatggacacgggaaagggaacatcacacaccagggcctattggggagttgggagcaaggggagggagagcactaggagaaatacctaatgcttgtggggcttaaaacctagatgatggattaataggtgcagcaaaccaccatgacacatgtatacctgtgtaacaaacctgcacgttctgcacatgtatcccagaacttaaaattaaaaaaaaaaaaaagaaacagtggttgtgagagaacagtgcagtagagtggtagggatgaaagacaaattataaatggtggaggagtggggagaataaaacaaaaacaaacaaacaaacaaacaaaaacaccttggttcatacctggcaccttactacttgtgtggcagggcaagctactgaacccctctctgtcttacatactgcatgacaaatgatacacattcaagtcacactagttttcattttttcctatcagttgccaatttcttgtactagagatctttacgggaggtcttacctaggtgttaccttccttttcacctagatgacgtatctgaaatgttgcccagatggggatccatatccaatgtatctttttactctgtctccgaagtacctaacatggctttggtaaatatcttttgtttagctagcaagcacatattaaaataatgaagtgccccgtgagtcacaatgatcatcacaaacagccatacgacatttcctatgcacttttacactcttttaatctcccaggtgattagatatatagcttaaacataccgtaagtccctcaggtgggcaaattgtattggccccattttacagatggggaaaatgagggaagggtaagaagcttgccccaaggtacagagtgagccagtggtggaactgggatttgaatgcaggctgtctcgctcctgaatctaacttcttagctgctagattcaaccgctgttcaacagagtgaagggatgctaacacccaacatatattgagcactcatatgtgctttcaaataattccatgagttaggatctcaaaataatttgacgacataggaaatgtcattctttttttcatttcatttatttattttgagatgaagtctcactctgtcactcaggctggagtgcagtggcacaatctcactgcaacctccgcctcctgggttcaagcacttctacttccctcagcctcccaagtagttggtactagaggtgcacgccaccacgcctgggtagtttttgtatttttagtagagagggaggttccccatgttggccaggttggtctcgatctcctgacctcaggtgatctgcccacctcggcctcccaaagtgctgggactacaggcgtgacacatcgcgcccggcctggaaatgttattaaccctgtgttttaggttgggctcctccagaagccgactttcagaaaaaaatatgaatgaaagtaatttatttaaaagataatccccaaaagccccagtaaatggtaagtgagacagggtgagaaaggatgaggtttgttattgagcagtgcacatctagtatgactgagactctgtatacaggaggtagtgtagaacacacctcagtgtcttatcagaatgtgactaagggaccaggaagctgggacacttgcccgtcactgccctttcatcactggcatcaactgttctaagcactgactaaacaagagacgagctctgagacgtatagtcacaaatatgtgcaataaggagttatcttgggagtgttgaatgttgaggggctctgggtgggaaatattttaacctcattttacagatcccaggtctgggataaatatcagttaagccacctgcccaatgtcactcaggtaacacaagagtacctgggggtgctgagatctgaactcaagcacacatatattcttcctgcattttgcatgttctctctaagcacagagcaatttctaggcttagtggagttaatgatgagcaaaaaaagggacattctagaagcatctggtctaacaacagtgatgctaatatataggttaattttttttaagaaaatacaagttttgaaaactgttttaacggaatcaaactatattgctgatatagagaataactcaggtggacgtgagtgggaagggtgtttaaaaaggcgtattcctggcaagggaaagccaaagtcactcatccgtggagacaaagcaggccagaatgactgatggggatgcagtgagtggcagaggaaggatggtatgaaatgaggaagaaggaagggaaaaggcagacatactagtctcagaggccctagtcatgctttaggatttaattctaaaagcaatgagaatttatcaaagagcatgcaattggcagaggatttgttcttctatttagcctaagaggcctccagattaaatgttctttctaaatacttaaaaaaggtgacatagtctaaaagggagacagcaaaccagctagaggctgtggtcaggtgtggggaaggaggggacattcagcctccttgttgtattcaaccgccttcctcagctctgtcttctcttttctgattctgtccacattccactttaatcctcaatgcttgtgagatgatccagagtttgactgcatatttagcttttcagggatactgcagataatgatgagaattattcatctttcttcagcataaaccgtatttaacgaggggctagaaaaataatataaagaggctttatggtcaagtttcagagctgagttaggaaagtaattccaagtagtagagtttcagcatattttatttcctccttttacttctctaaattttccaaatggatttatactatttttaaaataaaaatggtcaagcctttaaacatttgtgccaattatgtagatagcctgcaaagctgagacacttctcactatgctaatcagataactggctcaggctttctattttatttgataaactttggtcattctgaatttccaaatatcaccaaaaattctgactttgataaataatcaaatatttagctctattgtgtattttcttacaattttcaagtgatatgggtggcccatattatattcaccttaaattttattagaaaaagaatactttcgccggttgcggtggctcatgcctgtaatcccagcactttgtgaggccgaggcgggcggatcacttgaggtcaggagttcaagaccagcctggccaacattgtgaagccctgtctctaccaaaaatacaaaaaaattagccggatgtggtggtgcaagcctgtagccccagctacctaggaggctgagacaagagaattgcttgaacccgtgaggcagaggttgcagtgagctgagatcatgccactgcacaccagcctggatgacagagtaaggctccatctcaaaaaaaaaaaaaaaaaaaaaaaaaaagcaatacttttaatatgcttactcacactattcaaagatctttaattataatcatttaaaaactgtgaggtagaaaggacaataagtgttattctccccaatatacagaccaaaatatgggtaacgtaagctaaagacccacagttagtagcagaacccgttgaaaatcgagtgtctatttaaataacaaacctgggtgtctatttggggataaaacacccaatctctacagccctttgatttcaaaagaactgatatcccaggaagatagagaacttaacataaataagaataaccaaagtgaagcttaaacatttgtacaaaccttgacaatttcattttttgtattgtttgtattacccaagtcttatcacaggggacactgagaaccaaattaagtgtgtcaaaaatcaaaaggaaagatacataagccatctcctctgaattttttcctccttcccttgtttcttccttataaacactgctgggtacttaacttttaaaaacatgggctttgaggaaggacatagctgggtaccaatcccatctctgctctttaagaagttgggttacctctgacaagttacaaaccttgcttagcatctatctctttacctttatattagccacaatacccactccatagagtgggttttatatattactatttgtacagacttgcaagaatgcaaagtgcgtagaaagtgctcgataaacagtaactagtggtgactggggtaggggtagtgccaatagttgctttaagaacagttgaactagcagcaatggccaatgccattggcaaccaaattgtgctcataactctatggaccagatcttaagactccaacactgggaaatttgctgtcattctttgatccctgggcttaaatgtctacttcttaatgctatgagctaaatattcaatgttaaaatggacagggggtcatgctccatctcatttatcataagtgaataactgggttattttgaccatagatcaaactccaaaaatttaagcaaagaaataatatgtgtaggttccagaaagagatggggaaaatgtgaaaatacagctaaaataacccacaatttaaattttggctacagagttaatgtcctatttgtaaaccagaattttataatctcaacactgctgagcagataactaatcatattttgaaccaaataattatttgctgtgtgagcctgtagatgtttagcagcattcctgcctgtacttataaatgccacttgtgccaccaacccccggttgtgacaaccaaaaactggcttgactcccaaatccactggagcaaaagtaccttcgattgagaaccactgctctatactctttttttttaggcagagtctcactctgttgcccaggctggagtacagttgtgtgaacaaattcattgcagcctcgacctcttgtgctcaagtgagcttcccacctcagcctcccaagtccctgggactacaggtgcatgccaccatgcctggctagttttttaattttttgcagagacagagagtccccatgttgcctaggctggtcttgaactcctgggttcaagccatcctcctgcctcagcctcccaaagtgctcgcattacaggcgtgagctaccacactcggcctgctgtatactcttgactttagaatgctcataattctaaagaaccatgttgcatcgtgccttctcataaagcctcagccttcaatttcacaccatccaaacccattgaagctcttgagtcccttgacatggtaactcctatccctctcccatcagaccatctcctcatggaggtgacagacaattcaggaaaatctcccattaaatccactcccctaaagccctcttggaagagtaactatatgaactttatacttctctccctcccaactttgtacctactttctcagaggtgcttaaaaaatatcacttctctgaaccccagttctctcttttatcagtttcatgtcttcaaaaatagcaggattatattgccctctgcagatgctactggtgataaagaataaaaattgaaactgactttttatgtaacagcagtgtatcacaaaggaggaaaacaagaaagaagggaattaacaatgattaaacacctaccatgtgccagcctctgcactaagtacctataatattacttcatttaatctgtatagtgaaactttcgagtaaagttttctgagatcaaaagaaagtgcatttctgacattatcttttaaataaatggtcatttcagattgttccgcccactttagtgtaccatttcccaaaagcatccaagaatccttgtgaaaagtgaagacagtctgcaataactctctgtgtgtgtgtgtgtgtgtgtgtgtgtgtgtgtgtgtgtatcacaacttaacccatagttttggaatgtcagtcatctcaccaaaatccggaatgaactatgtcccagtggatcacatattcttgaaagggcagtcagatttctgataagcaactcatatacacgagagcaaaggcaaggttctatctatagccctgtcatgaggcaagctgtctctttttgaaaatgatttagaggcagctggcctctggtctgctagtctgttggtgtctcacttggctattcaacatcagaggcaggaatctctgcccattttcacataatgcacatgtcttcctactggaagatctttctccaggagtggagggttcaggtcaaggtctctgctcacaaaataaagacagaactcagcactatttatatcacaccagaactgactcagcgccattgcccatttaactcacttgtcttgctatttggagatgttctctctcttctggcttttctgccatctgtgacatctctccaggcataccgtaaggagaggacattttgaaggatcactctatttgtttcatcctagaaaagtttatatcagtccaattctgctgctaactggacttcgtctctggcttcttcatttggaaatctacctcttatgctaagtgcccttatatcacctggcggtttgcaaagaggtgagtgtgaatgctccagtaaaaacagctgcctttactaagctttacagcatgtgctcgatattgagctaagtgctttacgtgaattatttcatttaatcctcagaaaatcctctaaaggacaggaagtattataatctccatttagataaaggcaactaattaagataagttaacagctgccaaatttcatacaactagtacatgacgaagttgggatgtgaacccggacccatccaatcccaatgcccaaggatgttccactttatcacaccacctccctgtgagcttctgttgagattatttttttactgcctgatccacaatattattgtcatctttatttggcttggcggttgacaaaatgaatgcatttctagaatcttcaatgacgtgaaaattggattacaaacaaaaccatctctggaactgcctgtttcctgtattttccttttggggaaaaaaaaaaaaaactaaaataatgagctagacgagaattctgatctcagatatgccactacatgctcctgcacaccagagcaatgatgtacctctcgagacttctgtttctttatttgtaaactggtggggttggaattatgaattttaaattcctttctatctccaatacactgtgattttctgatgcagtgggtattactgcctcacaaagggcttacaaaatacactggagaaaacaccagtaatagaaaactctacattcattgctacttaactttgtgctcattcaaatatcttcatagtgtctctctccagagactccaagcacttacttaatttaatatagccctttataaaatgggtcttctctgcaaatctcagcttgaggcatttctctggtacccacacaatacattcgcttttacagaggctttattttttcccctaagaatttcctgttcatttagctacagccagaggtaaagctaacaaatttgtacatctcttcagaggcacccaatttactaaatgtcttttaattggcataggagctcatagaatgtcctctgagaggtcacgttaagagttattttgttaaatacaaaggtatagaggaggtattttcagatggaatctgaaactcaaacggaaattttttagcagcatctcatggaacttctcagttttcttatcacaaatgttctcctgtcagatcttctgtcgtaaatatgaccctgtagactgaacaatggaaatgacagccactgaatccatctctctttctcttttctgcatttaaaattcaagattataattgtagtacaaagtatgattagtaactatcagtgtgaactttggagtccacactaatctcctaaaatttcagtcatccattcaacaatactcatggcttcacccacatgctcacttctgtgtcccttaaatcagtggctgacacataggaagaacccaatgaataataatgctaaattgatatgccaagcactgtgctacaggtaaagcactgaacaaagctgacattgccccaatccttaaaaagtttatagtccggaaataattgtttattcttatatgcatgcgcccacacacgcgtgtgcacacacagacacactcccaagcacatctataatcagtgtattaaaacaaatatcttggcagagtgtggtgggccattcctgtaattccagcatttttggaggccaaggtgggtgatctcttgaacccaggagtttgagaccagcttgggcaacatggtgagaccccatctacaaaaaacacaaaatttggccaggcatggtggtgtgcctgtagtcacagacactcagggagctgaggaaggaggattgcttgagggtgggaggcccagactacggtgagtaccactgcactccagcctgggcaagagagtgagactttgtctcaaaaaaaaaaaaaaaaaaaaaagacatatctttaagagcatgtaaaaggaaaattccacttgatctaaggagttcaaataacactaccataaaaaattgactttctaactaaaatgtgaataaaattttaccaatgattagatacagtggagaagaggcatttagggtataggcaaaaacaaacaaacaaaagatcaaagtgaggtatgggagaaaacacagtctactcaaggctaacagcaggttagccaattgcagatagcaactgggagcacagcagatgaggcagcagggagaggcagggaccaaactatataggactttgtaggtccttttacaaattactaaggatactctactatattgtaaaacaatatgaagttattaaagactttctagctgcaagagggcagtagagcaggagaggcaaacaacaaagacattatctgatttgtatatgcaaaagaccccattggctactctttggtgaatatattgtgagagtggaaagaatgagaattaaaaggcagtcatagaaatcaaagccaaaatagcaatagtgtgatgcgggactcttgctgtagcaacagaactatttgaatagatttaggatgtaattgaagggttaaaagtgagacttggtattgcattttatatagatacaatggagaagaaggaatttgtcaaggaggactcttaggtgtctaacctcagcaattggttcactggttgtggcattttctgaaataaaaaaggagagaactaaatctggggtgagattgtaagtgcttccttctacattttgatttgaaaagctctgagtttattgtccctgtagaaatattgagtacaaacagtggatgtttgtggaataaaaagaaggaaaaggagtcagagttgtgatgaatttgggaatcaccacaacatgtataacaaaatatagtagaaatattgggaggccggggcgggcggatcaactaaggtcgggagtttgagaccagcctgaccaacatggagaaaccctgtttctactaaaaatacaaaattagctggatatggtggtgaatgcctgtaatcccagctactcgggaggctgaggcacgagaatcacttgaacctgggatgcagaagttgctgtgggccaagatcgtgcaccgcacctgggcaacaagagtgaaactctgcctcagaaaaaagccccagatcaaacttgaggctgtttgattcaacctggttagccgaagagagtggctggtagagaatgactagcatgcaacggtgatggagaaatattagccacaaagatacgaggcaaactagggagtatggaatcacaaaaagcaaagaaaaagcaagttttcaggtgagggaaaaatttataactcttgattattcaagtatatagagaagttaaaaatatctacaggtatcataacaagcatgtcacctacaactttagttgaactatgtctgtttatttaagagataagtaaaattgaatttactaagtggaaagtgtggaaatagaagcaatagatacagacaacaattcatagatagatgtttagctgtgaagggttttaaaatgtttatgctaataaagtattaatgagtcaaaatgtactacacatgatctctaaatatcactccacagattatttcttcattacaagcagagtaaaaggcctcctcaatgctaagaggtgcactttctactacaaccaagtgatcaaattttgcatcactcataatgagaccaactgaaataatacacctctggatgacaaaagaaagcatagaatattactcatgtccttttcttgccataatgtttaatcttaatctaatcctgaggaaacaatcacaaagttccaactgggaacccttctccatggcctgggatcttcaagaacgtcaacgtgataaaagtaaaaaatgtgaggaaaatgttctaattaaaagaagcgagagattgcatagtaaacacaatgttggtttgatattttaaaactcagatataaaaaattttggggggtttgttgaataaacttgaacatagattataatgaagtattgtgtctaccttaattttctcaagtgtgatgttgttatgattattgaaagagaatagtctttttctcagaaaataatgctgtggaatttagggatgaaatgtgatactctgcaacttctttcaaagcagttaaaagtaagaaatttaaattgtatttttgtcttcatttattgcatttatagatctcttaatttccttgtcaagattcaagattctatctagcatcaccttttttctgcctgaagaaatttttaaaatatatttcaagttcagctctgctgacaatgtaatctctgaatttttgtttacctaagaaaacctttatttctccataatttttgaaagatactttcactgggtatagaactgtgggcagacagatttttttctttcagcactttaaagacatcactatgttttcttcttacatgcatgatttctgaagggaaatattctttactttttttatttttcggtatatatgtataaattttttttctttattggtaagattttctgtatgtcttgatacttctatttgaatatgacttctgtcttgactggtgttcactgagtttcttaaactccccctgccctttccattttttttttttttttctttgagacagagtctcactctgtcacctaggctggagtacagtggtgcaatctccgctcactgcaacctctgcctcccggattcaagcaattctcctgcctcagcctccctaatagctgggattacaggcaccaaccaccacgcctgattaatttttgtatttttagtagaggcagggtttcaccatgttggccaggctggtcttgaactcctaacctcaaatgatccacccacctcagcctcccaaagtgctgggattacaggcatgagccaccacgcccggcctcccctgcacttttcttactttattcttccaggattccaattacactcagctcttagatgctctgttctgctttattcactctttctctctttgtgttttagtttaggaattccttaatgacatcttcaagtctaccaaatctttcctttgatatgtcaagtctactgataagatgaaggtttcttcatcactgctactatgttttccattcctagatttctacttgatttttaccatctatctattgaaattagcctgctgatgatgcatattgtctgtgttttccagtagagcttcaatatatgaattagagttatttcaaattctctatgtgatagttccaatacctatgtcatatctgattctggttctgttgattgctttgtctcttggtagtttccttccccccactgttttctcatatgcttaataactttttgctgaagctcgacattttgtccaaaagagtggagactaaatagtttctaaacctaagaataggcatgtttttacttctgataggtcgttagtgtggaagtttgagcaatgtagtcagtagttgtgctgggtttgggtttgttatgcttgcactctaccactggcttccacttcctttggttatacttgtgtttagagtgaggactggtttgccagagagtagtctgtttcactcccatctttagggtaatctcttcacactgcaactctctgttagtccatttgcattgcattcctatgtaaaaggaaatcctgaggctgtgcaatttataaagaaaagaagcctattttggctcgtggttctgcaggctgtacaagaagcacggtgccaacatcttctggtgagagtctcaggacacttccactcataggggaaggcaaaatgggagcaggagcatcacatggcaaaagagggagcaagaatgacagggggaaggtatcaggctcgttttaaacaaccaaatcttgcataaactcattgagtgagaacttactcattaccacaaggacagcacaagccattcatgagggatctgccctcaggacccaaactattcccactaggcccacttccaacactaaaggttatatttcagcatgagatttggagatgacaaaacatccaaactatatcaatctcggagtctctacccacacacttttgtaactctcaaagctcttaatcactgttagatgtcactggaggcttttcagcccgggagcgtggtggtaagaggagcattgctgttctaattaagccttggttttaggcgaattatgtccttaggtttcagaaaggtggctgcctccgtgttccagtgtttcccacagctgtaattctgggaagggagtagagttttatttttaatgcttcttatctctagctgcaatggctgttccctagttccctaagacacttcctcctgcagtttaaagcttttctcccaaggagaattaggggagggtgggatacaagcaggacttcttgtctttcctgcagtggctgctgttctcctccccatgttttgtacaatgaggattctaccacagtcatttttttgtgtgtgcatgagcttctggtggggcccaaggaaagagcctattctgggtgcaaatttccctgttatcttgccccaaggttttctacagtgagaatctacaagccagttaaaatttgttttatgcctgcagccaactgaaccacattccttctttactaatttgttaccaggtgagcaaatgctagcttaccctctctccccataggcacatatctttttttaggttttaagttagttggtattcctgcaatcacagctctctgactagttcaagaaaagttatgaatttgcaatttgtccaattcttttttaatgctgagagtgggcataatacttttttattccagctttgttcatcccaagcaaaagttggaggtctctgaaacttaatttcaaatagttcagcaaaaaaaatgaaaagaaagagaaagagtaaatgaaagagaaggagaaagagagagagagacagtgagagaaagatacataaagaaagagcacaaatgtggcaacatatcaagaattaatgaatcaagatgaagtggggatgggtattcataatactttccatttctgtgttgacacacaggcagtgctcaattaattaccttgaatgtaattaagacataatttgctgaatgacagtattattcttgttattagttcccaccaaaatagatgaatcaatttttttccctttctagtttgacattgttaccctaagatactaatcctgctgactctatttttaaaatccaggtttactaaatattttatctacttatctgtcagcaatgtttcaactagaatagaaatgcttttgcataaattcatcactcattgagggatcagctaattggaaagagcattagatatggaattttgaaaaacaggcttaaatgcaagcttattcatttcaccaatatttatggagatcttacagtgttctattgattgtatgagaggtttgggagtgaatagtagctctgctgcctctcagtcccttgcacctgcacacatttatatggtttgagccttggtctccacctctgtgaagtatggataacaacgcctccctcatttgtgagagttaaaatccctgttatatgataaagtgctttgtgaatcataaacaaatgatccaaaagcatattattctaattctcttttagtttcttcctcacttgttcttattttttttacttttttttctttgcatttttgtaatgtccttggccttggtttcttactttattttattatgactgcttacactgttgtagtcatttacaacttcatgttaatcaaaattgtgaatttcggcaaaggcaacagtccctgcctagtgtatgaccttttttcccctttgatcttggcatctgaaagctttttatacattctaattctcttccattttaatagctctgtgaagcagtactattttctttgactgataagatcattgaaggtgacctgattttctctagagatgcacaatgaataaaacacattctccactacacaactcacttactcacatcccatgaagggggaaaaatcctgaggttgctctctctctataaaggtcacagaaaaaggagatgacttctcagatattgtgattatgcatgtatcatcaaattatgcaagctgcttattattccaaatcttaggggtttttttgttatttcatcctgttttacataaaactgagtagcaaaagtggcaaaacaaatatagcatttgtctttgtttgtgtatttttaatgagccgaataacacaaacaccttaattttgagggtgcatcttgttgagacacaatattatagatacctgtttgtacttgtgtgtatgtgtgtctccaggtattacatttatgcagttttcagttggaaaggtgacctctttctacggagtatgtgccctgcacatagggtttatcccttgtgactggtttgtgtgttaaggattcatggcttaaacagctaggttattcatgggtgtggaaaattgatatttgagagcattttattctgctcagtcaggctgattctttataaggaatcaaaacagtgataacatttaccaaaaactactgaatagaatattcaatgtgtatctatgccacacattgtttctttccatacactccatcataaaatacctcctctgcctatcatcgctctgacaacgtcactgccaaacccctatcctcatacactcatcacagaacatctcttcattttgttcagaaactgtgcttttttttcttaatcgttctgcttttcaaagctttattctttctaggcattcaatatatattgaataatttcaaggtatttttatattcattcattctactaatattttcttaactattttcagctactcttctaaacatcttgttcaggaattgtggaagaatctactcactgttttgtcccaatatccaagggagaaaaataaaactagctcaacatccctgtgcatgaacttttagtaactttatttccccactagaactggaatctgatgatgagcatctttgttctccagatttcaaggaggtactccaggtagctgactttccacagagccctagaaagtaaatcatggaggtgaggatactgttctctgaaattaatatagaactatagttacttggtagtttatcttgagcaagtcttgttaattctactgtaattcaaaatggtagtatcatcctaggaaaggatgacaaacatgtagttatagtgagtattctcttggtttaaatcacagcattaatcggcattctgtattaagaaaaaggcaatcatttgcccacattctccttttccttagttttttttttttaatttttagcttcagaaatgtaactcatatacaaagtacgcctatagttataccatgtatcacacatttcatatgagtaaaagaacagaaaattgatgaaacatgcctgaatgcttgtgatataaaattatatttcagttccagctataaaagtgtaatacaattgaaatgtttatcatgcatctatgaatattttttcttgcatgcataatggtgttgcatgaacaatttaatttcttttttgaaaaaagtcatcctagagaggtctattctataccttttcgacagattcatctaaagaccagctctataaatgtccagattgaatgcataaaatgtattgtctcaagtgattattgtttaaaaaaatttaactgtattgttaacttactgaaaagcactggcataattccgcaggcatggcctcttttcttcttatcttcatgtgtgtgctaatgttgtgatctttttaaaatgccaagatgaactgtccggtatacgaagataaaagattttaaaggcaacgcataatgccactgaattcctattgaaatttacagttttcaaagaaatagtattcattctaacatcaaaattattgtcagaaaaatataaacatagtaaaataaaaggcacctgtgaatccgaagctatcatggttcaaactcttctatgaaaacacaatggcactcaaagacttactatggcttaatatctattattaatcaattagtatttttcattgtatgaaaaatttataactaaaattttaaatttaaaaagaaatggattgattagaggccaggtaatcaggctcttggccatgaccatatttttttttttcagtattagttaagtaccaaagtatttcacaaagtccagtattcaattgattgcacaatacacaactagatttcatatttttgtaatccttggcattacttattttctgcacattctggacacattcctacatttttatttaaatggcttttacatcttataaaaagagtactttttggattcaaatcccttattccatttctggcaaccttccaagagaactctagtctgaatcattgcattgattttctgttgctgtataataatattaccacaatcatagtggcttcaaaaaaaaacacatttattatgtcaccttttctgtgagtcagtagtctgggcacagctcatctgagtttttgcttcaagttctcatccgaaagctacaaccaaggggtcactcatgactgggttgtcatgcgatgactcgactagggaagggcctgctttcaaactcatttggttgttggtagaactcagttactgattgttggattgagggcctccattcctagctggctagcggctgaaggccattttcagttccttgcaattagggcctttcctacacagatgcttgcttcattacagtgtgcaatttgagtaggtagtagagatactctctcacaagatggaaggtataatcttatgtacctggtcatggaagtgatatctgtcccattttctgtgttttattggttagaaataaggcacaggttccacctacactcaaaaacaagggatgtaacagggatatgaatgccacgaggctggatcactgggggtcatcctaggatcttcccagcacactttttttgttttacatttggtagtttggtaatttttccaaatgaatactataaaagtgtaatagaagaagtagtatatgtcattgaatgtagttctaacccagaaattacagtgaaggtaacgctcatatgataggatgggcagtttcattattatttgtcttgcctgttaccaagcattctaatgatgtttcattgagaagactgttctttgagattagtatgtatcataaaaatgcctctctttaactaaattgtggatatttgtctatgaagttcaggtatttgttttcataataggctgtatttgaaggacacaaaaatttatataaaaatactaaacaaactgaagcccaaatttgttactagttctagtgcaccaccatgacatattgattacactgaaatacaataatgactctcaatatggacatctgaaaattaataataactatttgattgtcctaggaaatgatctggatagctaaatatagtctgactgaaacttacgtagcccaggcattaagtacatatttgaatgggcaaatcttatgaaataatgcattatttactagaacattttccctactggtattttctactagaagtccaaattagggaatcatatgaggatataaaattaattcaaatatataaaaatattttggctgtgtttacagcattaggaacaagctgtactcattctagcattacgttaatgtacacttggtaggcattagaggaataaacagttctaactacaagaaacagtaaaaaataagatatatatactcataagtcttctcattctgttaagagcagttagtaaagaattatttctaaaatttgtgaaataattattgctcataaaatttttagctaataagaaacttcagatggttcagaaggtaatagaatatgtcctatttggttcaggaaacttaaaattccttctccttaaaagtgttggattaaggcgtttcataatttttgaaaaattttgtatttattggcagtggtttttacacttagagattcttatttcttccacagtgaaattgtttatttaaaaaagatgtttctaaaatatgtgaagagaaaaaatagtgcaaaatattcactttgataccaagaagagctttgattatacagatactctaaaaaggtattaagaacctccaggggttccatttccacagtttgataaccactgcattagcacaaatccttggaagtatgaaacactttgtctgtgtttggtataaaggccactgaatgtgctaatctatgtgaccttggcatgtagtcagcatctgttaatagatttcaggatataaatgagatagtgcatgtaatgtacttacaacaattaatgacacaataaatattatgtgttagaaaagctacatgtagcatagtaattgagagtacggactgaagactgcattggttcaaatccttgctgtgcccctctgtaagcttgaataaattatttaatccctgtacctcacttttcccctttgtaacattgagttattagtaataacaacttgtgagtattatataaatgaaaaacacagtgcgttgatcacattaaacactatgtaatttaaaagatcattgtaaattatttagttcctagagacagatgtattcttaatacattttaggcctttgttactttcagtcatttaacaaatatcaattaattcacctactacatccaaaacaattcaccaaacagtatgaagaatacaaaagggaatataaatgtgatttttgtgatggaagtgtttattgtttaatatagaatataatatattcacatataagtagcatatggaagaaaacgaaagacagcacaagaaattaaattctcagagaagagaaaaaaagtaacttctatgtatttatgaaagtcattttaagaagtattcagaaggttgttagaattgagtcacagagatggctgatgttaccaagggttacttatcattggaaaagagattcataggtacatgtttaaatatggaaatctttcatatcttcagacgttatcgtcagctcaaacccgattttcacagatggcttcacacactgcaactactctctcataattacttatgagagaaaatgacctgtttccctttggccattttgagaaactttcaggaaaaaaaaaaatctttaatttagaataacttaaatattgggccttacagattgactggcaaagtcaaatccaaatgcaagttatttcactactctgcatcccacttaggtgtttttctttcgtgaattatttcctgggagttagggctctttcatcttttatttgcaaagtgaaaagcaaaattgactcatcttaacttctaatttagctttctgaatcggaaagacaacctgaaagtggctgtggggaggagcgctgcttggtctagctggctggagaccttttacagtgtggatggagcccctttctcaatggttaagtggctgccacactcagtagcctttctgaagtcgcttggtcccattctttttatttttttctttttttaataaaggggttaaaagaaaaaaaaaaagaggtaagataaactgcccttgacagtatgattcctttcccttccctctgcccaaatacagatagaaaggaagtctttccatctatataaaggcctatttcatgttaccaaagaggaaaagagaagttgagaaatgcagccaattaggagaaatgagagcaaaacaggtagtacctccgtgtgtcctagcaaatggcccaacacgaggatttttacctattttatccacatagaatggcttgcgaaaagcctttgttgttgttgtttttacaattcatagacttcccactgataaattccaatggtcgattttccccttaaagtgaaaaccttcctttgggaggcaagcaactcaaaaaaaactgcctgatgcgtaatgaagtatgttttttgtaacccacaccagttctatccatacatactttttttttttctttctgacaccttcacctcctgccttacgttcctttgagctatggaagccaatgaggatgaaataattaaagtttgtgcctgctgtacaaaaatcattctccataggctctgtttttatttgatcttttgtagaaaacatagcgtctttatgtacacagttataggcccatggtgtcaggctacaaaggcttcatttcctgctatccagagtcctggtgttattctccaagcataaattctgtagtttccctcctctagcccagcaggtgtctgggtttcatttttggttgttacagttttcatagggaggctggggtggtctgaagtgtcacagcagggatccagcattgcccctacccaaaatttgctacataatttgtgaggccaagggaaaaatgcaaacgcaggacctcttgttcataaatcattaagtgggtgtttttaaacacagtgtgctgtgaagccacacaggtcagatgcccaagaagctggctctgcccctactgtgccagtgcctcctgggcacatggatggcagggaccctgtgtgttgcccttctgtgaaacaagaagtctgtatggttggttgggcaccgtatggttggttgggcagtctgttctttcctgtgcacttcctgtacctcctatggtggtccacacctcgaaagccccacactgcaccaccttccttggaggacaactctattaaattctgcacacccgctacccctgccaaatcttactcttttttttctatttaaatgccatttattcacaccccctgcaaatacatacatgcaaaatccttcataatgacccaatgatgcaagcaaatagtcaagcaatgcttaatagcaattgaaaaaccatatccccacctcaagggtagagaggactgaagtctttatgaactcaatggctagtctgcatccccagaactggaggggaatgcttgcatttcttcatttaagacttctcccctcctcctttccagaatgaactgaaagaattcttacaaggcaccacctcttataaccctgtcccccaaaaggagatttttatattcaaaaacattgtacattcatgtattaaggcttttagaattagcaaggactttaactctttggaatttgcagaagttgataatgcaattatattttttaaaagtttacattgtaattgctttagaaaaaaaattagtgatactgcatatacggaattagccaagcctgtgtacacttgctgtttctgtggtctccatggactggaatttggttaaaaaggcaagtttatcaattgaggtttttaaaaatgcctgctctttcaacaaacccaacaataaataatgaaaaataattaacactgtaatatcaaaagtgaatattgccaaggacaaagataaatgatagccaaaaatacagtgaaaaatctcaatttaaatataggaaaagagaacttggcttctagagaacagcaggtttcctcccaagcctatgctgagtaatatgatatgaaattgttaccactgcttttctattagaaatcttccaattcagttttctttattgacccaattccctggtgtttagggctaggctgcttttttctgtacacatgtgtgattgcttatccgtctagcctaggcttgagttattttatttgattggtaacacagacctggcagaagcttcacctttggcatgcagatgtccacaggtgatgtgaaaagagattgaaaaaggcatttgctgataaaaacaaaacaaaacaaaacaaaacaaaaaaaacaagctcagcatgatttgattgccatctagctacaaagtgtagctagaattgatacagtaggccagaaattataattatatccgccttacaatttcagaacagccatgtgacccaagtttataattgttggtgccataagagacaaaatagctgagtaaaccactcctacaatgtttttgaatataaaaatctccttttgggggaaagggttataagaggtggtgccttgtaagaagtctttcagttcattctggaaaggaggaggggagaagtcttaaatgaagaaatgcatttatacaaaacattatacattgtacattcatgtattaaggcttttagaattagcaaggactttaactctttggaatttgcagaagttgataacgcaattatattttttaaaagtttgtccaattccttcctgaatcctttaaagtgcttaccacattcacttgtacatcctgaatagacttagtatttgtttaataaagggatatatgaaataattttggactgttagagccagaactttagattatatataccttgactggtattacattgcctccttcatgtcgactccatttcattatctgtggatgcttgcatttagtactaactgcaatgagaagcctttgaggccacatctgaacccaatgggaaagaatcctgtgattgaatagtaatgtctgccaaacccaaggaagagaaaaaaatgccaccatctctactataaagtgactctcctccaccagaatgtgttccatcccctctttttacaggcaaacaaattggggatcagagtggcaaagcattctattgcatatcacaaaattagtagcaaaatgatgatatgaatttaggttctcagactctggttgtattagtcagctcagtctgccataacaaaataccacagactggctgtcttaaagaacagacatttacttctcacagtcctggcagctggaagtttgagaccagggtgccaacgcagtgaatctggtaagggctctcattgatttgcagacggcagccttctcactgcatcctcacatggcctttcctgtgtgtttgcacaggagaaagggagagagaaagagaggggagtgggagaaaggtctctgatgtctctttttataagcgcactatcccattcatgaggaattcaccctcatgacctcatctaaacctagttactcctaaagtccccacctccaaataccgtcacatcgggggttaggaattcaacaaatacattttaagagcacataaccattcggtctataacgttagtcacatgcactttatatgtcacaatgtctcttctcctattaggctgactctagttctctttttactgaaaccgccttgctttttgtatcatcgttttaggcttggagaattctaaacagcctctaggaaatatacatggttgagttgtttgacaggttatgaacacattgtgatcaaatgcagtgactgtttataaaatgggtgccttgcagaggagagtttaagcaaagtttaagaattgggaaaatccttaatcacatctctacagaaagaaaaaaagctgtaagagaaagcagaatggtacaggaaatactcctcagagaacagcggtgagggagggataatatgaactacctataaaatatgctcttgaccaaccatatatcaccttcagcctgttctttttgacgcgtgactcactatctagggatccccttctgttggctcacttggcagcctctgagattagttttcccaaagcaatttattacccaggtggtgggtacatgttacataagtccaaaagtcatttctcaccacttttcttgtcttccttttattattcttttaaaatatatgctacttctacttcattattttcaaccatctcagagcatgttgaaagtattgacatgtactttcagcatgaggaaaggaagttactgcagataacataagaagaaatatgtgtttagtctctgtccctggttctaatactgagctcctaaaactcttacaatttccttagtgatgagtgctatgagcatcttttgtcctagtatttgttttttgtccctggttcctgacacagaactctggagctcctgattccagagcttggaatttcctggatcataggagtgtcatttgttctaatgatgtgactcatggtgggctcctggatagcttcagaatgggagctggccactggaaagcccaagctgttagtagaagcttggaactttcagtcccgtctcccatcctccaggaaggggagattaggttaataattaataatgtctatgtgatgaagcctcaacaccagtccctagcctatgaggtttggaaagtttctgggttacaaatgcatccatgtgccaggtgggtggtgcaccccaactccacagggacagaatctcctgcacataggacccttctggatctctccctaggtaccttttcagccagctgtttattcgtatctttgtaaaaacctgtaaatgtgactaaggttacagcaaattatctcatcctagagggaactgttgaaactcctaatttgtagccaagttgagcagaagtgtggacaccctgggtacccaatacttgcaactggcacctgaaatggagggtgttcttgtgggattgaactcctaacctgtgggggctacacttactctaggtagtttagtgtcagaattgaattaaattgtaggacacatccaattggcatttgcagagaactggagaattacttgctgtaaaagaaaaccccatacatgtaatgtcaaaagtgttgtgagtagaataacagctttcttttactctaaattataattttttgaaaaatcactgttacagttcacattctgatcacaataataggtaagcagagcctcattttgacacctacctactttattgcggtgccgtgctctagtatttagtctgtatctcaaataactcttcaatctgcctcgtccttttgatccttttaggtcagtccttcattatctcctgttagaagtctcctaattttctaatggataagctcatctagtggataacaatgggataatattcaaaattcttacatggccagaaagccttcattgattcttttctgtagggtaccaccaattctcacttttctgaagtgcttatctttcccaaggcactaggattttaatttctctacatcttttttacttgctagtgcctcttcctagaatttcttcccttaccgtgtatttctagcaagctactactaatctttcaaaacttaaaattaatatcttctggccaggaagctatttcctgtctagcattctggttgcaggaaactggagcccacatggaccatactatacattatttgcagcatttgtaggcaaaggtgcctcatttgctgcaaatgtataatggaccctgtgctcattgagctccatcttcagtctacagagtccagaactgctttcagaagttctgttcttctggaggtaaataaatggaacctaagtccaaaattatttatacattgtcacagatgcacacctgctgctaggcctcacatgtgcaccccaacaacaaagatagcaatgacaaccacacacacacacacacccctgttgtgctcatatatgtataaatacactcattgtacagaaagccttaaaactgcccttgaatatgaaaataagatatttctcttttatttttgtcctcccttatccagcttagaattagtctaccttcaatgcatccattattgcttcctcaacttagctcacccacacagcaattaaactccacgtatttgaacaactcaaaaattccatgtgtgcaagaggctaagtgcataagaatcctagggcctagatgacaagaattactaaagaaacgtagcccactccttctcactcttttgcagttttgtatgttatatgtacattagtatgttacatgtacattaatttgcctgaagttgctgtgttggcttaatggaacaccattgccacctgctagccatattgagctattaaagtcctgcaattaaccaaattaagcgcaggttaacacaatcaggttttgctgtgctattgttttaaataacttttacgtatttaaatttagagtgcacagtgtgacacagcttgccatttaatgactcagcatgcatacagtaacctcagctaaccagcattaagtggaagtattatgtcttggcactgaagaatatagactgacatcaaaaataagagtttcaaggctcagttccaccatttgttagttatatgatctttgataagtcacttaacctgtctagactcacattatttaaaaaggtaaaaatagaataatagtagtgccttcttcatagggttgatataaccattaatgaaataagaaatttgaaatgcttacgtgataactaccatatggtcacaatcaatggatgttcctgcatattatttctctagcgttattacacctttcttctgattgccaaatatgtaaattcaactgtttctctgggcctccattttctcatgaactctatggtttaatttataaatatgttccaatgtagtttcatttgttttataaaatacagtccactacaggtagtgctccatttgttcaaccttatttgtatatgatgcagtccactctgtgaacatcagatttcaatcatcattgccttcccactgcactcacttttataaagtcaaagcataatttatagtaaataaaatacagtgatcttaagtgttcagatcaatacgttttaagaattgtatataccatgaaactgccatccaaaacaagatatgaaacgttttcttgtatgtaggaaatgcctcatggcttttatctatgttttttttccccaaagcatgtgttatccttatgcaggccctatgctaatctctgcatcatgtccattttagttcacgcaaccaaagtagacatgacacattgcaattctgatcacctctctttttctcacaaatccagtagaaattataaagaagaaaaagcaacaattaatccagaaatgctatttagtcaattgaagatcaacacattctaggtgagcgctgccccaagaatgtttaaagggagaaatcttttaaaataaaatgcaactataacattattgatatttttaaagggagacaacaggatatctcttagagaaatggaagtacctgtacagggcatcatgttctcagactcctcacttcagaatctgattcttagctctgtggacttgggagactgggttttcttagcattctcagagtggatcagatctttatggagaaaaacttgcaaagaaaatttagaaaacatttacatataaatcagaaaaatgatatatttacttacattaatatattaatatgctaataatgtattattgtaatctgctgttttcttttttcatttaccatatacttacatctcttatctaggattccctgttctcaacctttagttcattatcaccctcctctcctcacaaaggagacttttgagaccactgccaatgaaattttgatactgcatttgtattgtttatctgtatatatctgtttatgtatttctgtgccttatacatggaaagtaacattttctttcatttctcccaataccccagagccaattttcacctccttgggggtgatgtcaactccattgagaacatgtatcttattccttttttcctgctacctggcagcatgagatgttatattaatcctgtctttttattttctgtacttttgatgctttgacatctagggacttgctgactctggaaagactgccctttccaaagttaggcaattcttagagattaaaaaaaaagactccccttccagcatccttttcatatgcctttaataggcaaatcaaacaatctactacccacatcccaaccatctcctttactgatcctttacactccacgccaggttcagcttgtcctaattattccggggccaggttccagacaactaaagacagcctctgcaccccagaatctgaagagatgatccaactagccatttctaagccttcttacattgtattcttttccatggaaacctctatacaggctcttgcctatgtttttctccactttctctgcctctaaactgagcctggtgattcctctgaaaccctgcatggtgggtcctgccccctcctcttgggacctgtgaataataaaccatcttttcaatggtaatcttctcctgatttcttgggttcatgatacctgaatagtaataaaacctaaatttaaaaatacctatgtatcagggagttggttggccagtatggaatatgaataatcttgagagatatttgttagagttttgatgaagacttgtaaattccccctgttccttagaaagagtgctgtgaaaacactaccaaactcttgttctttttacttttacttttcttttctgggtctatacagacatctttatagttaattgactttttagtaaagagtaactgattaaactcatagcctttgtttaggctccacctgattctgccttcttagtttaccttttgaatgaaactgagtgtctccaaacattttcaggcatatatttatagtcaactcttgtggctattttgacaggtggttgacctcattcattatgtattgaatcttactattctcacctttagtataatcttatttctacatttttgggacacatcactgaaaccttctgtgttccatacgagacctgtaccagatatctctgcagccaaagagaagttttttttttatttttattttttcatgagctaacacaaggcttgcacaaaactcagcagcaagtaattcctttcttgtccagtatgaaaaagtgctgtctttgtcataaagcaaaaagagacaatgaaaggttaggttcttattgccccatctcattattgttaatgcaaaactagactaatttgcttgtggttatggaaatacctcctttaaccttggtgactgaatcagaaagaatttgttttggagatgggcattgcttaacagcatttggcatttgctcaggctgagcattcatcgtgagagtaagagccttctttccttctttagtgtagtaatctctgcagaaatatcacatgaaatatggtgcagaaaaccttcagcatagtggctgggatagaggcagtgtgctttgagtaaggctcttcagttggggcctgcattttctctggagccaagatacttctgacctcagcaaatggcttaactgctctgataaaaagtggatgataatgataacacttccttcttttcagatccataagaagaagagatttttttgtttttgtttttgtttttgtttcatctcctgctgtatgcttggtctctaaaagtgactggcagagggaagacaataaatatttgttgttgaatgaatgaagtgttatgatgagggttaactgacattataatgcaaagctcttggaccaagacctgacttatcataggccctcgaaagatattccttccaaaaacaatgacagcaaaaacaaaataaatgcttcatactcaataaagtgtctggtgatgggtttataggaaatttagtaattttaatattaaaaactaccatttacatcatctgattatttattcgccaaatatgtatcaagcaatcactaaataccatgcattattgcaggtcttggagatttagaggtaaacaaaaatagccacaagtaaaagctgtccacctataaaactttctgcccagcctagcgcaggttagagttcccatatgtctatcagtgatcaatagctgtgggagaagaaacctgtagaacactgaaaaaaataaagcattcagatcattaacttttttattaatcttttgccatttgtggatctgtcagcttctctaaaactcttgagatacaaaagcattatctctgagacaagagataattcccaagctctcctcttgattgcccacgtttgcctgagagaatttctcaaccagttgtttcaggttatagacataattggctattagtcattgcagtgccattgttcattgacatacctctcagcatcatctctcacccatctgcaaagcaaggtcctggtttctgattaatctttggctggtcattgaggatactgaagcagctcctggttaattagaccattttgtctctaacctcatccattctctggatgtaataatagggatagaggtggcagcaattgtaagcacagccctgaaaacttgctaatcggcctttgtgatttgccaggggtgccattgtttaaattgttaaagccaaattgttgtgagaggcagtaagtgggcatttttatctccaagtcaattacacacatttagtgaaacctaaggagctcataaattaaaagtaaataagtaaataggaaagcagcatctacaacacttagtgatgtaagtcacacacatacacaccacatacagggtgataaaatagcaaaatgtgcacttatgtggagaggaagcccacgtagtgataaggggtgagggctcctgagtttaccagctgtgtgaacttgggcaagtaaccgctctctgaaccttcttatctgttaaatggaagtaatattaaagcctacagggacatcaaaaggattaaattacattaatattttatgttatttcattaaataagattttataaactatctcaaagtctgctctattacgtgtgctaattatctggtagttactattattctagaaaagcatcctatcccccctaactcatgcaaagaaacaatgaacgtttccaatacttcacattaaaaaaattactttgacagtatccacaggaaatcaggtaaaaagcaaagacagacaagcttagctctttccactggactttgtgagatgtgtctagttgtactagagttcaggcgagcattctaagagatgctggagggcagaaaatgaagtgaacttcattctatgaagcacttgagacttgtctttcccagtatttccccatcatctctcaaagaactgcctattaataaaaaacaaacaaaaaaaacttattccttggtatgctaccaaaaaaaatattcttcattcaagtaagtttggaaaccactgagtattacatttccctgtgaagaatcataatcattattttggtgttaaaaggcctgagaaatcaggaaaagctctaataaaaggaataaaaagaatagctttgaatcctttaacctaatttttcaaaaataccccacacaacatgtgttaccacacaaattgcattttgaaaaaatgctggccaggcacagtggctcatgcctgtaatctcagggctttgggtggccaaggcaggtggatcacctgaggttagggattcgagaccaacctgaccaacatggtgaaacccgatctctactaaaaatacaaaattagccagtcatgggggtgcatgcttgtaatccctgctattcaggaggctgaggcaggagaattgcttgagcccgggagatggagtttgcagtgagccaaggttgcaacattgcactccagcctgggcaacaagaacgaaactgtctcaaacaaaaaaaaaaaagaaagaaagaaaagaaaaaatgctgagctacaacatagtaggttgaagagtgtcctccaaagcatccgcacccactcagaaactaagagtgcgatcttatttagaaacagagtcttcgcatatgtaatttgttaaaaatcttgtaatttgttaaaacctggattttgactgggccttaaattcagtggctgatgtctctatgagaaaagaataggacacacagattcagagaagatggtgacgtgaagatggagacagagattgaaatcatgcatctacaagtcaaacaatgccaaggattgctggcaaccaccaaaagaaaccagaacgtcatgggatggtttttccttcagagcctccagaaggaaccaaccctgctgacacctcggtttcaggctgtagacttctagactcctgaaccatgagagacaatatatgcttttttttttttttttttcctgagacaaggtctccctctgtcactcagtctggagagcagtgacaccatcacagctctctgctgcctcagccacctcaggtccaggtgattctctcacctcagcctccctagtagctgggactacaggtgtatgccaccatgcccagctaatttttgtaatttttatagagacagggtctcaccatgttgccaaagctggtctcaaactcctaggctcaagcagtccccccaccttggccccccaaagtgctggaattacaggtgtgagccaccacacccagccaaatttgttgttttaagccacctagtttgccaaaattggttgcagcagcactaggaaactaattcatatttagtatttttaaatggctatttgaaatgtaaaaaaaaatgccatgaaatatattgcaattaaaaactttgttctctctgctgcctatttgttttggttccattttttggcaatttgaggtagaggaattggaacacagacgggaggagataagaagcactctctgctaagtgagtgattaagagctcactcatggctcaaaaggaaactctccattatattttctattatcacttgtgttcttgtcaatataagtacttgccacttgtgaatcattttggcgtttgcaaaaactttcttaaacagtcaatttcttccattctaccaccaaaagaaacaaataaaataaacaatagacaaatgcaatagcaatgtttactaaaattaagtttttcactctgcttagctttgaaatctgtatggaaaattaagataaaggcctacattttcatagataaagcggtagaaaactttgtttttagacatatatatatgtcttttttttagacatatatatatattttttaagatgaagtctcgctctgttgctgaggctgtcactgcaatgttcacctcctgggtttaagtgactctcctgcttcagtctcatgagtaggtgggattacaagtgtgtgccaccacgcctggctaatttttgtaccgttagtagagatggggtttcaccatgttgaccagactggtctcgaactccttgcctcaagatatctgccctcctcagcttcccaaactgccaggactacaggcgtaagccaccgtgcctggctcagcatgtatttttaattcagctctttggagagctgcatctactgagcactgcgtgggcttagtctcactgtgtagttgaatcttggtggatggaggccatctgtggtacctctaaagctacagtaagaacagccaatgccatggcatcaaaggaagccagaggcatttggaccttttggggtctggcaggcaaataaagaaaagactagatttggcctgagtctagtttcttctcatctggacactagctcatagctcataactgggctctcttttttaagctccataaatgcaagcatgacatgcatatgtgtatacagaatttggacatgttttccaaattgtaaatgtgatcacagccttaagtaaaatttatgtctcccaaagccctcaggattagttcctcattctttaaggaggctcaaaataacttcatgtcactttggttatctctctagccccatttcttgtcaactttttccttaagaagaataacttgacttctctaaatactcctttatttctctcagggcatatgcatttacttaccctatactctttcttctttctttccctttgtttctttcgttctttttttctttttttttttttcccaaggtctgattttatcgcccaggctggagtactgtgacacaatctaggctcactgcaacctctgcctcctgggctcaagccatcctcccacctcagcctcctgagtagagtagctgggactacaggcaccactgtgcccagctaacattttgtgtgtgtgtgtgtgtgtgtgtgtgtgtgtgtgtgtgtgtgtgtgtattttttgtagagacagggtttcactatgctgcccaggctggtctcaaactcctgagttcaagtgaaccactcaccttggcctcccaaagtgctgggattacaggagtaagccgccatgctcagcccctattctctttctaaaagaatccatttgctctttttttccctatgattgggttagcatcatggcttccaatgtttgactgaatggttttaaattctaccctccatgaaacgggaaaattagcttttttttctcatggagttttgttgagatttgaatcagataataaatgccaagttactacatataacagagagttgtcaaaaatatcatcactctcatttttcatatcccagcttaactatcattggaactgaaaaacactccctgaacctcacaagattcgattagataaaattagctgtaactattagaacaaccccaacatcaattcccttatatccagtagttccacttctagaaaagtttgctaagaaagtaattctaaatttaggaaaaacttttattattgcattatttataatagaaaacaaaaatatggagctacccaaacattttcacttcatttagacttatcagtcttgtgatggattgttagggaccttctgaatcatattattccattaaaaataaaaattcacaaggacaaattaatagcatagaaattcctatgttatattgttaaccgaataacagcagggattaaaaattgatgggatagtatagaaaaaaaaatcctggaattacaggtgcaaatatcttaacagaattattttgtaatgtaataattgggtattttttctctatttttctgagtcttgcaaatattccataataagcatccattacatttataacggcataaaataataaccttaatctttaaaaaatgctagtggagtaaatgaaacttttcctgcattttcttgccagttcatgtcgctggggagtgtcacttatttctcttgtctgtttccctatggtgaaaaacatagaaacatgttgataaagaacacaaagaaagaatgcatgactaggaatgaggagaaggaaaagcttcatgcatactcagctgtaacatgtttgggccgggcgcggtggctcacgcctgtaatcccagcacttcggaaggccgaggcgggcggatcacgagctcaggatatcaagaccatcctggctaacacggtgaaaccgcgtctctactaaaaatacaagaaatcagccgggcgtggtggcgggcgcctgtagtcccagctactcgggaggctgaggcgggagaatggcgggaaccccggggggcggagcttgcagtgagccaagatggcgccaccgccctccagcctgggcgacagagccagactccgtctcaaaaaataaataaataaataaataaataaataaataaataaataaatacaaataaaataaaataaaatttttacaaagtcaatgtaacaactcagggaaactatttgtcttcaaacattgaagtaagaaagacaggaacccaaattcagaaccagctgaaccttgaaggaataaacagtaaatgtcaagggcttttctcacacagggaatgaaccggttttcctgctcataaaagaaaacaaaaatattgagtatgagtctgaaaaatatgaacttcctcatgtttgtcatctccataaactatccctgtcattttatctttttactgagaggaagataatttagcaaaatgaagcacgggctgctatttcattttcttattacatatttgaattcagtctagtataattatggtgtttatgaagtttaaactgatgtagcaagagagtaataggaagaataagtgatcatccactctcaacatgataaggagcatttcttgataagaaagttgactttaccaagtacaggaaatatgtaagaggttttatcagacaataattttaatttatgagatgctttcattgtgttccactaagaaaatatacatttatttctaaataagttagttttaaagcaaagtgagaacaacagtagcaaaaatgtctcacagttacagacacaggcaaaacaaaaacaaaaatacctgcccccatctgtgagaaaagagctcacaaagaaccaggaaattataaatgagcagatttgcccttggctgtaggcaagatccctgagacagtaataagaaatgaggttaccaaacatccagagagatatgagctgataaaacttaatcaggctagtttcacaaagggcaaatcttttctgacgaatttggtggcatttttgcatggcacatggggcaggagaagtacgtgacaggaatgcgggatagaattcaactgaagaaggtagaaagccatggatgatacacatgaaaatgaggtacggtcttagctttccgaagaagagcacttgggagacgtttagcccaaatgcgttgatttcatgaagatatttatgttgacaataaacatgaagcgtggttgatggactggcatgcttagcagtgaaaccacggtagcaaaattatgtctgttatcatcaaataatgcacgcttggggtgcgtatgtatgtttgccattccagattttttttagagtattctcatcagttatttgcagtcatgcactgcataataacattttggtcaatgaccgactcccccctatgagatggtggtaacttaggattataataccttttctatgtatagatatgtttcgatacacaaatactccccattgtgttacagttgtctgcagtactcagtacagtaacatgctggctgtgcaggtttgtagcctagaagcaataggctgtgtaccatacagcctaggtgtgtagcaggctatactgtctaggtttgtgtaagtgcactctgtgatattcccacaatgacaaaattgcctaatgacacatttcgcagaatgcatttccatggttaagccactcatgactgtatttactttttccaaatgtttatgttattagtatatatagagagagccaatgacatttcagagagacacactcttatctcaaagaggaaccaatgggccacactgcaatatctcaatgataataataggttttacagcatttctagcatctttactctgagacatttttaaaaaacgcttttagttgttttgtgtacttgacagtaggctgttatttttcaaaggttaatgttgaagtgttctaaaattgggaaagtaatagggtcaaatacccagaagttcaaaagaaagaatctgagtttcctgcttagttggtccctcagcgtcaatgtacaaataggcttgtctctttcatcttaaaaagataaataatccaaactgaaatacatacatacaaacaatttctctacctcctgctgttgtttctgctcacctctcccttctctttgctgtctgacttctttatagagcaacctgtacaccattccatagttttatttcagttcccagtttatctcaagcttggcctttatgtctcaattcatcttgatttgagagtgaaatttctcccaaagaagaaacaaggactttctgatgatcaacattagtgccttattgctgttgctcttgtttttcacggttactctctaacatatataactcttaacatgtgtaactaatataactcttaattacatcctccttgttaaaaactctcctgttttggcctcccatatgatggatggggtaggcagaataatggcccccaagatgtcaatattctaatccctggaacatgtgaatctgttagattacaagacaaagggaaattacggttaaaaatggaattgaggttgctaataaagagattattttggattagctggggaggcctttgaagtagaagagggaggtagaaaaagggccagaggaaaatgtaactatggaggaatagtagagtaatttaatgtgagaaggactcaacatgctgttcctgattttaaagatagagaaaggtgtccacaatccgaggaacgtgggcagtctctagaagtcgtataaggcaaggaaacagatttcactccagagcctctaggaaatgcagccctgatgacatcttgatttgagctcactgagacccattttggaattcaaacctacagaactataagatagtaaaattgtgttgttttacaccattgagtttgaggtaatttgttacggcaacaatagaaaaatagtacaatggtgttctggcaaaatagtctcaacttctcatgcagatcttcctcagaacattgggctgttttctttcttttgtcaattccctagatgttgacagtccttggttttcatccttagctttctttttattcagttccatgctgttgctgccttttacaaagcaatgccatcaaactcagtctctttccccaaccagattcctgcttgtagctacctatctacatctacaagtccctcacaaaatccaaatttaacatgctttatgatagtttttaaaaaggcaaaatcatcaatttcaaagaaatgtaaatgaacacatgaaagattttctttaactcactgatcaatgaagggaccagtaaaatgttgcaacttgttcaaagaagaatccaaagtaccacacatgtgtaggtgataaggaatgctaaaataaatgtataaatagatgcagaacaggcttaccatgggtaaattggatggtatgtgaattatattttaagaaagctgttacaaaagcaaacaagcaaaaagtttggcttattcattagggaaaaataggaaaaaaatcacctgcatttcattggacacagtttatttgcatttcaatgaccaaaagtcatttgcattcttaatagttttctcctctttacattgttgcaaagtagttaagagtcattgaaaggcagggttaatcttataatctgcaatctgcaagagtacctaattgcagggtactctgcaatctttccatgtccatattgaaattttcgcaagttttcctgatatgtcctatcacatatctctaatccaaatactttctcattctcctgaagatcatttcacacatacatccctcttaaacctcccatacttcccctcctatcatctgtctcagctgatgatcttcctacttcccaaggaaataagagaaaaaaacagaagataattttaacttgctttccaccccacatgcatcagtgtattttccatctgtctccacttactctgccttccctcctgttactgtggatggaagctttctttctaaggccaaccactgcactgtgaactcagtgcctccctgtcaccaccagggtgtcactcaaggtattgtcttctccctctcctgtatcatcatgttcttatgcaactgcatcatgcccagaatcatgtcaatataatgtagtatcccatctcaaccaaatgcaccattgaccccatgtctttctgtagtacaaacctatttctctagacccttttatgagaaactccttagaattttttctttttcaaattcactgtcttcaattcctctctttacatactccatatcctcactccattcaggatgtacactccactcagcaactcttgctaggtccttagtaacctcttccacattgctaaatgcagtggaatgttttttactcatcttatttgcctagcttccctatttgtcaaagctgaccattcagcttctttaattttagattctagtccatcactctcataggacactcctacaacattggctattgttcctcagtccctttactggttcctcctcaccagtgtgatctttagttgttgctgtgtcttcaggatgggtttggggtctttgtttgtttgttttgctttgtatacactcaatccgatgatcttcaaatgcatataccttcagttcataattatctccagaactccagattcatctattggatgccaccttagatatttcagtagaaagtctaacagaaacctcaaactcaacatttataaaaccaaagtctttgtcctcctcccaacccccagcacaagccagctgttctacttgagtgttttctctccccagaaaatggaaaacctatccctccatttccttaggctgaatacctgatactcattcatgatttccaaatttttctccaacatattacaaatctcattgctttaatatacaaaaaaagatctagaatccaattattatacatctataccacaaatactttggtcccagccaccattattttcccttaaattatatcaatgctttcagtctcaggggtttgacgcttgctgttcctctgcctagaaatttttctcagtgcatgttttattatccacttttcttttgatctctgttcagatgtcaccagaccagtgatgccttccttcactgccttttataaaataacacctgacttcagcatttctagctcccttaccctttatttctctccatagcactcacaacaatctcatataacttctgtttgtttgttcatttatcttatgcctccctcaattagaatacaaacgctgtcacagactcaaagttatctgttttgttcattgctgtattttcaggctctaagatggttctcgcacatagtaatcccacaaataaatgattgttcagtaaatgaataaaaaataaattaaatttatatctcctctctcatcttctttcattctcactgctcctcatctttctcttctcctcttcctttaacagctaaggacttcaacatacatgcattcttccattcatccctaatagctaactcagagtaatctctaatgctgtctttgcctctttcctcacatcaaatcatttataatattttgttggtattgtgcctacatactccaaaaaagctctcacatcattcttgtcctctttattcctactgacaatgcccaattatctcagtggtttcaaacgtttgataaataatctccttgatctgtggtttctctttccctatccttcctcccgtgagtcatggatctaaacatatcataatcttgcttaaaactgaaaacacttccatgttttctaactgtttacaggtcaaattcaaacctctgtcatatcatttaaggtccttcaaaactgttctaaatctgccattccatctttttatttcatgactctcctaccttccagactagttatattcttttgaatgacaggtattttcatatctttattcaagcttttcttcttcttaaaacttccttactgtaactcctgtttcaatgccattcttattttcattcttttacacatagttcaaatgttgcctcttttggcattcttccaaaacctctaggtagaattaattgcttccttctctgggctcctttaaaattatatttatacttttggtgtagtacttatcctgtaatattgtagttcgttaattgttttcttattggcttccctttctggagtataaatcatagtgatttacggtatgagttctggagtcagtttgcctagactcaaaattgagcctcaccaccctttagctatttgatattgaacaagttatttccattctctaaacctcattttctcatctttaaaatggaaatattaaaatctgcctcgcagagttcttgaaaggaccaaataagataattcatattacaagtttaacttgattcctggcacttactatgctcccaaattattatttgagtgtcagcttcttgaatgtaatccacttatttatttttgcattgtcagtgcataaagaaggttcaacacagagttagagctaataaaagttggtcgagtttacttatgttggatttatcactgtgtgctggcaatatctagataagcaatgatgtagaattttattttggtctggctttaacctaaagagatcaacagaatgtgaaatatatgctaatgaactcttcttattataatttactttatgatctgcatgccacttccaatatggcatatacattttaggcaggtttaatgcttaatctcaaatcacaaggtcaccatagatgtctgactggactgaaatacttcatatttcatatttgaatactggatcttcaactttataccatgtgtataccattagttcattctgctagagtaacataaagataaccagaatgattccattatgtgaaaagcagctttcacattaagaattgtcttctcaaatgtctactgcatgtaagaaataacaagcatggccactgtcaggtgactgtgcagcttctcttcttcacatctttggtgttacctagagtaagaggccactgagtgtccagtccttagacacagtctagctttgcatcttgtgaagtgagtgctgatttcaagtatggcttgaatctaactgatgcttgatgttcaagcgttattgaacatatacttttgaaataattccaaatacatttgttgaaagtattattatcaaatgattattacaatgaaaatttatttttattacaatttaaaagacaacaattcaaaaatcagtctcccatcccagcccttaaatactgagcaacatcagtgtctccagttgttggttggacaggtaaaactgtgagccccagcaccatcaaaatcagtatctttatacctgaattagtattttttcctaatacaagcattcctcttttctttattcctctattttgaaaaacaacaaatatctgagcaatctttaatgtttccttttcctttaatcatgctcccacattcagttaactggcaaatcaccttttacctttgctttcaattcttgctcccaccaccttagtaagatgtatctctctacttagactagtataagaatttcataactatttttaaaactctagctttatcatctttatttttgaacatagctgacaaagtttacttttttccttttttctttctcctatgaagtaagtctgacatatcttcactgcataaaacccttcaaaagataaacatcaacaggcagtgggatctcagttcagagcttgatcttttgacttaaagctccggtctgcctctagttcttaagtaggacacttgacctctctagaattacttttctgttttattttttttctgtaaattaggtaaacatttctctaagtattttttctattttaaaattttgtgacttgacaggaagtttaaagaaaattggtaaaagataaatacgtgtggtaaggggagggagaaggaagaaagaagggaagtgaagggaagggaaggaaagggaaggaaaaaggaaagaaaaaaaaaaggcttaactctttatagaacctgcattccaagaaagatattaagtgagtttagtctagcttaagctctacaggttaaagagtatgagtttgaaaaactaaggtagaagcttggtaatagaagaaaaataaagccagggagggtagagcttttatagtactgaaagtatgcagaactcaagtggatgtataatttgtgtcactctggacttggagtcaaacctggatttgaatgccagctctggactattaatagggatgtgattttgagctaattatttaatgtctttaagttttagtcaggttcaactacatcatttgcagaccccagtacaaaaggaacatgtgagccccttgttcaaaaggcagaaaaaaattgccattaaaggcattaaaatataaaatgttttcttacttccctggtatctttcttgatctggaatgatgttttttatttgctttttaatggcactttccttttgggcatgggaatactttctcagcgaccctcacatgacctgggggccttgccccaccattcagtgtaaatgtgactcactgctgacccactgacttccaggttctccctttcatcagctgcctaaccaatatgcagtgccccagctcatagccccaactcacactaatggaaaatcctcaaaggctttgcaacatttgtgcaaattagacttctgcggtagaagatattctggaggttccaggagccacggtggggaaatatattgggagcaacaaaattctaacacagaaagatctcaggtactttatatctgggtgtgatcttggagctctctagtcttatccctgggtgaaacctgaaatttacccaggctcatacaatgtgattcaggtagaaccaaaaataatatgacttttagttctgtgttcttttagatacaggctttctaatgtatgtgagtttcccttgtgatttcctctaaaagcccaggttgtctgcacttttgtagttctggagaggaaaagcagccaaacactggtctctttctatggtttatttaaagctatctttctcaaggctgttttagttgtaagaaacagaaaccatacaattagtggttcatgtaacctagaggcagatctcactagaaattgaaaccaaagatctaaaaattcagggaataaagcctctctcctctaaattactcattctctccatcattctgttcccccccaccctctctctctatcatctacttatctcaatttctgcctttgtgtagactggtgttctctacctcctcatgagttttatggacgatggatattataaaagttatgaacatcctcatctctgctcaagcaaccagcagagactagcatctcttaatattatatctaaattcttgggagagagaaacaccagagcccaagaagaacatattcacttctcatccagtcagccatggcccaaggaatggcctaaagcagattgaacatgcctttaaggatctccacagtttaagagctacttctccatgaaatggttcatgggccattcagaaatgccagaatgtcactgcattcgaataaaaagttctcagtatttagggaataataatgaacgttagataccagtaggttagatgtaatattgcagtcagatcatggaattaactttttaattccatagaagataatggaggaagaaaggtagggcagaaccctttatgcattttcaacaatattgtacaattttcatataattattacttagaaacatttatttttcagtgtctacctattccaaagttcttgccttactgccaaataaaacttgttttttttttttttttttgagataaggtcttgaacttctgggctcaagcaatctgcccgtcttggcctcccaaagtgtggggattacaggtgtgagccaccatgcccagcctctctaataaaacattttgtagagagtaccattataatcattggtgattacaatgtatagtagtatgtatacacatatagtttttatatgtgtgtgtatatatatacacatacatgtgtgtgtatatatatacatgtgtgtatatatatacatatgtgtgtgtatatatatacacacacacatatatatgtgtatacacatacacatacagtagtatgtgtcttcaatacaattactcactgattgtagcagtggctcaaaaataccaacaccattctttttcccaaatacattcttaaagcacaagtatttgaaaatgcattttgatttcttgtttttgatatcatattgtcacatgttttcagctgttcctatacagaaaaccaacattgttcttgctttctgattgtatagacaaaacaataaagacttgctgttatttcatcatttcattacagtatgagaaaaatctaacaatttaccaaaagatattaaacaattagttgaaactagactttttacttatcaagtggtataaattcaagctcctaaaaagttgataacaaatataaatgaaaaaaaggaatgatatcaactgactgatgataattcaacaagacctaacttctgtgtctttcaaaatgacctaaagttacttagaaaaatgtctttaagtttctcatctatcaaatgggaacagaaatgtgcatctcacaaaaggcatcacagggatttaatttggaaactgctgtatgtatatattttttgaaaaccactaatcattctcacaagtataagatattattaagccaagttatacccccaatttggactacatgaagtttaaaccagacttttctctgagtgaaagtaaaggaaagcaaatgaattagcatttgttgtgtgcttgttttgtgcctggcataatgtatgttgcttaatatgcattatttcaaccaggttttctttttttgtgtaggaggtagggggttggaaactttaaagagattttatggagatctgcaaaaaagtcattcatattcccaccatcaaaaattaagttaccatctcagcgtatttatttcccatctcttttcttcattttttaaaaaatctgatgtttctttaatataacgcatttttattttaatcattcaaactatgaaatattatgcaaagaaaataaaaaacctatctccaataaaactttctctaaaaataaaaattattaatattgggtaaaattatagccatctttctatatatataaatacagaaaagatatactgtattcatgtatagatagataatagcatagaagaatacaaatattttataaaaatgagatcataccatagacgttacttttaacgtcaagattaaattttattttagaaaacagaataaaacaaagtaaaaatgataaataatttgaacttctaataaatgatttgagacaaaaaaattttttaaatgatttctctaaggttaaaagatacaatgaatgatacaaagaggtcagagtgcctttgtttgtaaatacaataatattatatgtatatatgtgtacatgtatgtatctatagactttttgctgtgaaagatgatactagcgctcatactagctaattatattccctcattcacttctcatttttctattttgttgtttatcttatcgaggttgtagcatttatattctgttctataactaaaactagcagagttcttaagtgtaagtttgtgtttgaaagtattctgtgtgtatcccattattcctctttcattctcaagatctgcatattgattcatatttaattgaatggatttcattgttaagtgatctctttaagaataatcatctgttatttttcatattagcttttttatattagtttttttaatgttcaaattgttcaaatgtgtttgttggatgtcttttttttttttttttttttttttgagacggagttttgctcttgttgcccaggctggagtgcaatggcgtaatctcagctcactgcaacctctgcctcctgagttcaagcgattctcctgcctcagcctccctagtagctgggattacaggcgcccaccaccacgcccagctaattttttatatttttagtagagatggggtttcactatgttggccaggctggtctcaaactcctaacctcaggcgatccacccacctccacctcccaaagtgctgggattacatgtgtgagccactgtgcccggctcagatgccattatatttgaaagatatattggtgataatactaaagtcatccttccatttggaatatttacagacttttcttcattgacttctggtataaaatggtactgtttaaaatcccagcttattctgagttttcttttttactctgtgtatgtatgtgtgtgtgatggggtcttgctctatcacccaggctatagtacagcagtgtgatcatagttcactgcagcctcaaatccctgggctcaagtgattctctcacttcgtctcccaagtagctgggactacaagcacccaccactgctaatttttcttttctttttgtttttggtagagacagggtctccctatagtacccaggctcggtctcaaactcttagcctcaagtgatccttctgtcttgatctctcaaagtgcagggattacaggcatgagcccctgtgcccatcctttcacttttacttagcttgctatttctgtccagtcttcttaaagaagcttcctcttgatgttcttcaaatattagtcacttaatcagcaaacgctttggtgttgagtattcactctttcaaatatttctggaacatgttctttccatttatagtaacttttcttaatggtatttactgagacatgtgtttgattctataactcggtgacatcaaggatcttaatgttgaatcatctttatctatgtttctaatccattaccttctcctcattgttttattatctgtgcttttttcacattatgtgagataattacaatcatctcaaaacattatagcagtaatgtgactttcagtgggtatctgttttgttgcttgcctattccaattgatttatttgttatttattgatgttgcctgggttacagtttgcatccttaggttcatggtctccaaatttatctggttctattgtctgtgtatttttttcatattgacattgttatattatttttaaaaactcatgctcttattctatagcataaaactgttttgaggaattccccaggttttcttgagttatgttttcttttagattgagtattttccctgtcttggtcatgccatgttttactcttttattgctgcaatatatttgcatagttactattccatttcttttcatattgttcatgcttgagaaactgtgtacagaaaattcattttacttaatggggaaatatattttttgaattttatttttattatatctgggaacaattttttttctccttcttagctccagtttggagacaggatttatggcgagtacccacattttgtagcctgagagaatgatggggccaaggaaagttcagcctttttaggatacctgggtgcttctctctatcctaagatttctttttcaatgaattgtagccagattattattggaagagacttcagtatacttcattggaagatgtagcacttttctaatgggcttcagaggcttcacccctgagtgcatgggcatgacattattaattggttaaacagagtcagctttactatccatatttccccactttacttttttttttttcctagaagcccttttcattgctcttcagccagaaagaggtaaaagaaaaagataagacctttccatctgtgtacatacaaatctgcttatctccagatttagaagttataatgagaattctcagaatgctgttatttcaccagtaaatcctatagggtgtgaggacgacattaggaaatcaagaactccttcccttctctgagcctgaccagactgcttttactccacagttgtttttggtttttttctttaagtaattttgtcaggatatgttccttttcttttcaggcattgttaatttctgtttgtctgttatttgtacttacaacgtctcacacatttcattaggcactgatactgatataagaaaactcactcaaacatcttcaatccacttgctcgatcatcatttacaggaacactaaaatatatgacatagcatcctcctttaacagctgagaaatcagagaacaagagtggtgaagtaaattgtccagcactggggagccagtaattgaccaggctagaattaaaacctctatctatctacacttctaggtcactgaggaaaggtgcctaaattacaattttaagatgaggttaataaaagaacttattttacccaattgcaaatattttagaagactaatatgatggaagcagatctgagtggatggtgaaaacaatggagagggaatcaggaagccaaagtttaatttcttgctctctcttaagacagatgttaaatttggaaaagatgattcaacttcctgggtttcaatttccttctctttaataataatgatggatgatgatgatgatgctgatgattgtcataatttgatgactatatatctactcattgtgaggcacaatgtgacatattttataaacaatatattattaaatctcaaaacaaccatctgatatacacattgcatctattttaataacaaggacacagaagattgcttaaatcccctgaggcccatttgattccagagcacacgttcttaaccagtagctctatggtctttccaaccaagaagtctgacctgagtggtctgtaaaagatcttccagctttgaggttctctagtgctgtggttggtatagaaggaaatgactatgggttaacataggagaagcaagctcacacatcactcaagtacaattattagagttacagactggacttcaaattaagtcctaacatgatcaggtttacgcttgatgttgtgcattgcactggaggggagaaaacataatttcttttatttccctttttaggtttttagttgagacaccctcctacaaacaaaaatcaaattaacaaaagaaaagcagaaatgtattaacacatgctggacccatcatgccgagagacatcaattcaaaagtatttttctcaaggcagtggcttggggtgatgtttcaataatattttatcaaaatgccataaattctgcatagtaacaaggcaaaggaaagaacagttttagtcctttaaaaggtgagaaaatgtgagaggatagtgaaatctgttctcagattcctctggtgcctgctggtgccttctctgggctgataacaagtgctgtctccagtaaggaagcatggatgtcctgccatcaagcaaacagaggctgaggccgggtattctcctgccttttcagtgcctttaactcaacaatcctcaatatttggggaagaaatattttggtttctttcaagacattaaaaaataaaaaccacagaatttcaccttacacatgagtactaagctcttcctcatcctcttccccttccctttctttcatagcaatttagtccaaatgccatgaattggagctgagtgaggtaggcatccatgtgcatgtggaagaggagagccacagcagtccagcctgaggtgctggaacctgagagaggcgagagaggcatccatgcagggcaggggttaggacagtggtgacttggtgtgagtggcagagcccaagtaaggtgagaaggccatacctgtggtggggtggcctggcagagggtatcagagcctgaggaaggggaagagggttccattgttaggggagggtgttgaaggcagaagcctggagtctggtgttggagccaaggagaaggagggtggtttctgggggaaagagagctcccgtgtgatctgaaagatgtgagaaagcgagaaagctatccatgtaggaatatgtctgtgtaccaagtgtcagagcccgagtggggtgaaggaggacatccacactggaggcagaccctaaacagggtcagaatctgagtgaggtgaggagggaggaatcacccagctagtggtgtcagggcaggtataggagtaaaactgggagtggacatcaggacctgagcagggggaagaggacgctgacagtgatacgagactagtcacatacaggggaagtgagcaaatgcataaatatgtcaaagataatgggcaccagggttctcacagcctaaatgggagttgcaaatataaacagaggacaactgtaaatcaccataaatgaacacatcacacacgtataaaatctacgcacacacacaaatttgctgagaggctctgggcaagagcacctcaaaaaaaaatgagtacggtgagcatcctcatgatggcttctaaataccaatctctaataaaggaagccaggttgttttgttttgttttgtttttgtttttaacaacaacaacaaaaatggctactttgctggcagagcaggtgaaatacaagatgatcctggaactctctcttgtatcagaaaggaagaattcaaagaagggtaaggacatgccaaaggcaagccatttgaaagcatcgaataaatagcaaatgtattataactcatttaccaaaataagaaaccttggattcacaccgataaaacagatcatcctcatagaaatatatgaataaaaagtttaaatgtccagtgaggcatatttgcattgtctaaaatccctagccacaaaacactaattataaagaaaaaaaagatacttacttttatactggagaagtctgacaggtaccaccttagtcaaatgattatttaacttcaagagcaatgggacagatagaagtcttaaccttctacctgacagaacgcagcataaagagcacagcatcctgaatcgaattgtaatgaaagtggtttattacctccaatggtgtatccagtgaaggaggagaggatagagggaaagagggcaagacaatgggatcagtgtacttgctggctgggagaagccttttttatagtgatttttaaagccaatttttactgcttttattattatttttgaacatctttatagacccttttattatatgtgcccttggcatatagctcctaccaatacagggaagagtctgtgacttgccattgatacctgactattcagacaagcccaaatgaggtgaaactttaccacataactgccttgtgatctaaggtgttaaagtcagggaaatcaaggaaagactgtggaattgttgcagattgaaatagactaaagagacataattaagagaggccatgcatggtggatcatgcctgtaatcccagcacattgggaggctgaggtgaatggaatgcttgagcccagaattttaagacaagcctggcaacatggtgaaacaccatctctacaagaaaacaaaaattaacctggcatggtggcaaaaattaacccaggagggctaggtgggaggttcacctgagcccaggaggttgaggctgcagtgagctgtgattgtgccactgcaattcagcctgtgcaacagaatgacaatctgtctcaaaaaataaaaagaaaataaaaaagaaaaaaaatatcaactggattcttttggtgtaaaagattttattgggggccagacacagtggcttaatcctgtaatcccagcactttgggaggctgaggtgggagaatggcttgaggtcaggagtttgagaccagcttgagcaacagaaggtgactccatatagccaggcatggtggcaggcacctgtagttctaactacttgggaggctgagatgggaggatcacttgagcccaggagttagaggcttctgtgagctatgatcacactactgcactccagcttgggtgacagagtgagacactgtctctacaacaaaaatgaaacaacaaaaaatagaattttattagaaaaaatgggaaatgggacctgaagattagctgcttagagctgaatcaatgttaatttcttgatattgttggttttgggggtgttatgccctttgtttgttggaaatataaactaatttatttgggtaataggggattggtttacaagagaaaaaaattctttgtccatttttgtaatactttttgtgaatttgagattgttttaaaataaaataattttaaatatgtatattgaattgatatttaatatagacttgcattcaaaacagggccacttttttttcatgtgatttattcttttcttttcccaggtgatggtcttttaagccgtcctatttttactcaggagccacatgatgtcatttttcctttggatttatcaaaatctgaggtcatcctgaattgtgctgctaatggttacccttcgcctcattataggtaaaatcctacctgtgggcaccacactattttgttcttcctcactgaaccaaaacatacacaaaataaagtgttttataaaatgtcctaatttgtagtgtacagctcaaggaatttctctacgggtatgcagccatgtgacaatcactcagataaagatataggcatttccagtaccccagggtattccctcatgccgctttccaggcaataattaaccccctacccaccagctccaggtaaccgtacttatgtctctgtcttattgattaggtctgcttagaacatttattcttgagattggtgccatgcattgccttattgtggtcagaaatgagagagagagagaagagagataggggagagagagaagagaaagacaggaagcaagtaacacaggaagccaggaagaaaagaaagataaaaggaaagaaaaaaatgaagagaaaggaaaaaaaaagatttgtttcctcaatttgaaagactaaaatgtaagctcattttgcatttcccacccctgcctcaatgcggaactgcagcctcagttgctgcatatgcaatgattatgaaaatgttctataaggaatgaatccagatggatatctagatttatttcatcagataaaattatgtgacttcactggtgggtcacatcacccaaaaatactgattttagaaaaatatgttgaagacagctatgtaccctctaaggcagaaagggaatttttattctgggcaaataagaaaaaaaaacctatatttgtttctcacatattatttgtggaattctagggagaaagggtcagtaagtttttgttcttatttatcaagttgtagcaaaggcagaatttgcttcatattgtgggtggaatttacaaatttaaaaatatatgcatacgtaaatattcataggtaaatactacagatatttagttagtagaaacttcatatgtagtgttaatacaggaaaagaaaatacatattaaacttttgtagctttgggttttaaaacctttttttaagtcttgttttacagatgtgaagttgatatgacacacacaaagagtaacaacttcagtgtattttggcaaaataagctggtttagcctgattttattttgcagtaaaaatacactcttgatgtgcatagttatttagatcctaaaattgtctagattaatgagttaaatgacttaaatgcacttaattagctaaatgacttcaaagctaaaggcaattctaccttatcttgaatttttttgagctaacttcagtgtcttctttttacaacaaaggagctgaaaaaccatgtcttctcattccacagactaaagcttccttgtctttatcatacccaaaccagtgaaactcatctgtcaggggaagatccttcactttgcaaatttgggacactcaattcagagtttgttgatttgttagtttttcttaaatgatgagctgtcctattagtttaatatatggttaaatatatgaaaatttgattaatacatttagtgagatcacctaatacttaaagtagtaattttatgtttgagagctaactaggttgatcctaggggttagtagagaaagaatataagaattcctataacattttttgaaagtttgctgaatataagacagacacataaatacataaattacatatttatataaaaaatctattggcttttaacagttagaaggatataaaataggttctcaagataatttgctaattagttttatctgtgaaaaaatagaatgaaggcaacagttttcaatgttgttaaatggcttttatttctaagatccttgtaagctaaaaggctaaagacaagtaatttatgtgcttatttccagcccccataacctggtttggctcatttcttttttttttaacttttaagttcaggggtacatatgcaggtttgttatatagataaacttgtgacatgggggtttgttgtacaaattatttcatcatccaggcactaaccctggtgcttattagttatttttcctgatcctctctctcctcccatcctccatcctccagcaggccccagtcgttgttccccttactcatagacaagaaactatggaaagagagtgagaaaagaattaagtttttaatgcttaaatgtcagactcaggcccaactttattgataataaagcaaaggacagaggtatttcagataacgtgcattaccaacaaaatgtaaaagttcagttttaatatgaccctttctaacttaaattttattttttaaaaagcctcacaactatattcaccttagatggtgtgtgtgtgcatgtgtgtcttagaaggaaagccttcacaattcacagattctaacgttatttgaggttacctgggtatagtgtaaagcaacataaaagaatccttgacttaaagttatcatttctagtcacagctctatcaatccattggtgactttggaataatcatttttctctcctggcgtcatcttccttattcataaaatgaggctgggtttgattttaagatgtgttttctttcttttagtaaattccatacagcaaatgaaatctcagggaaaataagcaatattaaaagcaaactttttgaaagagcttaagcttgcccatgaaaaaggattaccctttattctttcaaagatcacataacacatgagaatatgaagtccagccctgaagccctgcaaagggaagagaaatgggctacccaaagatggtgctttggaaggattgcttatacctggaaagtctaggaaaatcatgtagcaatgaacttagttctacctcagaatatatatttgatttggaaaaatgaaataacatacacataaattatttctaaatagaatatactctctatcagaaaaaaggatttctgacaatcttctctctacctggtcaccagaggagactcctttctgtaatttagtctactctaccctagtcatgaacacaaccttaagtctagagaagctctaggcctctaagaaaaaactataatagtagtgactctgcccttctgttctttttattcatttcccgcaactttatccttttaacaatcctgtgagataagcagaatatacattattgcacacatcgtataatttgtgaaatgacttctggagaaatcagaaggcttgttcaagtatatgcagcaaaggaacgtcaaagctaggactaggattctttccacaggggtcacagactcaaattcagtgtacatcacaatcacccagagagacttaaaatttagattttggtgttctctgtcagaggtctggggatgggctcagaaataagccaggcagagagagacaaatatcatctgatctcactcatatatggaatctaaaaaaagttgatttcatagaatcaactcatagaagtagagtgtagaatggaggttaccagaggctgagtcagggaggggcaggaagggaaaggggacaggtgggtcaaagggtgagaagtgacctttagacaggaggaataagttctgggattcatttggacagtagagggattatactcaatgataatgtattgtatatttcaaaggagctggaagagaagattttgaatgctctcaccacagacaaatgatagatttttgaggtaatgaatatgctcattactctgatttgatcattacaaaatgcatacatgtatgaaaacatcacattactccctataaatatgtgcaatcattatttgtcaattaaaaataaataaaactcaaaaaaaaagaaacacattctttcagcaaatataccatgtaattctaaagcacagcctaattttgaaaaacaccaacaggcacaagcgcgcacacatgcacacacacacacaaacacacacatattacggaaggacagccaacaaacacagcccacaaccattattctttttttgtttttgtttttgagacagtcttgctctgtcagccaggttggagttcagtgatgcaattttgactcactgcaacctctgtctcccagactcaagcaattctcctgcctcagcctcccgagtagctgggattacaggcgtgtgccactatgcccggctaatttttgtatttttttaatagagactgggtttcaccatgctggccaggctggtcttgaactcccgacctcaggtaatcagcctgcctcggccttccaaagtgctgggattacaggcgtgaaccaccgcacctagcccagccattattcttgacacaggactgaactacttaaaagtgaaggatgtttcccaacaaagggtcgagattttagttcacatccattatgttttctggaactaatatgatattaattcagatgctaaaagcaatcatttaaaacacatttcctaggttgcatcataggaagacacttgtcagtatgcaattctatcagaaatgtgtgcatgacaatcatttgaattcattaatactgtttctccattgatttagacatattaattaggacaaagcccacaccaggagttgaacccctgatctatatgtacagtttaataatcattgtaccgtagtgatcagaatgattatggggatactgtgaaaaattcatttgctgccgctaagccaacaactttgaatttgtgttgaaaaacaattactgagcttaattaggagcatgtaatgatgacagcggttatttcagtgattgattccaaaattaaaaggagctggcaaactaaatatggtatatcctatgctttgaaaacgatagggaacatggaagtctaaagagcaaattatcaaaaactatattagagtgctggcaaggagaatattggtgtcttgagacaggcctaaagaaagaaaagttttgaagggttttattattgttttttttttttttcacttttttcttaccctaatattgaaaacgagcagtctctacaaattcctctagaaaaaaatgatcgcagaaaatctaggcaaatgaaatgtactctttaactgctgtctttcaacttccaggtgtgcaggaaatggctaaataatttcaaagttaacagagttggttcaaaacctttgattgatttgacatctgatccatcacatctcatctttaacatggtagaggattacctaaattcatatttcttttctactttggtaggcatttgtcagattctccccatgggatgtttgaagacgcgcccgaagaagtcaatgacatttgaattaattctgtatttttagtagaggcggggttttgccatgttgcccaggctcgtctcaaactcctggcctcaagctatctgcccaccacggcctcccaaagtgctgggattacaggcatgagtttctgcacccaacctctttgaattaattatgtaaaatgtcattttttaaaaaattaaccactcccaccaaaatatttttaatatgattttggtataaaggggagaatcatagcaaagctggcataaaccctaaaaaacacagtttggaaactggctatattccataggaaaagatcattcacttgttttcctagatgactgtgatggggttcaggacataccacctcaaaatatggcaccttggcatttgagaaaatagcagaagcaggaagatcattctcaccttcccctcactcttcttctctgaagcaggtcataaaacctttattccagaggtatcatttctatatccagaggaaagaaacacccttttcctcctcaaagacacagagaaatcaagaagaattggaacaaaaggccttgctaacttcccgccagtttcttaccattagatcataccctctttttacaatcatacttctgcaggactgtctactcttcatcaaaactagcattaaaaacacacaggttttcctgttttttaggattttttttctgaaggctttcatgtcatggaatatttatattaaataaaattatatgtttttctgttattaatcttcctttccttttagagacctcagccatgaacttagcaatgagtgagaaaagatatttttctacatgcacaactgtttgtcattattcaatagttttaagtgtttattttaaaaaatggtctatgtgactatacacagcctgtgccctaggaatgtatctcattagatatatacgattcatgcttcaaaatatttggggattttgatggagttgggagtttcaaggtaggaaaagtgagtctggttagagataataatcaggtattcatttgtcttaaaaatgaccaaataaaatttctaaaactagttatgaatctttgaaagtaaatataactctaagactcttcagctagttaattcatgtactaaagaattgttgactaatagctaagccaagagaatttttgcttctcaaaataaaaacctctcaaacagcatttgctttgctaaagtataattttagtttggcatttctaagtaccattgaaatattttcaacatgattaattttccaagtaacatactaacagaggtaatcatgttctaaagtagtcaggttattattgttttgttatcagccctgaattggcgttgtaaaattatgcttgccgctttcaatatacgcttcttgaattcctatctttaaatcattttgacattcaattttgtgctaccagttgtggatgttcaggtaaggtatatgttatttgaaaagtcactaaaggaataggttggccagtattattgactgactgtctaatttttatttctcatgttgagagttctgtttcctctttgtatacatttgggtgaatgtaacttataaagagtacatctttcaaataatctagttactgatctcaccaaacccaccaagacagctacctttggtaaaactggtaggattacctccacatgtaatcatgttttttggtgttttttatagttgcaggaattagaactacatgttttttaagacaaagattgattgactctgtatattataagcactttattttttttttccttgaaggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatgtgagtttggggtaaattttgtaatctttgtctctgaaaatataatattcttctgatacacacattttaaaaatctagctttgccaatgatatatttgagaatgaatatgactttatgggcttttgacaatgttcattttgtgaatctagattcttgggtataatagaaacctgcttctaaaaaaagaataaaaaaaacagggaaaagatcaatgttattatattttgtgaattatttttagaaacatttctaaaagtttcagacataaatattaagataaagatgtatgatatagcattctttttctttttcttttgcattggatattaatgcaatgtggagagcacaggaagaaaaagctgagggcagagaggtcatctgggggaggtgggcgttctcccaagaaaagcgatcatgcacccgtagtttgatgtaggtggaaataaagtggttgccaaaggcaggctttatattaactgtaacaatgtccagctgcatcacataaatgtcatccaagtaattaccctggtgacatttggggacattagcagatgaacaatagacatactgcgtctaatatcctttatatatagtgtttccagggactgaaatgtttcatactggattcagcaaaagccttgcttgagagtaattatatctgttgatgtggataaagtagaaggcttgcatttctccctttgcaccaaccattatgtcccagaggatctagccaaggaaccaaaaagtgagctgctatacctgcagggctcatagaaatgtctatactgtctgttactttgaaaaagtaattgttctgaaattttattaacaaatacatgaccaaaactcaccttgtgaaactacttcagtcatcagtagatacatgaattaataactgggtctgtttctcattgcaagtcttgtgttccaaagattattctacaccagagatcccttgatctacacagagttctctttatgttgaccattttggggatggccttgcttctgattttacatacaccacatacacatacacacatgcacacacatatacatatatacagatatacacacataaatatgttgctaactgtatccaaatgtatttgtatctatggaagtaagaagtgaacgtggaagtttattaacctaaatagaaggtgggaaagggccagtggctactttcgaacataggataaaaatatttataacacttgatttcttcatttcagctaagactatcacctggaaaaataatagggaacaaaataacataaaaacttatgttatagaaataaagaattgttccagactttgaacgattctgccacagtaattgtttatttctcctgcttggataggagatgaccctacaacatacacatgatatgaatcagattccataatcataaatttgactctttggtaaaggaaactccatacagcatatttatttgctataccctcgagtttctctacagttatgattctatctactctcgaaaacagttgaatgtctacatctcaaatcaatgcactctttgatataaccatagatttcttctcctttgttctgtactttttaacaaaaatatgttttaaaatgtcctacattattatatcataccttctttctgctttaaaaatttcttgcaacgagaagtttctctagttaaaacttattttgtttatgccatatcagaataaaagtctcaattaagaagaaattatatgctttcatctggctaaatgggacaaatcaatttttctgtccttattgactttcccatcttatcataaaattttccattttggggcagaaggtgtatgactgttgatcttgaaaagcatttctattacctttaatgcagaaagtaagatggcctatatccattaactaatctttcttctgcaaagttaaaggatcttaggctctaagagcttgcaaaagcaaggaccacaacatggtggtggtgtcatgtctgaaatatttctcattgtatccggggagacatgtgcgagagtgtggaaacagagagtaaagggtataaatgccagtccccaaccaaatggaaagttcctaaagtgcatgaactgtaccttcatcttaattataattcctcacaacctccttcataaatttttaacaatatcaattgtgatagaaaaggcctttggtaggataaccacagcagataaatgctgagattttgggaaacagagaggtgtgagttcaaattctttttgtcaaatatctagtggtatgaaattaggtcttttcttaacaacgttaagcttctgttaagaaatctatacgatgaggatacagcagtagccaccacataggacagtgacatggagtcactgagaaaatgaaggtcaagtccctgatccattatggaccctagggaaatgacagctctaattctttctttcactattattacctatctcaacttagacagacatctatatatttcaaaccacttgagtttcttatggaaactctcctagtttagtttacatttgaaaacttcctaaaggctagtttcttgttcttttcttttcatgtcaaatataatacatgtgctttgacatatattatttcacttgaattggacaacagctgtaggaggcagttgctatcattgcccccattttacagattagaagcctgaggctcactgatattggggctttcttaaagtatgttgttagagaaaagttggaacttgtgtatagacaaagaagacttcagactctaaaactcatgcacttcatgtcacagtattgagtccttctcaaacactgaccacacagttcatgtgggccttctttctttgtttcacttgctggcacagtaattgtctaaataataaactgtatcttcaggacagaatgggtcaaataagcctggtagtagaggctggtgattccttgtccacatccgcttttgcaagtgatgtgccaacccccagctatgaatacccacagatatccctttttgcatttcatgccccaaacctctccatgggatcaggctgaaaccagacaacagctgcaacaccttaattagcttcttcacttgctgtttccttcttccctccctgcctttctcctaagaggatatcctcaataaatcatatgcacttgaatccttgcctcaggctctgcttctaaggaatccaaagcgagacagagattaaacatttaatatgagattgccgatctacttactgacagaaaaaagcgggtgcagaagccccactcccatgaactcccatagataagaacaagctatgcatcagaataaaaatggatcaactcccttgcttcctgtccgttggcagtccattgtaaaatgtcactttgaccttcagaatgaatggccttatgaacaacctttcagaatctaccctgtccatggcagaaacgctgcagggacatacctctagataattgatggcttttgtttgtcacttttatcctggtattcagtaatccaaaagcacactttgagtttattttagacacagactgtaacactctgcttcattatgaatcgtctcatcatgaaaccatcctgaaatgtggcctgtatataaaaactacctgttgtgaaacatactcctaaatcaaatctgtctttaaccaactatgtaacttagacaagtcattcagttctctggatttagctaaagtatattttgaattatttgattacaaaagtctctttcagctattgtcatataatctgtccttccaaatactcaggtagatcctattttaagtatctctttcttccccaacccaaactctaccctaaaacaaattcagcaggagtctagtcaccaaaggcttctgttatcatcctggcattcttgaatgataaaactagtttgacttccaaaatcacttgtagctgctttcaatttcttttatttatcaaagcttttggtggtaaaggttgaacttagacctcttccttttgtatgtatgtatgttaatgaattactctgtacttgtgtgagagaacattgcatctgtcattgctgtttaaaatgtcatccttgagaaaatgagataggtgttttgaaagaaacccatgatatcactcagatgtaatttttaaatgcccttataatatataactctaccaatgaaaagataaacatttatgataaaaggtagtcatgaatggggctttttgatcctacattatttaatgtgtaatcacagctagcatttcaaataagtttgctccattattgcaaaaggaaaggcagctgggctggagcctcctaattgacccttcatttattcatcctccaagcaaccggagaacacctaatttatacccatcaagtactacactaggtcctaaagattaaatggtagataagaaacagctacttcctgtctcaacagaacagacaggggaaacctttaataaaattaaaaataagaaaaggaaaataaaggaaagtgctaacgcctacaaagtattatgtggcaggcattgttccaaactctttatgtaaattagctccattgatcctcacaataaccctctgagagtatcatgatcttcactttcagataagcagattgaggcacagaagaatgaactagcctgcctaaaatcacacaccgtatgtgggagagtctgttttcaaatccagacagagtgaagagtcctaccacctactgcactgtcccaaaacatcaagtgaagtgagaaaggtgaaattgacctataacagagtggagctcaaagtgagaagtagtgaagtttgtctgaattggagaaaaggcaagggaagcctttcaaaggaaatggggcttgcattgaaccttgacatgttagtttgtattctggacagagaaagtggtagagaaagtacaggtcggaagaacagtaagaggaaatgcagatgtgtgaacaatcttcaagtatcgaagaaagtgtggggaggtgggcaaaagacctgagaactgaaatgcagaaagctagggatcagaaatgactggttttctaggttgagactgaaaactaatttggagccacttataagtagtcctttatatccgggcctaatctgcaaacaataggataatttagagatattatgagatgccaaagaaacatgcaaaaatccatcatagtacaatattccacactcagtatgacactgtgtacggtgttaatttatggttaaatgccagtattgcccatttcatatagggttactatgaggaccaaatatattatgtggaaagcagagggcaagggcaactgatagactggtatgagttgaagatggtgagctaggcaggggtctggccatacaaatactaagaggccaagttttgtattttactgcttatcctaagagcaatggaaccgttctgaataatgttaaggatgttgaagttgtttataaaatgtagtttgaagccaggcgcggtggctcacgcctgtaatcccagcactttgggaggccgaggcgggcggatcacaaggtcaggagtttgagaccagcctggccaacatagtgaaaccacgtctctataaaaaatacaaaaaattagccgggtgtggtggtgtgcacctgtaatcccagctactcgggaggctgaggcaggagaatcgcgtgaacccgggaggcagaggttgcagtgagctgagatcgtgccagtacactccagtctgggcaacagaacgagactctgtctcaaaaaaaaaaaaaaaaaaaaaaaagtagtttgaaataccacatactatttccttaaatatgttagtctgacatattaatgatattattaatattatcaaaaccatagcacacatacttagggggcatcccaaacctcagtttttatcatatacaatggagtgaacgaattcttgcaccacatcacaggattgattttaaatggttcaaggttaaaatgcagtaagaatgcattttaaagggctataaacatgtaggcatttacaatcatcatagttttttccagaggaatgcaaagggttttacacctgccatgccattcatctttattctatacctgtaagctattcttaaccatgttttacaggtgaagacattaaaaggcaggacaactatgttacttgcccaaggtcaactaacctacagcagacccagaatttctaacatttccttcttgaaacaactttttaaatttatatttattttgtagacagaggaagtaaatcagaattctcatgaatttaatgccatattcaaagaaaaacaaaaaaggtaaagtcgtaacataaaggtctttgactccttgcagaaggattctaagatatttgtgtatttaaaggtgataaatatttttatttctatcttttgaccagggtcttataagcaagaacaaaaaccctcacatttagaaataaattttaagagtttccaaatttctttaaaattctttcatatataagaaatataaaagcagttatatgtgctcccgatgatatggtgataaagtgcatttatatcagaaaaagaaattaagacccagcagaagaagctttaaaaataacacttaaaaatgcttttggaaattgtaaagtctccgataattgcgaagtgcgtattaagtgggtaatgcatacctaattataaatgaaaatgctaaatggcttttaaccttttttctacatcagaaaagaactaactgaacaaaagccatgaagaaatattttttctttaatttcttaaattaaaaaagttggtaaattagtattgattttttcagtatcatttgcaaatagcataagcaatgttacaatggatttaatattctcaatttgtcttaatgaaataacagcataaccaccaattgttatcatatcaaggagaaaactttgtctttgcttttaaaaataattcagatcttaaacaaatagactgtaagcagttgcgtggttaaattatagcaagccactgttatatttatatttaaaatcaacagggaagtagattattcaatgctttagcctcattttttcccacactatcgctgctggaaatctatttatgtgtcttatcagaaatggtactttttcaaaattcaggccttctcccactgcctacttctacttatattcagcaggagctagtctttttagttcatttgaataaaattgtgcaggctaagagttgggatgggagaggaaaatataagaaagtaggggatccattctatcaaaactgggagtttctgatttacaaaactgagacagatgcacaagctgaaatgcttgtttattactcatgttatttgacaaactgtttcaaggaatttatgaacatagcacatagagattttgcttctaagatttataaaattggttcaaattacagtgacattttttgcattaaaggatcaaatatttctattgtttatttatatataaataaatatataatacatataaagagcatttataagtaataatgtgtatataattatctgaatttatatccaatattgtctaaaaagtaaatcagattcaggtgtttaaatagcaaatacaggagagaagatggcggataagcagcaagactagcttgcagctcctgctgggagggatagagcagcatgtggagactcacatcatactttgccccagaaactaccccaggaacataccaggaaagccgagagaatccacaaaccctttgaaagaactggatcaccgctgcaggctccctgagatgcagaaaaactgtgagtcggcttgctttctcaatagggaggctggtggtctggggcaggttctcagccctggtcactagctgtctggaaatagactcagtgctgctgggggcgggtggggcatggtgggagtgagactggcctttaggactcacgctgtgtgggggtggggtgaggcctgtgactgcgttttccctcacttccctggtgaactgtatgactcagcagaggcagccataatccccctgggaatataactccatcggactgggaactgtacccccatccctcacagcagctgcagcaagccccacccaaggagaggctgagctcagacacaccttatccctatcccagtctggtggtctttctctatgtgtcctggtagccaaagacaaaagtcataatgtcttgaaagctctatcgccctgcccaccacctgagaaacctgaatacttttgcatcctccgtataggaccacagctgatgcactcccgaagcgccatctcctgactggaggccaaccaacacaaaaccagcgctaaacaaaaacgcaaccaaggaccctcacagagttcacttcactcccctactacctccaccagagcaggtggtggtatccacagctgcaagacctaaagatggatcacattacaggactctgcagacactcctcagtatcaatcagagcctggtagctccactgggtgccagatccagaaaagcaaagcaatcactacagttcagttctcaggaagccccattcctaggggaagcgggagaacaccgaaacaagggagcaccccatgggacaaaagactctgaagagcagcccttgaatcccagatattccctctgacataatgtacccgaatgagaagaaaccagagagacaataatgataatatgacaaaataaggttcttcaactcccccaaaagattatgccagctcacctgcaatggatccaagccaagatgaaacttctgaattgccaggaaaataattcagaaggttaattattaagctaatcaagaaggcaccagagaccaggcgcggtggctcacgcctgtaatcccagcactttgggaggctgaggcgggtggatcacaaggtcaggagatcaagaccatcctggctaacatggtgaaaccctgtctctactaaaaaatacataaaattagccaagcgtggtggtgggcgcctgtagtgccagctacttggaaggctgaggtaggagaatggcgtgaacctgggaggcagagcttgcagtgagctgtgatcacgccactgcactccagcctgggcaacagtgcgagactctgtttcaaaaagaaaaaaaaagaagccaccaaaaaaaggtgaagtccagcttaaagaaattaaaaacattatacagaaaattaaaggaaaattcttcagtgaaatagatagtataaataaaaaacaatcacaagttctggaaatctaggacacagagtaatgtaaaatgcattggaaagtctaagcaatagaatcaaacaagcagaagaaagaacttcagagctctaagacaaggctttcaaattaacccagtccatcaaagacaaacaataataataataataattcttaaaaaatgagcaaagcttccaagaagtttgagactacattaaatacccaaacctaagaataattggtgttcccgaggaagaagagaaatctaacaatttggaaaatatgtctgagagaataatccaggaaaacttcctcagctttgctagagatctagacatccaaatacaagaagctcaaagaacatatgggaaattcatcacaaaaagataatcacctaggcatatagtcattaggttatctaaagttgagacaaaggaaagactcttaatagctatgagacaaaagcatcaggtaacctataaaggaaaacctatcagattaacagaagatttcttagcaggaaccctacaagctaaaagggattgggattctatttttagcctccttaaacaaaacaactattagtcaagaattttgtatccagttaaagtaagcttcataaatgaaggaaagacacagtcttttccagacaaataaatgctgggagaatttgccactaccaagccaacacaagaacagctaaaaagagctctaaatctgaaacaaatcttcaaaatacacaaaaatagaacctccttgaagcacacatctcacagaacctatataacaataacacaatgtttaaaaaaaaagaaaagaaaacagaaaacaaaacaaaaaaaaaccacaaggtattcaggcaacaaaatagcacggtgaatagaatagtacctcacatctcaatactaacatagaaagtgaatggcctaaatgcttcacttaaaaaatacggaatggcagaataaacgagaattctccaataaagtctctgctgtcttcacgagactcaactaacacagaagaactcaaatttacttatagtaaaggggtggaaaaagatattccgtgcaaatggacaccaaaagcaagcaggagtagctattcttctatcagacaaaacatacttcaaagcaacagcagtttaaacaaacaaagagggacattatataatgataaaaggattagtccaacaggaaaatatcacagttctaaatatatatgcacctaacactggtgctcccaaatttataaaacaattactactatacctaagaaatgagatagatggcaacacaataatagtggaggactttaacactccactgacagcactagacaagtcatcaagacagaaagtcaacaaagaaacaatggacttaaactatattctagaacaaatgaacttaacagatatttacagaaaattctatccaacaactgcagaatacacattctattcatcagcacatggaacattctccaacatagaccatacgataggccacaaaataagtctcaggaaatttaagaaaatcgaaattatatcaagtactctctcagaccacagtgaaataaaattggaaatcaactccaaaaggatccttcaaaaccaggcaaatacatggaaattaaataatctgctcctgaatgatcaaacaaaaagctgcctctttgaaaagataaataaaattgatagactgttagtgagattaaccaagaaaagaagagagaagatccaaataaactctattagaaatgaagcgggagatattacaactgatatcacagaaatacaaaagattattgaaggctactatgaacaccttcacatgcataaactagaaaacctagaggagatggataaattcctggaaatatacaactctcctagattaaaccagtaagatatagaactggaacaagatagggatgcccactttcactccttctattcaacatagtactggaagtcctagccagagcattcagaaaagagaaagaaataaagcgtgtccaaattgataaaaaagaagtcaaactgtctctgtttgctgacgttacgattgtatacctaaaaagccctaaagattcatccaaaaatcttctggaactggtaaatgaattcaccaaagtttccagatacaaaattaaagtacacaaatcggtagctctgctgcctaccaacagtgaccaagctgaaaatcaaatcaagaactccacccctttcacaatatctgcaaaaacaaacaaacaaacacttaggaatatatctaatcaaggatgtgaaagacctctacaaggaaaactatgaaacactgctgaaagaaatcatagatgacacaaacaaatagaaacacatcccatgctcatggttggggagaatcaatattgtgaaaatgaccacactgccaaaagcaatctacaaagtcagtgcaattcccatcaagatagcaccatcattcttctcagaactagcaaaaacaatcctaaaatttacatggaaccaaaaaagagcccacacagccaaagcaagactaagcaaaaagaacacactgggaggcatcacgttacctgacttcacctttttctctgaggccatagtcaccaaagcaacatggtactgttacaaaaataggcacatagaccaatggaacagaatagagaacccagaaataaagccaaaaacttgcagtcaactgatcctcaacaaagcaaacaaaaatatgcagtgtggaaaggacatcctattcaacaaatggtgctgggatcattgaaaagcccagtgtagaagaatgaaactggatcctcatctctcaccttaaaaaaaatcaactcaagatatatcaaagactaaatataagacctgaaaccataaagataatggaaaataacattggaacaacacttccagacattggcttaggcaaagatttcatgaccaagaacacaaagcaaacacaacaaaaacaaagataaatacatgggacttaattaaactaaaaagcttctgcacagccaaagaaataatcatgagagtttacagacaacccacagagtgggaaaagatcttcacaatctatttatccaacgaatgactgatatcgagaatctacaaggaactcaaacaaatcagcaagaaaaaaacaaacaatcccattaaaaagtgggctaaggacatgaatagacaattctcaaagaagatatacaaatggcaagcaagcacaaatgggaaaatgcttaacattgccaattatcagaaaaatgtaaatcaaaaccacaatgcaatacgacctccctcctgcaagaattgccataatcaaaaactcaaaaaataatagacattggcatggatgtggtgaaaagggaacagttttacactgttggtgggaatgtaaactagtacaatcactatggaaaacagtgttggagattccttaaaggactaaaagtagatctaccgtttgatccagcaatcccactacttggtgtctacccagaggaaaagaagttattatactaaaaaaaaaaaaagaaaaaaaagaaaaaaatttcatgtgtgtccgtgtgaagagaccaccaaacagactttgtgtgagcaacatggctgtttatttcacatgggtgaaataaacccatgcaccttcacgtgggtgcaggcgggctgagtctgaaaagagagtcagtgaagggagataggggtggggctgttttataggatttgggaaggtgatggaaaattacagtcaaagggggttgttctctggtgggcatgggtggatctcacaaagtacattctcaagggtggggagaattacaaagaaccttcttaagggtgggggagactacaaagtaccttcttaagggtgggggagattacaaagtacattgatcagttaggatggggcaggaacaaatcacaatggtggaatgtcatcagttaaggctgtttttacttcttttgtggatcttcagttacttcaggccatctggatgtatacgtgcaagttacaggggatgcgatggcctggcctgggctcagaggcctgacattcctgccttcttatattaataagacaaataaaacaaaatagtgttgaagtgttggggtggtgaaaatttttgggggtggtatggagagagaacgggcgatgtttctcagggctgcttcaagcgggattaggggcagtgtgggaacctagagtgggagagactaagctgaagggaggtcttgtggtgaggggtgatattgtgcggatgttagaagaaacatttgtcgtatagaatgattggtgatggcctggatatggttttggatgaattgagaagctaaacggaagatacaaggtccgaattaaaaggaggagaaaaatgggtattaaaggactaagaattgggaggacccaggacatccaattagagagtgcccaagggggttcagcataattacttgcttggttggcaagtttttgggctctatccttgagtttttttatgttgtcatacaccaggccagattgatttaggtaaaaacaacactcctcatttaagaatatgcagagtcctcctttttcagcagtaagtcagtcaaggcctcggcggttttggaggacaactgcagctaaagagtcaacttgggcctggaggactgataaagtttgtgattttgaaggcctctaaaagtattaaagcagcagcagccgctgcacgcagacatgagggctaggctaaaacagtaaggtcaagttgtttggacagaaaggctacagggtgtggtcctggctcttgtgtaagaattccgaccatgctaaccatgcctaggaaggaaaggagttgttgttttgtagaaggtgctggggtttgagagatcagtcggacacgattggcagggaaagcacgtgtgtttttatgagaattatgctgagataggtaacagatgaggaagaaatttgggcttgattgaagtaatgggggctgtctgtgaagctttgcagcagtacagccttggtaatttgctgagcctaatgggtgtcagggtcagtctaagtgaaagcaaagagaggctgggacgaggggtgcaggggaatagtgaaaaaagcatctttaagatggagaacagaatagtgagttgtggaggaatggattgaggacaaaagagtgtaggggttgggcaccacagggtggatggcaaaacaatttggttgataaggcgcagatcctgaactaatctgtaagacttgtccggtttttggacaggtaaaatgggggaattgtaaggagagtttataggttttagaagcccatgctgtagcaggcaagtgataacaggctttaatcctttgaaagcgtgctgtgggatgggatatgggcgttgagcggggtaagggtgattagattttaacgggatggtaatgggcatgtgatcagttgccagggaaggagtagagatgtcccatacttgtgggttaaggtggggggatatgagaggaagacgcgaaggaggctttgggttggggagaagggcggcaatgagacacagctgtaatccaggaatagtcagggaagcagataatttggttaaaatatctcggcctaataagggaactgggcaggtggggataactaaaaaagagtccataaaagagtgctgtccaagttggtaccagagtgggggagttttcaggggttttgaagcctggccgtcaatacccacaacagttatggaggcaagggaaacaggcccttgaaaagaaggtaatgtggagtgggtagcctccgtattgattaagaaggggacggacttaccttccactgtgagagttacccaaagctcggcgtccgtgatggtctacggggcttccaaggcaatcaggcagcgtcagtcttcagctgctaagccgagaagatctgggaaggagtcagtcagagagccttgggccagagttccaggggctctgggagtggctgccaggtgagttgaacagtccgattttcagtgggttcctgcacagatgggacgcggcttacgaggaatcctgagctgcgggcattccttggcctggtggccagatttctggcacttgtagcaagctcctggggaaggaggttctgggggaacgcctggctgctgcggttcaggtgtttggaagttcttgtgtgctggagatgtggctggggtttgtgtcacagtggaggcaaggaattgcaacttttttctattattgtacaccttgaagacgaggttaattaaatcctgttgtggggtttgagggccggaatttaatttttggagttttatttaatgtcgggagcagattgcgtaataaaatgtattttgagaataagacggccttttgaccttttagggtctagggctgtaaagtggctcagggttgctgccgagcgagccatgaactgggctggatttttatatttgatgaaaaagagcctaaacgctatctgatttgggataaagaaaaagaagcattaaccttgactatgcctttggctccagccaccttttaaagagtaaattgctcggcaggtggggaagagctagtcacagaacgaaactgtaagccagaccgggtgtgaggaggggaggctgaggaagtattgggacttagctgggtctggcaatgagcagcttggggaggacgggaaaggtcagatgggtctgtagaaaaggaagactgggaagactcagcgatgcttggggttgggaccaaggggacaggcgggagggaaagaaggaggatctgggaggaatcgcattgggaacagaggctagggagggaacgaagtgtgaaaaatgcctggacgtaaggcacctcagaccatttgcccatttttcgacaaaaattatttaggtcttgtaggatggagaaatcgaacgtgccgttttctggccatttagagccattgtcaagtttgtactggggccaagcggtgttgcagaagaaaataaggtgtttaggttttaggtcaggtgtgtgttgaagaggttttaagttcttgagcacacaggctaagggagaagaaggaggaatggagggtggaaggtggcccatagtgaaggaagcaaacccagagaaaagagagcgtagagacacggagggaaggggtttgggggttcttgcctcctagaaaagtgggacttgccgctgagggtgaaggagaaggggttgaggggtacttggccctgccccaggaaagcgggacttgccgctgagggtgaaggagaaggggttgaggggtacttggccctgccccaggaaagcgggacttgccgctgagggtgaaggagaaggggttgaggggtacttggccctgccccaggaaagtggagaagaggtagagaggtaggaacaaagagcaggaggacgggggattgatctcccaagggatgtcccccgatccgagtcacagcaccaaatttcatgcgtgtctgtgtgaagagaccgccaaacaggctttgtgtgagcaataaagctgtttatttcacctgggtgcaggtgggctgagtccgaaaagagagtcagcgaagggagataggggtggggctgttttataggatttgggaaggtgatggaaaattacagtcaaagggggttgttctctggtgggcaggggtggatctcacaaagtacattctcaagggtggggagaattacaaagaaccttcttaagggtgggggagactacaaagtaccttcttaagggtgggggagattacaaagtacattgatcagttaggatggggcaggaacaaatcacaatggtggaatgtcatcagttaaggctgtttttacttcttttgtggatcttcagttacttcaggccatctggatgtatacgtgcaagttacaggggatgcgatggcctggtctgggctcagaggcctgacaaaaaatctttgcacacacgtgtttatattagcacaatttgcaatagcaaaatatggaaaccaacccaaatgcccatcaatcaacaagtagggtaaagaaaatgtgatatatatatatatatatatatatatatatatatatatacacacacacatatatatataacatatatatatatatatacacacacatatatatataacatatatatatatatatatatatatatatatatatatatatagcatggaatactactcagccataaaaaggaatgaaataatggcattcacagcaacctagatggaattggagactattattgtaagtgaagtaactcaggaatggaaaatcaaacatcatacgttcttattcatatgtgggagctaagctatgtgtacacaaagcataagaatgatacaatggattttggggattgggggaaagggtgggggttggtgagggataaaagattacatattgggtacagtgtacgtggctcaggtgacgggtacgccaaaatctcagaaatcaccactaaaaagcttattcatgtaaccaaacaccacctgtttcccaaaaacctattgaaataaaaaaaggaatataaataaataaataacattattggaacaataagaaagccaaaaacaaacaaataaacagcaaatacaaataataaagagttttgatggaaatccattgaaatgttaattatgttttaaagcaggagtgtccaatcttttggcttccctgggctacagtggaagaagaattgtcttgggccacatataaaatacacaaatttttagctgatgagctaaaaaaaaaattgcaaaaaaatctcataacgttttaagaaaatgtatgaatttttgttgggccacattcaaagccatcctgggttgcatgcagcctgagggctgtaggttggacaagcttgttttaaggtattaatttatgctcttcttttccctagaagtataatatatacagaaaagtacaaaaaacatgagcagatagatcaatgaagtattgttaagccagatccaggaatagatatttccaacacccccagaaggtccgcccattatatccccttctagttatgacatcctccttctgcctcaaagatgagccatatcttgacttgtgaatttgtaattattattgctttttaattttatatgaataaaatcatgcaatatataatatattgcttcaagtctggcttattagccaactatgtttctgagatccttttatattgttgtaggtagctgtagttcatttttctgatcacatataatattttattgtatgaatataatgcagtttatgtggaacttttactgttattggaaaattgtattatttctaagtgcattcttctatgattattcttgcacatatcttttgggagatctgtgtaaatatttctctgttgtatataccagaaatcagaattatcgggaaattgggcatgcatatgacaattttaaaagataacaccaaattgttgtctatagtgattttattaatttgtactctttccagtaatgtttttttctatattcttgacaatatttgatatgatcagtctttttaaaaattttagccttttgcagggggatagtaaaaagtatctcattttggtttagcttctgtttcctgatcactaatgaaattgggcactttttaaaattattattggctatttggaaacctccctccctccccttggtttctaggaataacttaattcatttttccatattttaattgtgttgtctttgttttcattagtgattgattctagagaagagcacaatgttgcttttttgtgtaggaaaccgcttctactgtgtcgcttgccttttcactctcttaatcatgtcttttgataaacagaaaaatttaaatttaacatagttcaatctattggtctttttctttttgagatgttttttgtaaaaagtttaagaactgttttccttccttgcgatcatattttcctgttatcttctatagtgtattttgtccttcgtatttaaattataatgcacctgcattttatttatttattcatttattttcatggtgtaaaattggttcaatatacaatttttttctatagggatccaattgagccagaacatatatgaaagatgcagtcctttctttgctgttctacagtgccattcctaaagggaattaaatctgcatgcctgcttgagcctgctattgacctcttttttctctcttcctttgttgtatttgtaaatgccatattctagtaattactgcagtcttacaataagtcttaatatctgatagctattaaaatagactatatggtttaaaaaaaaaagaggcttgaattgtaagtgaaaccaaaggagaataaaatccaaagagaaccagaggagaataaaaattcatgccatgagatccaatccattatgaaaattgagctttaaaaagctttagaattagtgaccaaggcaaagagcggtacatatctttcattggataaaaatataacaactgtttctgtgagtataatcaccctgagtataaaaagcccgagggaagcttctcctgtgaacctgcatcaagagcagtgggtgattccgtggattatagtcccctcacagacatgcaatgctggcttttttatggtagcttcctatagcatatctcaaaaataatagctaccatgtattaggtatctattaagccttttacataacatttgttaaaaaaaaaattcccaaactatgtgcctggtttgctaccactatagccaatgtcactgggcatctcactattctctgactgtagctgttacaagagcatcaatagattctctaaaatgcagacaatagaaaggagttgctaaatttgtcaaattttaagtgaatctactgcttattttgttggtatgttgggtggctcttcttggtggaaggctcacaacctgtaactgactccagagcttctgcttaccaatttcagaaaactaggtttcgagtatttcctttgagcattccttcatgtgcttttatgaggctaactctccttccctatttccaagatggatactttgggaaggtaacatattctagttctcaaattgatgtaagtacatttatgttactttcttctctatttttgtagcagtgagggaataatgggaatttatacaaataaaccacatgagtatttcaagttctgtgatgttgatcacattctctgtgatgtatgctttagttgtatcttcctcaaagtaagtaccaaccttcctacagttatttctaattaaacaggataatctagtttaatcctcaaaactaccatgtaaaatagaagctactattataatttcaattttatatataaggaaaattaagttcagagaagtgaagtaatgtgcccaaggacatcaagaaatagtgaagttgggcctgtaatctcagcactttaggaggccaaggtgggtggattgcgtgagttcaggagtttgagactaggttggccaacatggtgaaactctgtctccactaaaaatacaaaaattagccaggtgtggtggtgggcgcctgtaatcccagctacttgggaggctgatgcaggaggatcgcttgaacccgagaggcggaggttgcagtgagctgagatcgtgccattgcactccagcctgggcgacatgagtgaaactccattgcactccagcctggacaacaagagagaaactccatctcaaaaaaaaaagaataaataaatagtgaagctaggatttgatgccagacattctgacatcttaaccgcttccttaatcattcaactaatgcttgtcaaatttaatgtgcacaggaatcacttggagatcttattaaatgcaaattctgattcagtaggtctaaagtgaggcccaagattctacatgtttaacaagatcacaggtaacactgatggtgctgccctggacagatatcagacggtgggtagcaaacagtctcaaaatgaaccttaggttaatgtctaaagacaatcaaatagcattaccataggggtcaacacaaggtgatagaaggaatagctctattatgatgtaaagaaatcttagggaaaaacaaatggtaattggtatttcccaccactaagatggtcattcaactatccatttatgcatccaaacaatgcatatttattaagcacctaccatatgtgtcaaacataagtgcaagcagtaagtaaaataaggtctattttctgtatttatacatctgccaaagtataaatgcagactcactttttaaaaaaggaattatatgaatgccattggaataaagcaccaggaaaaaaatgtgcttgagcattaaccaaagtaataggttttcaaactgtatttccttgccagaaatactatcctcctaggcagtgtttctactcatgacagaaaatgcaaataaggaagagtctccatctatagacgtgatttaacaagtcaattgcaggtgtttttcctcctttttgagaattgtgcggttgagagatctactttcacatacatattaatgagttgttttgcataaatcaattctatttttatgaatggagattatataaccctcctgtaattcttccagaaatcccatccaaacaagctactagagttcttagtagggtatgtcccttgagcacaaaggattttattttaattatttcatccatttttaagcaaaagtaatcaaatataaacaactgtgctggaggctgcaccctctgccagctgcctctcagccttctgaaaggctctgtttttgtgttgtttctgttttgtttttttgttgttttttgttttttgtttttgtacttttctcagtactcatttagaaagcaatcctattgtttttatttaaaaaggtgtaaaatgtagctgattcaaactttaaaatttatgatattcctctttggcaagtctagctgactatgggccctgaatattattattgctataaatattaaaattaataaaagcttatatgtgtccagtaagccaaaatatgggaaaacatttcctgagcttgcttaaattttcacagcaagtgaatggcagagccaggactttaaacctcggtctaatggacaacagaaatcaggcttcaaacacaacactggcatttcaaagcatgtcccaggtggcagatgtcctaaagaagcatctcacttctacctgtggttccagttagctcactctatcctccaccttctttccatagttaacaggggaaaatgtcagagtctgtgatgcactggataaaattgtcctcccctgagctccacgttttcacagctggagtgaagaaggtgtcttggcaagattcccacaaacacacactcaaaacacacatcctcactcccatatttgccttgacatcaccatctctgcttttacgaggtcttgactcctgtgtacataaggcagcaagcctggaattcttaggtcacccctcattgcccaaaccttcatctacatagagctctgaatgttcccgtatctgaacccacttcccaatcctccgcagcttgtgaaattcttccttgggcctcctaaaaccaaaatcaataattagcaaaatctttgcacacttaaagttttccctgaaagtccccctgactgtgttgcttcaactgacatttggcttccatctgaagatgcttctcctctctggctgaactgctgattcttttctccaatacccctcttaccacaggtctgtcagtagggatagagtcgtcccatctcctccgtgccatttccagatgatccctcctccctcatatctaattcctttgccattaaaatcatgccattagcccgcactactcataacttctctttgttgcaatcatattctcatcccctaaactccaacatttcttgaagattttacctattagctcactgtcattctctgcataatactcctgtcgaatatcttggccatttcagcctttggtgaatttggtattcagtactcaatatcctgatttgccagtttcttgacttctttcgttctgttgcccttgtttatcgacccatcttagccaatagccacgctgctaagatgactcttttaagactttgtcaatgtctaaagttgccagttccacccataatctgattttcaaccttcccaaatttgactgtctgactcactctctccagtccatggactccagcaatactttgactctgctagatcctataattcacgaatcctaacaactactcctgtccttctcctgcttcgtcttgtcattccctctatactgagacaaaggcaaaaaacacttcttctcattaacttttaactcacttgctcatcacttgcacatcaatgattcactttcactttcccccttatttcattcatctggtgaaatctaagccatgatgaaatccaaaccaaaattttaatctagtgaaaaatccaactatgacacctgctttcactttccaattaatgaccaccgacatcagtggtccattcagtgggccattaatgttgcctgacattaagtcaccatgaagctcaaagatgttactgtattgccggcatcttcagtctagaaaggccctctgtaggtggaaaaaagtatgagctagtatttttctcctataaaagtcaactaaatcatcctcacatacctcaaacaacattttcctgaccctttaatataatttatgttataaactgcttgatacttagttctgattcaggtctgactcattgcctagtccctgagccaggatggactttggctgtacttgagatgtcaaggtaatctggcactctgactaactagatgtgtttcagttgcttacctctagagttatttccccaaaataattccaatgaaacgttaaaacacacaacaaaggcagcctctttctttttccaatcccatctatcacataccattggatttctgttttgctacaaagtcctgaaggttttggccttttatttttatctcacaacctaggcccacttcttaaacattgcctagcttgcctttcccttttaaaatctgccaacaatcactttctctgttgaaattatctcttcctacatccaactgtgggaagaacagccttttcattgtgctgttctctgaggacaagaatagaagcacattttttaattcttatttttgtgtgacttttttctgcttagtagttaccagtttttactacaattgtgattcctgacaatatataacatttagaaaataaggaaaagctattaataatatcacctgagccagagacaaccactgttaacattagtagattcttctaaaattttttcttatacaaatcataaacacagatggatgaatatttgttaattgtggataactatttcactttacggaaataatacaacaaacactttaaaacattttccctactagtcattttagaggatattttaacaaaaataataaaatacggagaacaattaagatttcagaattttcaaagtttgcatattcatgatctgttttttaaaattcaggtctcctgactaagatgcttattttactgcagagaaataagcttttgtggataccacactcaaggggaaagacaggcttattctcgaagcaaatagagggtccttcctgccaatatgacctagagaaacagacaaatagtgagaagatgcatctccgagaaccttcaggctgggccactgtaaatccggttggatttgactcaacccagggcataagtaatgttctcagggcatttccttaacgaagactccctattgaaagaaggtatagcatgaacaatgtcgggaagtcagaatgcttaatttctgcattttcttcctctgaactgctaagattgtatttagagacaggtagagtcctatgtgcgtgttctaatctagttaatttacttcaatcatcctcttttattttgccagcaggcaaagccccttcagaatacctaattattattccagactcctgtcttagttttcatcagaggacttgtatatttcattagcttcagtccttgtaccacctctccttaccaagcccagcattgtgacaccatgtcctttacccttgtgtttttgaaagcaaaagaagaaacgcatacatttttattattcattcttttatctcactagtcttgttctgcgaaaatttgagatctcaatagatagtgaaacagtctttcacccttttccatggaataaatagttattggtgtttatatactctataattattatatgttgataaatggttatgtaatagctgcatacagggaggaaaagtccttgcaggtaattttgtctgctaattacatataaattggttaagcagtcatgcgtattgatgacatcgttttcaactgatttgacttctcaaaattactaaacttctacctggtcatctaaggcaggacaatttttccccaggatgaggggttggagggcagtggtttcagcaggtattagattctcataaggagtgcacaacctagatccctcgtatgcgcagttcacaatagggttcacactcctataaggatctaacaccgctgttgatctgacaggaggcagaattcaggcggtaacactctctcacctgccactcacctcacctcctgctgtgcagtcagatttctaactgtctatggcccagcactgcagcccagtggttggggactgctgatctaaggaataatctcagtctttgtctctctttatccaaaacaaccataagtctattatataaaaataatgtatgtatgtatacattttgcatgtgcttacatgtctctgcgcacacacataaatttatataaatgggattgttctagtaaccgacatttttctttaaaatttttaagttataaaaaatttcaaacatacagaaatgtctataaaaatattataaacagatttttatttaaatgtgtgttaatgtttttgcatttttgcttcagatcttttttaaagacataaaatataccaatactgccaattttcatctcgtgctttctttccctcccttcccagaagtaaccgctttcctgaagttggtgataattttttgaagtatggcttgaaatttttattgtctttgtttataatatttatataaatgtcatcagagtacaatttctttggcacctttttcactctacattcagtttttgaaattcagccatatttctacgtgtttacttattttaaatgttgtgtagtatttcattggattaatgaaagaagtttacttcgtttcaacgaaggaatgagaataaaatttaatcctgttttttcaggaacaatacactataaaggtatttttatttatatccatcaatttcacttatttttattgagctattatcatgtgtcagactctatcatgtgtggaagttacagtgctgataaaacaaacacatccttgcctgccatgagtctacgaaagcagtaggagagggatcacataaatatgtacagcataaaaaatgtaataaatagtctgaggagactctgagagactaaaatgaaaaagttatttattggaggctcaagaaagcaggattcaagatggatgaaatttccaatgaaggaaaattaaggttcatcaaaattagttatctgttagagttttttgtatctaatgccacagtaatgtgctgaaacaaagcatgaaaaaaacccatgatgtccagcagtaaacatttatttttggtcacgaatttttggtttactcggtggttcctctggtcttcttggggttcagttttacattggtggtcacatatgcagttacgttaatcttgctgggctaattcattacgtattgttggcccaggctggggcaactgcagtgatttatttcttctgcacatggcctctcatgctccagcctgctactccaggcttttaccatggtagctgggtggggatccaagagcaaggggatagaaggctacacagctacttgaggcatatgctcagaaccaatatattgtcacttctgctgcattttgtttgcaaagtcagaccagattgaggaatggtgaaagagactatgcctctgatggaagatgctgcaaagtcattgcaatagggtacaggaaggtgaaaaattaggactaagttgtaatcactctcccatggtgatatgaggaatggggtaagaatattccatagacggaaacaccacgtttaaagcctatgaaattggaaggggctacgtaagacatttgaaaatggaaaaaaaaaaagaaagaaagaaagaaagaaaggaattgtggagcctattgaggaaaaaagggaatggtgtcagtaaaagctggagaaattggcagggaccatattatgctggcattattgctaacactcaggattttgaattgtatcctaggaacagtagagctccatacaattttaagaaatgtattatttaattgatgacgttacctaatttattacatgatttaatcgattatatataatctaagtttaaaattatttttattatttcttagagtcaaggtctcactctattgcccagcttgagtgcagtggcaccatcacaacctactgcagcttcaaactcctgggctcaagcaatcgttttgcttcagcctcctgagtagtagctgggtccacaagcttgcaccaccatgactggctaattttttattttattttattttagttttagttttattgttttttgagacagagtctcgctctgtcatccaggcttgagtacagtggagagatcaagactaaccacaatggggatccacctaagctcaagaaatccactcagctcagtctcccaagcagctgggaatacaggcgtgtgccaccatatccggctaatttttaagatttttttgtagagacaaggtctccctatgttgcccacgctagttttgaactcctgggttcaaatgatccttctgtcgtggtctcctaaagtgctgcgattacaggcatgagccaccaagcctattatagaatgtaatttttaattaaagttatttgctttatctgtattaaaatatcttaagaattataattttctaagttatgaaataatctgggagcctattgagtcattaagatgttagacgtgaaagtgtgggtgagaggtagcaatggagactaagaaaactgagatatgattgagaaattttggatgttaaaccaataatatttgctatgaggtgggatgtgggttttgagaaagaggatagtatcaaatatcgccaaatggataattgatatttattatttactttgatgaggaagacttgaagaactactttgaataaagaattaagagttcaatttcagagatgtcctgaggttggatataagggtctggattgccaacagaaagtctgtgctaaccatatgaatttgagaattatctacatataaatgttacttgaagccttgggagtagttgaagtcaccaggagtaaatttttcaatcaagaagaaaagaagacaaaaaataaatcccaaataattccaattattagacatcagggaatataaatagatatgttcatggttttaaatggctacatatcatctgattatatgtctttaccataattattctaaataaatgtctcttattggactttgttaggcttcattagacagtaataaaataactatctattatatacttctttactcatttgccaattatatccgaacagtagatactgggaagttgaattgctgggaaaagtaggttatacattttaaatgtgaatgcatcttgattaacaacctttgaaaaatggttatgccaaatgatactttcaacagcaccacccgaatatgctattacatcaatccctcttgatattatgtattgcttaatatgtacccttagcaatctgatgggtgacaaattcttgttgttttcatttggatgtctaggtttatttgtaaaatcaaacttttcttatctgtttattggcaatttaaaattattttgtaaatttcctaaattgggtctttgcctagttttctgttgaaggattcaaattcatttccaggaattattttaaatatgttaatatttttcttttacaaattatgtgaaatgttcctatttttattttaacttggctagttgtgtttttatgatacagaaattttagcaaagaaattgttttgtaattcaatttctctctcattttctttataatgctttttgtggcacatgcagaaacattatttaagccctatgattgtaaaaactatttttggtcagcactcttataatttcattaattccttcgaggccttcgattcaccttgaattttttgtaatgagcctgaggtaaacacccaaccttgcttccccacccctgccctatgaaatttccccaattccatttaataagtagttcagtgttgacagagcccattttctacttcaaatccaagaggttttctgctgtggaggcagtacaatatagtagttaagagtaaagttcccaattactctaaataattttcccttcacacccctcccggcagggtagaacactagctggtgagagcgagctattctacaaagctcaaagctacaccgaagggtcatatttctcctctagagaaagcccatttaacaacaaaagacaaacttttaaaatggcagcactgcctagatactaatggtttctgatgccttattcttcctgtaaataggtcagatataaaggtttagaagtcagcattaagaccaaatgcagcatctaaactagagaaagtgagtgaggaactgccttgaagtccattctatcaatttcattttaacctgatttatttggctatatgtttgccccctctgcatttcctatatcagctccatcacaaatcagtcccctccaagttgtattggaaaagcaatatatgtgattgagatattgttaacaacaaagccaattctggtcccagagctgttagattgtgattgataaaacttaatattttgaagggaggaagaaaaaaaacctattattccagttcttttatttgtagtgtgggtgaagttccttttatctcctctactttcattgtagcagtatgactgaaattccaataaattattgaatgcaatatccagatgtccagatgattttttggtgctgctgctacttcttagtgagcaagacaaaagatagttgaggttctgcaaaaagtgtcaaagcttagcaataaaataagatttcattgaacagaaactaatggaatcactcaatttatttccctttcactgttgtaatgcagggaaatcttgcttcatacgagtcacaaagcttgagtgtgcagtggcctggctctggcattgcatggtttgtgtgtgagggattggaatacctttaataaaaaagcgtggggtgaagcagcttagtctttcaaataaaagaagtttcagtgtctgggcatcatggctgtttaaaagtcaactttttcaactttttctcctcgtgtcacctttttaatattcttggggtccctgaagacctatatctccagttcatcttggcatacttaggttcaggttttatctgctccatggggacagctacctttttcttagagtgcttccattttcttttctcagatgcactttgtagctgtgtcatagattagccaagcatgcctgattgagatattaatctgaaggagtgttggttaagagacagaccagtggtcagcaaaccttttctgtaaagagccagatagtaaatatgtttgattttccggccaatgtctctgctgttattgggtgaaagcagccacccataaacccattaatgtggctgtgttccaataaaactttattcacaaaacagacagtgagtaggatttagctcatgggttgcagtctgcagagcactggagttcactcagaatactttatagatgtgtcctaccaatgatgactgttaacatttattaagcatttgctaaaaattctccttagataatctcatttctcatattatttactaaaactaaagtgtgggtactatttataaccatgtttatagataaataactgaagaagacagaacaagtaatttactagtacatggtagaagggcatttgaactcaggctcactctagggcccaagcttctaaccactctgccataatgcttttctcattaattaatagaaatgcaaatgctgtgaaaatccattttgttaagatatttttgtctaagtaagttttttttgtttttaattaatgacgtgtcacatatgtttcagcttactattcacaggacactagattactattattatttaaatgtaattatttaatttctattttgggaagattaaccatgaatttactggcagtggaaaaacacaaaggactaaatacaagatgcataaagtcagcatgaagagatgaaaacagacagggatgtgaacttacatgagttgagtctttaaattctggctctgtcctttacaatgtatgactttgcatgttacattctgagccttaattttctcattcatgaaactagaaaaacactagctctatatctacatcaaaattattttgagaatctattaaattacctaatgtagacatgcttgtatagatgtatccatgtataataatatttgcagtatactatatgtaattatatacatacacacacatacatacaaacacacaatagtatatattagtcatttttatttagaggaataaagaaattctgtgtttaaatgatatgttaaaactgctttgaatttggatcaaaatttagagtagattttcacaggttctgaggcataaagagttcttaagggtcatgtaggccatgcctctgtcttcaggaagagatatccttaagccaatgcagatgagatcctgtctatttcttttagagaaacaatttagtgaaagtgcctataaaccatttgctgatagaaagacaacctcttgaatacaaattgactccctgattgcaagtgactttgtgatgacaagcaagagaacttttcacaaacacagaatatcaaaaacattttttgtttgtttgttttcgggagtcaattgcctgtgtgcctgtggcttccggatgggggttccgattcaaaacatccagaggctccatcagtacttactatgcaacataacacctcttagtgtctagaggtgagtcttaatattttataccattaactgtgtagtcccaaagatagattcagggcagatgtttgatgtttggtttgctgagtaccatagcgagtttctctgcctatctttgacatttttgtagcagtaaccacatcacccttcttaatcactggtgctttagataataattccctcaaataaaacaaaaactgaggtgattttataacacattatgatatggtttggctgtgtccctgcccaaatctcatcttgaattgcagttctcataatctccacctgttgggggagggatcctgtgggaggtaattgaatcatgggggcggttaccctcatgctgttctcttgataatgagttctcacgagatctgataatttaaaggggcttttctccttttgcttggtacctctacctgatgccgccgtgtaaagaaggacgtgtatgcttccccttctgccatgactgtaagtttcctgaggcctccccagacatgctgaactgtgagccaattaaacctctttcctttataaattacccagtgtcaggtatgtctgtattagcagtgtgtgaacaaagtaatacacattatattctctcctttttgaagaaaaaattaagaaactggctgttcaaacttaatgtgaagtatcagagaactctatgtgcgatggggaaaaaaaaattagagaaacattggtttgccaccagtggaaactaaccagtcttgtctgtttagttcattgttgcattttcagctgctagagcagtacggggcacattttagttacttaataaatttggcagatgagacttcctttaaatgtctacagcacaatctctttggctttctgtgaaagcagatctcatggcgaagacatggactatgtagtgtatttaggtggtattctcagaagtatggtgaaggagtaggtaaatagatagcaaaaggagaaaacccaaaaactgatgaagaataaggtaattaattggttgtcattgtgggcaattgtggctcagtacagctgagtgccccctacagctatcaagcacatctcattattagcccagcataggccaaggaaactgggacatttactcattaccttctgtacctcattggttaaggatcagtcctcaggacttcaatttctggtaacctggcctgctttctatgtagacaagtatgtgtctgtggaataaaaaataatttctcagagcattctcaggcagagcaacccaaatggaggcagcaaaccctctaacgtaactgtcccccaatgtgacaggtaacttcctaaatgggttgaacagatatatgggatatggggcacctacagtggctgctacaatcatactttaaaagaactataacacttttggtttcccatgtgacagtcataatgtgagaaaattcaagaaattagcttgatatttacattttatcacataattttaatttaaaaggtcacatgtaataagacaagaggaggtgtaaaagttcagagatagcagttccggaatttcacattttttcccgtatacttggccctagtatttctatgagtaaataggttagtttttagttgttcttggtaaattactggatatgcgactggactgcacttatgctatccttcaaataaatgaaaaacccaattgagacaactggacagtgatctcctggattaattattatactgaagatgataattacagtttctgcctgtcttataaataagcagtcctcagttgccaaatgggcaacctcttttctgcagttacagatgtgcggcattaaacatctcaaaaatccgaagtaagagtcacaagaggacttcatggtaggctcaggggcagagaagcttatgcagtgttgtggctaggataagccaaagcaatatgcagtctgagatgttatgggggcatgaactataagtaaaaacaaggagactgatcagctgggaagacagtggagcagatattcatgcaaagcagagttaacagagactgggacacctgtagataaaggaacctagagagggaggaagagaataattggcaggtgtggcaagtgtccttcctgttcccagatatgcctcctgcactttgttggtctaagatttctcttgatcctttttaactccacccccgctttagtttatactactttaagtgaatttcatttcctggcatgtaaagagacctggcgcaaacaatgaacacacaataatcattgtagcagaaattgaaatgaactagaaaatcaaccagttggtcgtttaggccttatggcattgtgctaaagactataggtcatactttttgggatttgaatctttgttctattaattagtaaccagttcagtgaccttttggcaagttttttgaacatttctgggatttagcatttcatgtgtaaaatatatgtaataataataaatatttactgtacaatatgcttgtatagtacccacatatatagtataaattttatgaagattaaatgtaaatataaataaatccaagaagataattggtataataaaaagaaaaataactaaaaaataaataaatgtaataattaaatctacatatcgtttaaatcaactccaagtctttgtaagagttataagttatttagggccatttgacatgtagtttttaaacaagttacttatttcatttaagtctcacaacagtcaaataatatacctattttcagaacattttatagatccattcacccattcctcttttcagcaaatgttcttgagtgccctttgtgtattagacactgagcatattcagagaaattgaaaaaaaatgaaaagtaccattttaaatgtctcacagcttataaatccaagcacttcattcaagcacagatttatctgactccaaagcccaaacattttccttcaactatgtgaacactctttttatgtgaaataagcaagctttccatctgtttgagggtttttctgtctcccctgggccccagtctcttataacctaattttggaagtgacaagccataatttgaccagactcagttggttgtgcagactaatgctgacacaatgcggcaatacacaaagtggtggatattggaagcgagttcattcggggccgttttgcagcctagctaccacatgtttccaggtcgatcctagcctcttctctaagaaacctttaatcagacaaatttggtcttttgctctcttcaattcctaaaggaaatattgtagactatgtttgtagtattttgtatgcattcactcgctttagaggtataattatttcttaatttattaaacatgttcttgttgaatacctgctttttgcaaacactgaactcgcgggaaaacaaggtccctgttttcgtgaagcttatggtctatttagagcacactgaaataaagtaaatcaataatcattgctgacagtgactgggcctttggggaaaaatacagagtgatagggaactgctacgttagattggttagccaagggagggttcactatgtggtagtagcaagtaggctgagatctaaatgtcaaaaagaatctagaatgcaaagatctgggggtaagttttcaagcagaagaaacaagaagaccaagggccatcgggggaagaaactcattatgttccgaaaaacaggaaaataaaatggcagctgtatttggaatgttctgaacacaggtgaaaggatggggtaaacagggccatatcatatggggctttaagtaatttagtaaactatttaaagtcatctttatttctctgggttgactgatcattaatcaaatattttttgagtacctactgtgggccagcacttactggtactgcaaaggtaaacctgtacacattttgtggaaaggcgctgatacaaacaaacggtggcagccaagtagggttattttttgaaaagattttataaatacatgagttagtgaacaaactctacatttaaattactgttatagcaaattataatgcaatgcaagcagttcacctctttgtaaacttattgaatcagccaacatgtcctgaaccacctgtctttgaggagcagccacatagagagaggttgagtggttgatgtcatttgggactaaaagttccagtttcagctttgactgtaacctataacttaaaccagcttcatctgtatttttaaaattatttttaaattttatttttaattaactaataataattgtatagatttatagggtaaaatgtggtattttgatgtatctttagattatggaatggttaaatcaagctaattaaatttgtcaccccacatacttgtcattttttgtggtaaaaacatttaaaatctactcttctagaaattttggagtatacaatacattattatttattatttttaccactctgtgcaatagatcactaaagctttttcttcctgtttcactgaaacttcgcactgtttgactaacatttccccatttcctatgcacccctctcccccagcctctggtaaccaccattctactctctacttacatgaatttaacttttttgattccttgtatgagtgagatcatttggtatttgtcattctgttgctggcttattttacttagcataatgtcctccaggttcatccatgttgccacaaatgaccgaatttcctttttttttttttttttttggctggatagggatagtattttattgtgtatatatgccacatttttgttatctattcacctgatgatggacacttaacttgcttccatgtcattgcattcaccagaatgcagatatctctttggcatactgatttcaatttctttggatatatacaagaagtgggattgctagatcatgtggtaattctatcattagttgtctcagctagcactctctgcctcttcacctctaaatgaaacctagtcactgttctctggaaaaatcagtgtccaggtaattccagtgtaacccaatgaacagacatttccatgactacttctggctccaacttttgctgaagtcccattctctgctctgggtcttacagttttccctccttctccatcctggttcttactcaagagtagaaatgttttcttaattctgtccctcacacaacacacttgataaacacatgtctatagatttttgtttgtaacaaaatgtttgtagacatttaggggaggagtattggcaaaagaaaacacaaattactataagcagaaaagactatttctaagagtccttcagcattctatatcttgattttctttttgtttctgttctctcccctccaccaaatccttcatcatggcaaatgcagtcagaccactttggttgtctcaaagatgtcttgtctcctgatatgccatgtcctctggagctcagatggcccgttttcctcaacaaggtttttcagctttagcctgaaacacaaaaaacctttgtgttttttgaaatatcaatgtactgtctgtactatgttttatttttcccaaattgctttgattttttaatgagtaaatttgtttgaaaaaacatatttattaccactgtatctagaaagccagtgtcattcatcacaaatagaacaaaactttaaaaggcaatacatagttatataaagttaaaggtgtttttttttttgcataacacctaagtgcgtcacccatacaaccagtgatatctctcccacacattggtaatgtctcttctgcttatctctcagggttactatcaacattaaaaatgatgacagaaatgaaaatgctttggaaaaaagtgagattttatttaatagtctctctttccctccctccctttatctaaaccataatgcatgcaagggtccttatcactgaacctaattctccttagtgctgagctggagaaagctacaaagaaaatgccgattgcagctgtgattccaaagaccttgcttggactaagaaaattcaacggaaaaatgtcagtatttaccatcaaccctgcagtcactctcccgaattccagttgtggaagttcttgcaaaccgaaaccagtaggataaaaatctctggtaaactcagagcttatgtccatgggaagtctttaaaaaaatgttcttgcttcacgcttcttgtataaacaggagcattaagacctttacccaggagctctgtcccattacctccaaaactcggccttttgtattttacataggttgcaaattttgcaatctaactttctgattaaaccatcacaatgaataaaagggcttattaagggctctgtctatgaaggaccatagcaggtataatggttcgcataaaccactctttccaagtgacctcgggcctcactccattgaaatcactctcctttactctaatgagagtcacacatgtgaatcaagagggagctataaatgcagttgttcttggaagggcacaggtgcacctaatttgccaccaaaaccaacaccttcagccccctttgctgatgacctggcccaggagtgaattacaagtgagcttctggccagactccctcagacctctgggaagccagtggtcagcctggcccttttttttttttttttttttttttggagacagagtctctctctgtaacctgcgacccccaggttcaagcaattcttctgcctcagcctcccaggtagctgggactacaggcacacactgccacgccccactaattttttggatagcctgaactttcttgttacctaccacctgctaagacttaagtacaaggtcaggatgtacttcccccagtgacagggcagactctgtttgcttgctcttggataaaaagaaactgtttgcagccctctttttcctctccttcctcactttttttccctctcccaccattgagcagggaaagtggtatcctgaatagctgaaaatgaatcagagctgggtagtagtccctattcaataaaaggcctccttttatttttttagttatgtggtcttgagcacattgcttaacctttctgagcactggtgtgtatatttatgaaatgggagtcatatggggtacctacaactcattttgtttataaagttcaggaattgggaaggtctcagtaattaagaggtccccggctcctgtaccaggaagcccctctcacggtacacctctatagctcttagctgttgccatcaaatatttaaccaaaatctaataaacacttgatattggagaaaaattggaatgctgatatccaagtaggaagtaagaaggtcttttaagagtttatagtgtcgaatccatttacggtccaagttaaaatttctctttgggaaagataaaataatatttataaaaattaacaagtggagagaaagtgagttgttttttggcgtcctgggaataatgaattcaacaagctgatctttggatgagtcactttagtgtctgcaatggcaatggaatatacacgtttcttttgccattcagggcttcctcagcagaaacctcacatttctttctgaaaaaaaaaacacgtcccttgatgacaccactgatgacaccttgatgactttcccacatgaggatgatttacctgaagatttggccttttctggatactcccctttttgcctttgaacaatatttatatcacatattaatcccaagaagcacaaattgccccaaagaaatctctttagagattattgactacaaaggttttggcactgtcctccctgcagaacaaaaggtgagaaaatgaacatttgccaaaaggcaaagcccaagactatgagaagcagggcagcctaggatttttctggctattgtatgtccacccaagaggtcactgctgcctccagctgggctgtgtagcttcctaggcagtgagggtcactaaccatcagtctaacaacttgtgtcaagttggagaaacattctctggcataaaatagagagtgggctgggcgcggtggctcacgcttgtaatcccagcactttgggaggccgaggcgggcggatcacgaggtcaggagatcgagaccatcctggttaatgtggtgaaaccccgtctctactaaaaatataaaaaattagccaggcgcggtggcaggtgcctgtagtcccagctacttgggaggctgaggcaggagaatggcgtgaacccgggaggaggagcttgcagtgagccgagattgagccactgcactccagcctgggcgacagagcgagactccgtctcaaaaaaaaaaaaaaaaaatacagtgtgatgtggcagttcttggaataaaattcacatatttttgactttaggtctcctttttgtttttttccattcattcatgagcatttaagctgccaccgaataggcacagaagtaagtcctgactcagtcttcaagaaaatatgtctcgttacatcatccgacactgagatgaaagctgaaaaaaaagccagtttaaaagttcaagctgggattggtggcacacacctgtaatcctagctactcagaaggctaaggcaggaggattgcatgagcccagagatttgaggttacagtgagctatgatcaagccactgcactccagccgaggcaagagagtgagaccctgtctcaaaagttataaaataaataaaataaaaataaaaattcaaaacatcctaattttgttgatgtgccctcgtatcatcagtaatgtgattaaagtccctcacatcatatattttgtacttaacatcttctacacactttaattgtattatgtcattttttttcctctgaggcaggtactattgttagctagcttattttaaaagtgaagaaaactgaggtagaaagatactaaataatctgccctaaatcaatagctagtgcatgcacggccaagctagcatttgaatatagatagtctgaccctaaacttgcatttttgatcattttgttccatcactaagccttttaaggaattcgttagtgggttatttaatctattttgcatgctacctacatcaccttcctttcaggaacaccaaaggccagttgccttttactagttaagtaatctggcatctcaatgtatcctatgcagttccataattgtgttctgtttctctcatctacttttaaatgtagggaatatgccagcttagtaagaagcgagtttgagtctagcccacatctagcacttgtatatttatttttgtcataagtgtcactgttcttaccaccatttgtcaggcaaatgtgtctattatagaaaatcaaatccagtctgacatgtatattatcatagaccaattacctaattgatatttcatattggtttacttgtttaatttatgaaatgtttacctccctgaaaacttaagtgctgggctgttagggaaaaacatgcattatgtgctccttactattatcctatctattttttcataaaaaaaaatgcttctcagtgaattcattatattcccagaaaaacaagaaacaacgcatttttttctctacttatatataaatttttacgaaaattcttttacacccccaaaagtgaggaattttaacttggactgtaaatggatttgacaccaggagctcttaaaataacttcttacttcctacttggatattagcattccaaatgtatgaccagttctaagatttagctattgcctcttttacagcgtttgacaataacattgtgcttgattaggttatgtcgtgttgtgttactgagttatgctaggaaacataataatatcatgaacaccatgactgagtatatagcatccagaaaacgatggtggaaaatgaaactggtttcagtagagatatttctctgtgccaattaataaaggcatgggaaaattagttactatagaactaaaacaaaatcactcaagaaataggaaatagcaacatgaacaattttggtattattcataactggtcctcttcaaagaagagaagcatggagagatacaaatttagaataacctcactataatgttttgagattcttaagagtattttaatactgaaagttgcatatatcatatctgggagttctgtgagacttatgcagatttggggatttgttttcttggtgtctttcaccatttctcttttgctgggcagagtactggcatttctttgccccgcaaaatgtttttgccgtaggccaaaacaaaatacataccttcaacatgggaaccgcatcgtgaaggtgaacaagtgctccaacatcttgtttactccagaaccagctttcagtgctaaaacttcttcagaaggattctcaaaggggggaaatagtatttggttgacggaaaccagaaagcagggtaaaataaatcatagagtttaaaattagacctaacgtctttgaagtgaccaataattgaaattgcttctgaggtgtgaaaagagagaaaaggtctgtctgggtgactttctagatagagaggcagtatggtctggtggttaagcgaatgcactctcgagccacaatatttgtttctttactttgtctttgtttgtttgtttgttcttgctttttgagacaaagtctgactctgtcacccaggctagagtgtggagtgcagttgtgcgatcttggctcactgcaacctctgcttcctgaatagctgggaccacaggtacatgccaccacattagactattttttatatttttagtagagacagggtttcaccatgttgcccgggctggtgtccaactcctggtctcatgtgatccgcccaccttggtgtcccaaattgctgggattacaggctggagccatggcgccttgtctagaaacacagcatctggaattaaattttatttcctttacttattacctgtttgaacccatacagatcaatcaatttctggtgtgacagcaggagcagagagagctgaacatcttggcagatgaaagcagcgggacattttcctcctgctcctgaaagagaggattgtagtagggaagttatagaagagagaaggcagacgcaagtaagaggagtaactaaagggcctttaggagccatatacccaatatttcattctaaggtgttcgagctgcatatgaatatatcagtaaggctgacacaggctcaaaatctggtagtggtgatgcaccacacctctgttgtatgtgctggtgggcggtgcatagctctctatgttggtcaaaataaggggctacattctatgttcacatgcagatacagggagagatgtaagggtggagataaatcgagaaatataaagagaggtacaaataaggattcagaggattcaggacatcagaaacagagccacttctagaaactacaaattcttgggggagagaaagcacctttacccctccgctagcaatttgtacaactttttggaaaagcattaggcttttgatggtttgaccatggagtattagtttatgttaattttgtaaattataagtggcaaggagaccccaggtaacatctggagagcagtgttttagtgtgaaccgtggaaccagagggatatggttttaatgtatccccacccaaatcccacattaaattgtagttgccataatccccacatgtcatgggagggacccagtgggaggtaattgaatcatgggggcaggttttacccatgctgttctcctgttagtgaataagtctcacaagatctaatggttttataaagggcagttcccctgcatacactgtcttgcctgccgccatgtaagacatgcctttgctcctccttcaccttccaccatgattatagggcctcctgagccatgtggagctgtgagtccattaaaactctttttctttatgaattatccagtctcaggtatttcttcatagcagtatgaaaattgactaatactcaaactctctttttcaaccttatctggacacatagaaattgggtcaactttggtcagtggccagtcatctgtgaacctcaatttcctccttcgctaaatgaaagtgacaatggtacaggtgattgtgaggattacaggtggttctgaggattcaatgagtgtacttatcagagcatctgacatataatggctattctccatatattaaaaaatgaaagaacaaagaaaaaatttaaaacattgcaatgaaataattcatacatagtaaatgggaaaaaatatatatcattattcagatttttaacaactcagctgagtgtactatgtcctactgtaagcatgcccatttttctggtgaatattttccctatctccagcttttcaggtgctgtcttcttggtcctgatcaatggaccctgggtacccatagccttccttcaagcttatgagacttggcaaaccactggcctccttctgtgtcaggggctggcactgtcaagtgcatcgtctgattgtgatcctcaggccttggcagcaaatgtacagttttcttgctttaattaggctgagattcattcctacacgtggcagctgcaaagatatattctcttacaattagatgttacaatacttgtattgcctgaaccttaattttaagtacattttggtggcccttgtccctcccttgcaccttggttgctccaagagagagcatatggcccagtaattctttaaagctcattttatgggccattctcaggcacttcctgctggcctttggaacagagccttattcgtgactgcatttttgcttatactcctgccaaatgcttcctccaaaaccagcaatcaaaccacaggacatgataagccatggccatcagaatggcttaatgagagcaacctcaacaatcaaggtcattaacagcaaccagcactgcaggatttgtatcccgtgcacaagggcagcctgggcaggtcacctttgtggtctatgagaatatctccaaatattatagaatttgagaccatctcagagaacgatctcattctaagcaattttcttttaagcaaaaatggataggacaaaaatagaaactggtggttctctctggcctctccttgtagaagaataaatctagagtttttaaaggtcttacagagcaaagaaaatattcgctggatgcttgtatggctacctaattcagtcacccttgcctcagaaaatgatctgaattaaatcttgtttccagctagcagaagggtatttgaaatacagattggatctgtacaatagaccttgttcaaagcatatccacatgagatggtacatagtttaaataaggcagacttatatcttgtctatgatctgtgtgctattaaacagttttaaaacgtgaattattaattaaaacctgtgaactactaacattttggaatgactgttttgatagctaacaggacttgtgtgacttttgagaggcgttgatttcctttcatgtcagctaatagaaatcccattgtaatcataaaaggcacagagaaattatgtcacaagcggatgctatttaagtggaagtgaacacagaatatattaaagtatcagtgttcttatcagcagtgtcttataatgacttctgattaacactgaaaagatgattgatgttcctaggattgtggagcactgacaatgtgacactgagagaattcaatccaaagcttgttaatttcatagaatcattcaatttctcattactcctttttgacagtgtttgtttttgtgaccattacaatatagtcacaatttaatggggcctttcaaaaacaatagtaagaaaaaaaccttaaaattgtcacctatgatgattattactagaaacagaaacaatgatttcaatatattaattttttttgttttaaaataaagcttattaggctgatttttattcaggagtcatatttaaactgatacaagccaaagtcatagaggactcccaagtcaaggcaatagttcacatcaacagcgccaacatatgtaggctgatttagttttttcatggccaaagaagaaaggaagcatatttgatgtaaattcctgtatgagaaacatggtaggcatgccaggtcctaaattagtataaagctaatgactgctgattgagagcaggtggagaacgggaagggggtgtagttgaggatcagtagagtttatcttaatacttttgttattaaatacttttgttattaaaagtatagaaaatataagactttctcaatttacatatcagatctggtgaatctatcttattgaactcatactttacatggattgaaaagcaatgtttacaaaaagaacactgatatgggaagtaatgtagttagcagagataaactgcggatgtttcaaataaaatcatctacctccaaaaattttactggaactagcatgtgatatttaacttgtatttttagattagtgtatctgaactttgtatcagtcagaggaaaatgtatggttggccctaaccactcagaatgtcataatcatagtaattaccactacccagtagtagtaattaccaatattctaggcttcagtcaagacactttaaattcatcattttatttaatccccataacaaccctgctaaacataggtgtgtttattggatcttttatcttcccaaatgaccacccaacgcccccacccaaatcagtttgattgaaaaatttgaaaccagcaccaaaaactttctcatctaacccagcaaaaactctgcagtccatcttttacaagcacatataagttttgttttaatttctctttccttacaaaggccgatccttccatgtgggttctcattatcacccttcaggctttacaaggaccttattttatctgtgtcctgaatcgtcagtctctttccttacttgatcattgatttcagcatagtggcctcaccctccaaaccttttggtattcttcctaaatctcatctcttactcatagccaactctaaagagttctcatgactgtgatctccatgtccttatctgctatctactatccacttctcgattcatattggctttttccccaaactctactgaaacttttcttggcaagatcacatatgaccaacattgttttgtcttttatgttcacgtattattcacctctagctttttacacacaccctctctctcatatctgtggttctctacctctaaatatggagattttcaaggttaactcctagacaactgtccaccaatttgctcgtgccaaaagtttaagagtcaccccatcaggtttacattcatacctatgacttcaaatatggtgtatatgcttataaatcccattcttagccctaagcttgttttcctgccactagatggtgccatttgggggtgatgggagacagtgacagatcatcaggcattaggttatcacaaggagtgtgcaacttggatccctcacatgcgcggttcacaatagggtttgtgttcctatgagaatctaatgccactgctgatctaacagggggcagagctcaggaggtaatgtgattgacagggagtggctgtaaataaaatgaagctttgttcgcttgcctgccactcatctcctgctgcgtggttttgggattggagatccctgttttatagtatttgtaatattgtcgcttagatagctcatggataatacaaatttaatagatccaaaatgaaattcttgaattcctctaaacaataccaataatttgttccaattagaccatagtaaggttgttaaaaaataagcaaaactaaaaaaactacaatgtgtaatctttagaagactttaaaagataaagacagatgtaagtaaagatgggtaatctctactttcacatctcccatccattcctctaagataaccaatgtgtatttttttaaaaattcattctgtaactttatgccaatctaacaggatgcttatattagttttttactgttgttttcttccacagtaggataatggtgtatcaatatttagtgactttttaaagaacatgacactaagaatgttccgagtcaaaccatttagatttgacgtattctttctaattttcaatgacatgactttctatgcatgttccaggtatgattcaacgatgtgcgctgctgtattattagattatttccaatccattttatttgtattttaaatttaaaccaaatgtattgtacgtacatagctcacgatatgctgcttgctactgtgcttgctctgaaaccttgcccattatgcactaacaacactggcttctattcagtacaacaaaacgtccctacattttttatatccagaaatttagtacggttttttcattctggaagcagttctttccctctgccttaccatcattgcatggctgtctctttctcatctgtcagatcagtgctctcttcttatcttttacagggtatcttagggtaaaaagttaaactgatgcgacagagaccccaaaacaaatgcctcaaacaagatagaaatttacttatatgtaatataatgatctaaagttgacgttccagattagctatgtttctgctccagctagtcactcaaatacccgggtgaatggtggctcttttgcattcagcaagtggctttcaagacctcccatatcattggcaatttggcaatttaggtgggtgtggtggtaggtggatcaggaacatcaaaatttgtggagatttcctctcaaacatagtaagtgaaagtttcattcatcatttttgcttgccatatttagctgcaaagaaatctgggaaatgtgatctctggttagacaagcatgtttgataacaagtctattattatgggagaaggaagaatagatcttggtagacaatttcagtctacactcaaggacacttaccacaatttgtaaatgatgtattcattttaaaaacaatcttctggtcttcccattagatagtaagcacaataaaggtaaaatacctgcctgttttattgttttattcacaaataaaccttctcccctgaatactacttctgtcttttagtaggttttctttttttttttttttttttttttttttttttgagaccgattctggctctgtctctcaggctggagtacagtggcgcaatctcggctcattgcaacctctgcctcctgggttcaagcaattctcatgcctcagcctcctgacatagctggaattacaggcgtgtgccaccatgcctggctaatttttgtaattttagtagagatggggttttgccatattggccaagctggtctcaaactcctggccacaagcaacttgcctgactcagcctcccaaagtgctgggattacaggagtgagccaccacacccagattagtaggttaattcattaaataactaattgaatgaatgaaaggattttacaggtaaagaaactgaggctcaaagaagttaaacaatttaggagaatgggtgaccattcttcaggaaggtggaaagatttatacctcagatggcttaacaagatagctagtaagcactctttcaactctgaatttctgtgattctgttatgcaggaaatcaccacattccaaataagatcatgagcctgctttgtaaaggaataaatcaagagaaaattgaaaatacactttttgtctcattggttctgtcacacagaactctttccctcacaccattacatcctaaattctcatagatgccagtcacactttaaaatggcaaccattaatctaagatgttggaagactgcagcaaacttgtgacatacctttctaaaatcacaccttccttggacagacaaagtaaatatgtgttgggcttcacagatttcctgctaggctacactgtctggaagaataaaagcaaacagatagtgagtattgtctttatcacatactgtgtttaattaaaaagaaagaaagaaacacaagattttgcaagataataataagtgcagttaaattgattgtcaactaagtcttctggtcagcaaagtatgagattaattccccttaataataaaaacattcttgagattcttctttaaaatatttattctgcaaagtaactaattataaatctgcttttctttgttttccaagatattgaagactttgaaactaaaacaagaagcacagtatctgtccgagaaggtcaaggtgtggtgcttctctgtggcccaccgccacattttggaggtatgatggggtgatttgggtcatatcatcaatgcggtcacttggagagtgatgtgagcacatcaggtcttaggctcagtgatcaccttttatcaaatcaaagaaattgtgactctcgtcaagtgcatctactgcatacaaatagttctatatctaaacattttcttttaaaaatattcgttcaagcagccacacagcaaatatgtttttaaggagatacatcatggcattgtacgtagtgtgagtgccagggctttttagagaaactgaccgcagctgtaattcggtgctgtgacaggcaaacttcatgacaaggggacaatttatttaccccactttgaggcttggttttctcatctataaaatagagacattaactgtttgtttgtttgtttgttcagttttgttgtaaatgttaaatgagctaataaatgtaaattgagtagtgtaataactaatactttagtaagtaaagaaagttaagattgttactacgtttttatttttgggctctatggagaagcaaattccaactaacactcctcttggcaatgtcacattaattaccggaagggatagatcaccattaactggaagcaaattctgtatagcaccaaatcagaatgtctcctggcaatggtaaaaatcaagcaataaatgccagcctctactttggaagactctggcttggtcagtggactggcccgttgtcagggatccaaactacttactgattctcatcctcttgggaatggattttctcaaatttcacatgatgtggtaaatttagtcgtgattctcaactcacagtgaacctgaaggaggcagtgtgaaaacatccatggagtcatttggtacaaaccaatatcacactatattatagaaagcttaataacagcaaggacttacacagcacagacccaaggactttaacatgtattagattcttaaattttcacaaaaacttataagagatatatgagtataattattgttttacaggctcagtacactatagagaaatagaaagatgttaattaactggtccaaggtcacgcagctggcaggcaatgaagccaatattcaaatccaggaagtctggttcccagaccctcagctcttaactatcactgcagttgttataattgatttccactctggaatgggagaacttttaaaatacaaaggacagatgtttaaaaataaaatttaagcaatttacttttaatgttaaaccaaatcttatttatgagccttgagaaacttgaaagcgtttttccattattatttttacacaacctcatgaattgccatgaccaaaagaaaagaaagctaattcaaagttaacaatatcttattcggtattattagagagtattatggcattatattcacctgatatgatagggaagagttgcaatgcttttaatgctatattgagataaaataatattgtttcagaacacacaataattgctgaggctcttttggtgcttattttttaacggtatagaagattattttccggcaccataatctaagatgacaaaatatgcaaaatggtatcagtttgtcctgtcagtctatgtcattttatgctcttacgatgttattcaaatattcttgacactactgaaaattgttttcaactttgtttaatcgggaataaaagaaatgtaaaatatttgtaaatgaatcagttccatatgtaaaaaaatttaaaaaattaaaaggcagccagacaggagacgcttgtccttgttaccttgtcacctatcaccattaaaggatatgtggatcttttagtgtgtgaggccctcattgtaacagcgcccgtggggtcgatgccataaaattaagtcacacatttacaaaaactgccttaaattaagacctttgtaactgaataatcttgctgcatgggagtaatggcaaacttgtgtaataccaatttttttttttttttttttttttgtgatagcatctcgctctgtctcccaggctggagtgcagtggctcgatcttggctcactgcaacctctgcctcctgggttcaagcgattctcctacctcagcctactgagtagctgggattacatttgcacacaaccacacccagctaatttctgtatttttagtagagacgggttttcgccatgttggccaggctggtctcaaactcctaacctcaggtgatctgcccacctcggcctcccaaagtgctgggattacaggcatgagtcaccgcacctggtccgagatttaatttatgttacaagtagcatctcatcatgattccaagcatatttgtcggctgaatcatgtttcttgctgttaaggtccctgtttccttgataactggctgttaagggacactctcaacttgtagaggctgctgaatttcttgccatgagcatttgtccaatgtcaaagccaggaacagagaatctgtctcacatttagtccctcgaacatttcaaatttctttagtcaggaagagccccatctcttgtgagggctcacctgatacagatcatgcccacaaaagctgaagtcagtttctttaaatcaacctgtgccatctaatcttatctaatcatggatatgatctctcatcctgctacaagtcgcactcacactcagatgaagagaattatacaagggcacgggtcgttgaaggtcatcttgggattttgccctacaatatgtttctcaaatattatttcttctatttccaatctccctaaaggctccatatttcctaccacacatggctctcacagagaaacgtcctagaaatatattcatgggggcagacggagttaacagagcactgtaaagtaaatgtcggcgtggccaaattattttttaaatctcgtgtgtaagtattaaacaaagcttctcataaagaaaagtagcacagactccacagagatagaaggccataaaagttgacttttttttttttttttttgagacggagtctccttctgttgcctaagctggagtgcagtggccccatctctgctcaccactacctccgcctcccagattcaagggattctcctgcctcagcttcccgagtagctggaaccacaggcacgtgccaccatgaacacctaatttttgtatttttagtagaggcggggtttcacttctgacctcgtgatctgcccgcctcggcctcccaaagtgctgggattacaggcgtgagccatcgggcgcagcaaaggctgaaattttacatcaaatttttgataacttagttctgttgtctttttcaacataaacagtcagcaagaatgagtctcacagggagttcggcagcaagggagaaatcatgttaaacttgatattatcagaatatcctgaattctttatgctttctttttagtgtattcacataaattatacaaaacttttttttaataaggcaggcctatcaaatatattttagtgtgatatatataggtatacacacacacacacacacacacacacataactttataggagagtaagaaaaagtatcgacatggctaaattttataaatttacccagcaaagaatggctccatgttttaaaaacaaaacagaaaagtgtctagatggtttttccatgtaaatgattggtcacaaccccatgaaacagagtaatcaacagaaaccaaataaacaggtacttttatagagctgtcctttcttctgcgtaaacgaaaggagggctgactccagcataggccttctgtggatgctttccacccagttttgaagcacagatgcaaatgtcctgctcctctagaaaggaagggttttacacggaaaggttattctagcagagaaggcatcacagtgcaaaagaaaaataacctaagcaataatgccaggacacagttcaagacgctctattttatcatttcaaaatgtggaagcagaataggcaccattctctgtaatctgagtggaggagtatatttctcttttaatcctattccccaatcagagatgggttttgtgattgtaactgaatctctgtccttaggactagactcagtccttgttcccatatttccaaaaaatcttatctgtaaaatatttccgagaaatgtaggtttcacgaagttttgtaaggacagcacagagaggactgcaatgcacatctgattacaaaacttcactaagattcctgttaaacgtctccttcattcctcctaaacgctctctcactggtaggctgtgacttcccacatctttccaacaatctccaacaattccctcgagtatctattataattcttccctatttggacacctatctcagaagaattcagtactcctttagcttctcagtgcttggcagaacgaaatttactagttggccaaacaaaaatattttatttctttcactatgtccctgcagggttctaaggtcatccctcagttcatgcaacagaaagagacaacacaaaactctttttttttgagagggagtctcgccctgttgcccaggctggagtgcagaggtgccatattggctcactgcaatctccacctccctggttcaagcgattctcctgcctcagcctcctgtgtagctgggactacaggtgcatgccaccacacccagctaattttttatatttttagtagagacagggtgggtctccaactcctggcctcatgtgatccgcctgcctcggcttcccaaagtcctgggatcaccggtgtgagccactgctcccagcccacaaaacttatttagtatttattttatttatttttggggagcaggatgttaccgtgcctttggctgaactttgagctgtatgcagagaggtctttccaccatggattctcactcacctccaaagtgagcttttgttaaatttcagtcactcgtcacaaaaaatgtcggcacaaactatctgcaacagagctgaaggcagaatttcctttaaattttggaacagatataacgcccttgaaaccaaaactgaagaaggaatatgaaaacaagcaatcaataaacttccatggacccagtgagttagtccagcctcataggaaatcttatttaaaaatgacagaatgaagcaacgatacatgttatctacaataattaaacccccccttcactatgtagtaatagtttcactttatccaaagtaaagaacactctttcccttcattggttggatatgaaactctcggcggggctcagtggctcacacctgtaatcccagcactttgggaggccaaggtgggcagatcacctgaggtcaggagttcgagaccagcctggccaacatggtgaaaccccgtctgtcctaaaaatacaaaaattagccgggtgtggtggcaggcgcctgtaatcccagctactctggggctgaggcaggagaatcacttgactctgggaggcggaggttgcagtgagccaagatcatgcctttgcactccagcctgggggacaagagtgagatttcatctcaaaaagcaaacaaacaaacaaacaaaaaagaaactaagtcccgagctcataaaaattataggtttaaaatttgatttagaggaaatgttccattctctcctcagatgcaactttcaggttggtagaacagttgaattgatgccaaaagtttggatcatctgtgtctgtagcaggaagatagcacgactgtctgagcccactgtttgtatttgcatcagtaaagatgttgacaattccacttaaattaaaagtcattccaagcaaaggctcacaattgtgttatcaaataaagaggaaaattatgtagagaaaaaagtgctaaaacttaacatccccttcctccagttggtgtgcttgctgtttctggcgtaaatgaaagtgcttttgtcttagtgggtaggtcaaattggcagtggatatgttactctgaggctctctgaaagtgtaaaaggcagacaggcccaatagttgcctcttggtataataataatagtaacgataataaccgtattattgaacttgtacactgggtattcactcaacaaatatttattatgtagttactaagtgccactcgtttttctgcattttagtgataaagtggaaaagagagacaaagtttttagctccatgaatcttataataaagaaatataaagcatgacaggtggtaataaaagccagaagaaaaataaaaggagataggaaatagtagatgttgctattgtatattctaaggtaaaagaaggtttcactgctatttgagcagagaactaaagaagtgagggagtgagacacattaagtaaaggcagttcaggtggaggaaatagcatgtcaaagaacctgtggggaaaccacgtctagcatgttgggagaacggcactgaggtcagcataggtgaattaaaatgaacagacaggagagtaaatgaggacacacagccttactttcagacattttagggactttgccttctcctgggagtaagatgaaaattcactggtttatattcagaagagtgacatgctttctctgactttcatttgtaaaaatttactctggatagtagaccacagaggggcaagaacataagcagttaaaaagtgattgtgttaattcaggtgagagagaatggtgacttggaccaggtggattgctgtagacagatagataattaccagtcttcagtatgtatttataaggtataagtaaaataatttcctgaaagattgaatgtgggttataagagaaggagaaaagtaaaagataactccaaggatttgggaccgagcaactggaaaatggagtatcatttattggggtggagttgatgaagggatagcaggtttaaggatggagtaaatcaggaatttgttttaggagatgttaatgttcagatgccagttagatacaagggtgaaagtttctagcaggcagctggattatatgtttagggcaaaagctctggtttgaagagctaaatttggaactcaccttatataagtaatatttaatactacataattggataagataatgaatacttactatgtactaggcactaaacttagcatttgcaatacttcaacgcatttaacattttccgggaagatatctcaattttacaaattgagtattgtgttaaaattgttagtgttagctaacaactatagttaactaaactcaactaactataacatagcttggccaagatcttgtctctggaattcgaaagatcctgtctaaacatcagtgcatttattccactccctaattttctctggcataatctggtccagaagagacacttaaaagtttttaaataatacaaggagataacaagagttctttactctactggagactatgtaaacaacacacagagaggtctactgatttgcctaaaattagtgtacagtgttagaaccaggaagctcatggctcttcccactcttcatagctggccaaagtcagctctctagaaagtttatttctttaagtcccatgctgcacattccttccctccactttcagactccattcactcttagaaagactattttccttgctttccagcacatcaaacagaactctcctgttgcagcctgttaccatgtgtagaagtcaggattttccaacactggtacactttgtggcagtagggccagatgttggggagataggaagtaattctttttttctctttttattatcatactttaagttctgggccacatgtgaagaaagtgcaggtttgttacataggtgtacacgtgccatggtggtttgctgcacccatcaaccggccatctacattaggtttttctcctaatgctatccctcccttagccccccaacccccagtaggccccagtgtgtgatgggcccctccctgtgtccatgtgttctcattgttcaactctcacttatgagtgaaaacctgcggtgtttggttttctgttcttgtgttagtttgctgaaaatgatggtttcgagcttcatccatgtccctgcaaaggacatgaactcatccttttttatggctgcatagtattccatggtgtatatgtgccacattttaaagaaaatgtgacagtctatcattgatagatagatagacataatatccagtctatcattgatgggcatttgtggtggttccaagtctttgctatttcaatattaaccttaaatgtaaacaggctaaatgtcccaattaaaagacacagactggcaaattggataaagagtcaaggctcctccgtgtgctgtattcagtatctcacatggagacccatctcacatgcaaagacacataggagacccacctcatgtgcaaagacacacataggctcaaaataaagggaaggaggaatatttaccaagcaaaaggaaagcagaaaaaagcaggggttgcaatcctagtcactgataaaacagactttaaaccaacaaagatcaaaagagacaaagaaggtcattacataatggtaaagggatcaatgcaacaggaagagctaactatcctaaatatatatgcacccaatacaggagcacccagattcataaagcacgttcttagagtcttacaaagaaacttagactcccacacaataatagtgggagactttaacaccccactgtcaatattagatcaacaagacagaaaattaacaacgatattcaggacttgaactcagctctgcaccaagcagatctaatagacatctacgggagtaattctttattggaagaactgctctgcacgttgttaagatgtttagtaatatccctggcttttacttactagatgccaatcgcactgcctcctccaattgtgggaaaatttgtctccagatattgccagataacttctagagggcaaaactatccttagttgaaaaccactggtacagcccatctcttacattcactgtattaagttcacccataaaagatggaaattgggaagaaaaagagaagtctagtcctcatatatttgtatcctatgacttgcttggtctccctaagaattggaggtttcctagcaattcactcagaagctggctatgagataagagtcggtaggactggctttgcaaagtacaagtcaaaaagagcccactgacaaaataagatgtggtaaagaagccagccaaaacccaccaaaaccaagatggtgaaaaaagctatctctaatcatccacactgctcattatatgctaattataatgcattaaggtgctaaaagacactcccaccagcgccatgacagtttacaaatgccatggcaacttctagaagctacccaatatggtctaaaagtgtgaggaaccttcagtcctgggaattctcctcctctttcccagaaaactaatgaatgttcctccccatgtttagcatatgagcaaggaataaccacgaaaatagccagctctgaagtagccactgttacttattcctctactttcctcataaacttgctttcactttacagtgttggctcggtcttgaatcccttcctgtgagaagccagtaactcatgtggcctcccaggctgaaccccagttttggggtttgccttgagacagctgtgttttcgttccttctccaagtaggtttggccaatgtacaaccagttctatagttatttggaacttagcaatattaggaacccatgagacctttatttaactgtcattcataggccgtaaagaaccaccatctccttgattccaaacagtagatgtgtaaatcagaagggatccaataaaatccaggtgatcaagcagtaattgtggaacgaatgggaattcaaataggagtggattttaaagtgttaggcacgtttctggattacatcgtaaacttcctcagcctaatatcaatgacttcagtccagaaaaggaattattcttcttggattaggtttttgccactgagctagcataaccatgattgaccacccaagagtcagtcacatttaaccctggagcactacacaaggtttgcagtaaagtacacacattctggaatattccaaaggggggatttacccagtaaatctgaacactatacttcaagttctttattctactcatttattttctgcctcaggaaacatgctatcaattttgagatctgttctaaagtgccaatagaagttgtcagtatcaatgtttatcatgatgcttctctttcacatgagatatttttcctctaataaaaattacatgctatataatgggtataattgcatatatctttcttgtttgtattttaaatattacagtacaagatatagggctgtaaaagatgtcaaaacataatcacactctggggaaaagaggatttgttgtatgcttgagagagcagcagatagagtcttcaattgcttactgcagatctgccatttctaataataataaaattgtagaggacgaagtcattgtgaaactacaaaaaaatgcttcaggaaggaccaattatcattcagctctaatgctactgctgactcatcacagggaaaatgcatcacaaccgttaataaccgataaatgtcatagatggtggagaaaatatttaaaaattcaatggtttcaacctaaatggctcatgaattatacatttaattaagaaaagccaaatgggaaggtttttaaacttccagtttggaaggttttttttttctttccccattgaaagatacacagattaagcacagcagtggctgatgctggaacaaaatagataaaagcccccagtgcaggctggctcttcagatgactgggaggagccagcccatggggagaagggagcagggcagggtgagaaatactatgacagcaaagacttgcagctttacatcttcaccaattcagagggcacaaaagggcacctggattgtactcccagagctgctgctagctctattcccctctgcttcttcacttgtaaaaatgaagtggttgggctggcaagtctcgcaaatccttgccatcccagacgttttatgaatgtataaactaagagacagccttttctccagactccaacacaccactcaaacgcaaatatacaaggtggtccaccattcaaaatccaggcgtttcccttcccagtgtgatgatgcagaggagactgagttttatcttttgttttgttttgtttttttgggttttttttttttttttgagacagagtctcgctctgtggcccaggctggagggcaggggcgcgatctcagctcactgcaaactccaactcccgggttcccgccattctcctgcctcagtctccccagcagctgggactacaggtgcccaacaccacgcccagctaatgttttgtgtttttggtagagacggggtttcaccgtgttagccaggatggtctcgatctcctgacctcgtgatccgcccgcctcggcctcccaaagtgctgggattgcaggcgtgagccaatgcgcccggcgagttttatcatttttatcaatgatttccaaagggtagctccagaccccccagtgtcattgtcacctaggagcttgttagcaatgcagatttcctggctcctccccagacttactgaatcacagagtctgagggtggagcccagcggcttgtggtttagcaagtctaccaaggggttctgatgcatggtgaagttttagaacctctgcttcagagaggcccatttaagagggaaaattcaagtttttatatctgttctactccctgctaatattagcaataagtactttacagtaatttcacatggcagtttaacttatttatctatgaagttcttaagaaattggacgcaggacaggaaatgttaatgggggagggaatggacagtgaggaacatttgtcttagaatgtgagtaaggttggttacttgtggagcttgggagttttgaaggaaggctaaaggtgaggaggacgagctaaggagaggacatgaacatagaaaaagaggatcaattgtaaagacattgaaaagtagaaagctattgttatgggaaaggggttcagatccggactccatgagagggttcttggatcttgtacaagaaagaattcagggcgtgcccatagattaaaatgaaagcaagtttattaggaaagtaaaggaataacagaatggctactccatagacatagcagccctgagggctgctggttttccatttttatggttatttcttaattatgtgcaaaataatcattatatacctcctggttttagaccatatagggtaactttctgatgctaccatggcatttataaattgtcgtggcgctaatgggagtgtagcagtgaggacagccagaggtcactctcattgttatcttggtgttggtgggttttagctggcttctttactgaatctgttttatcagtaaggtctttacgatctgtatcttgtgctgacctcctatctcatcctgtgacttaaaatgccttaactttctgcaaatacagcccagtaggtttcagcctcattttacacagcccgtattcaagatggagttgctctggttcaaaggcctctgacagtattattagggaaagagcaaagatctggcatctgaaggatctaggttcaagccctgctcctcccacatgttatgaatacaattttgggaaattacctttatactgttagttcttgcacccttagcctcataaagcagttgctggcatgatgaaataagtttttttctgaatttattattaatctttatgtaatcttccctatttctggattagattcttccagcagcttctaaatatctcactattaaagaaggacacaccacatgtaggaatagattggcaagttctagcagctaaggtaaaaatgaattcaccaggggagagaggaaaattacagtctcaggtcccaagattacaggttgaagaatacaaagatttcttgggcactagtggcaaactgtaatttttgttaagtgaaaggggtgacattggatttcagagagctaaagcgtatttctctccacaaataggcattgaataaggatccgtaagctgagacatggccctgggaatttgctcaagattgtctttgtttcacaaaaaggttcaaaagatgaggagtcaatgacaacaggggaatctgaactacattctttccttcctctttatattgaagaaaaatttactctctagatgactctgatttcaaacaaaaacctttgagcatctctttggtggagacagcaacaggcttagaagtgaggcagcaaaggacgtcagtaaagaaactgaagcaagagaccacatggtatgatgaaagactccaatagagacttgcaaaagaaaataaagactcaatacatgagaacagcacgagcatctcaaagcatttttcaaaaattaaaagcaaattgcatttatgcatacttgatccaaaagtatagactcttagggagatcaaaggaatgttgaggctgaaggaaaccattcgtagaagcttaggtttaacccccatccatcgtcaaaacaatttttttttgctacatcccgagtagtgttcatccatactctgcttgatcatgtctaatgataaagaactcactacctagtagatcatccactgctatccttctcaaatttagactgttcttcattatattaaatctaacagcattctgtcacctccagcagccacgagtcctacttttgccttctggacattgatagagagggttttatttaactttttatgcgtgtggcagctcttcaatgtaaacagacagctgtaatatgcttccagaatctttttttccagaggcaaaatcaaagttttatcactatgttttgtgactggcttttgctacattttattttttatctcttgataaacttgatatttttaattcctctttcaataatgggtgctccgaacaaaatatttcagtcaattgcatgcgtcatttggagggtgtcgaaaacacagatcccatgatacctggctcagatagaataaataaaactaaattgctaagaattgagttagctatttgtattttaacaagcttctttagtgattctaatgtacatcaggtgtgggaatcagtgcctgcataaaacataaaacatccatttgaacggttcagagtaagaataagaaatgttatccaccctgtttttacaagttgcagctcattctagtgtttagcctttctgacactcttcttatcctgttgattctttcttccatttacacaaaaaatgcatagcaatttaaaattataatacgacagaaacacattacaaagagagtaaaagccttttgtatttccctccactcactctgagaaaaccactgtatacatctccaggtttttaaatgtaagaatttgcataaacatatcacacacacacacacacaaagttcccacactcataacatgctttttacctaacaatgctgcttaggttttttttcccacatgacactacttttatggtttaatgacactttttgcattttctcacttcatgcgcaagtagcatttactgtgctcctgctgttcctggtctcatctttactttatttcttctccattcctgggaacgatatcagggttctgtctgcagagacaaatttctttttactgacatcatttataaattgttgtgagaaattaattattttgctcctccccactattaatagattaactttttccttctttctctttccttccttccacattttctttctccttttttcctttatttcttccttcctaaaatctcattcctttaagtatggttcatgcttcatgcattttttttttctcgatggaagggatgacaaaatgacaatattccctcattcccattttcaagagtttgtctctatagatcagatttaagtccaaaatagctgtcagtttgttttgccaccttttacttttgggaatttaaatttagtaaggttagtgaagaatgtttcaggtggtctcttcccagctgaggaagcctaccggaacatatcagaaataattagcttcttttgtctctgccatgtcttgcttccgtgccagtttttaatgtaagtacagttggcaaatagcaactcagctctctgtttggacaagaggctccaagatgcataaactactcccctgtgaactataattcaaaagtgtatgagggtccatccaactgaagactttttttgagttagttgcagtatattccccttctccaccctgagtacctatatactccacctattttggggatctcctttggaccagctatattcttctacttccctagacatagttctactctacctagtttccgcagtacacctaatgtcttagcttcaggaagaattatattcaccaagctttaatacatatgaatatttgcttttgctcaaagatttctggctaaaacgaaagaaattgacagcacatgatttttgtgaggttatgggacaactggaactctcaaatattgctggtggaagtataaactgatacaaccactttaaaaaattcttttgtcatttcttataaagttacacttacatctacattatggcttactcctaggaatctaaccaagaaaaataaaaatgtatacagacagtcttagacaaggatgcttatttccacctaatacataatgacctcaatctggaaataatccaaatgctcatcaacaggaaggtgtccaatcaaattatggtatattcataaaatgaaatactatccacaatataatggaagaaagggcttatagtcatgaaaacaataggtgaaccttaaaattatgttaaatgaaagaattcagacataaaatagtacattctgtttgttttatgatgacatacaaatgacagcagaaataatctatgatgatagaaatccagtagtggttgcagcagtagaaaaaaacaggggaggatttctgaagacctggaaatcttcctcattttacttggggaaggatggttacagggggtatataatggtcacaagtgattaaacggaacacaagttctgtgcattttaacatatgctcattatgtcatttatacagttacccacaagatttccagagatggactgattgatgttcagtaaaaacaatgtgtgccctgtttcatgtttatgctcttgatagttactcggagaaatgcttgtcgactcctccgtcacttggatagctctagtttatcgtgccggtttcaaaatggaattccttcttagaagtcttttctgatgacacatcattctaggctccttctctgggctccctataatgcctttgtcaaagcatatgttatccttcattgagattactcacattattggcaattagcagtaactggtgtgacctttatagggcacaggttttgtttggttttacactaagacctaaaactgtcacagaatagctgcttaaaattatgtaataatcaggccagtgcagtggctcatgcctgtaatcctagcactttgggaggctaaggcaggagaatgacttgagctcaggagttggagaccagctggggcaacatagtgagaccccatctctttaaaaataaaaaagaaattatgtaatgatcaaatgagtgaacttcaaggtctgtggtagacttcttgaactgaaatttttaagttaaatttttaacaagtacctgtaagtatgtttaattcttctgataatgcactgagaaacactgctttgaagcagcataagtttttcctaaggaattcagtgtacatttggaacagttattattttatacgtcttatggtatttcttaataaactcatccacttatttccataacatcctattgttatatccttaatcccaaaaagtcaatgatggggaaagtgcccacataatttatcgtccaatctgagctatatttcaatataagggaatattacaattacaccagatgacagctatcaactgagcaaatagaggcacaattttctcctaattatggggaagtaagacaaagaattttcagatatgaatgaatgcagtaaggacagtatggttttgttttgttttgttttgtttcttgtttttcagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtaagataatgagttatcttgggaatgtactttatctttggcccttaaagcctgggaagattcgtaaagctttctgcttccttcttgtttggtggagccaaattacgagtttaggttcaattcacaaatatgtaaaccagaaatataacagaaaattatctaattcacccacatggtgcagtagacatggttctgggtataccaagccatctcctttctggcattgaaacagcttgtcttttttttgcttaaagactgttttgtaaaaacaaaaacgatgttccggggagttggcgtgtgtgtatgtgtgcacgtgtgggtgctgccaaacatataactgaatcaatatatttttaatgaacatatgttgcagctactttttaatggccccttttttccatatttgccctttttttgttgttcaccctttatttacgtggctggcaaaatggagggaaaagttcatatccaaggaaagcaaagcaaaccaacattaattatgagcattccagagaagaatgaaacacaagatttatactaattatattcctccaaggaacataattcacactagtctctgacgagctttgtagcttagtcaagtcatggctggtacaagatttagagagccagaaagtttaaggaagtcattgaagtggagaaattctctagttgtttttttaattaaatgttcacagtgggattcatacaggtagaaaatttgttggtgcattttatgattgtattcaggacttgaaatgcaatacctcgtggagtttttctcccctctgaagagttgaagaaaagcaagaatataatgctaatgaagcataacagaattgtggaacaagtcccatagaaggagttcttataatagagcttttataatcactaaccacccaaatgtatttgcaaggtcttcactaagatttcagcaaccattagacttattcctaagtccaatttatctccttcaatgaatactactatttatgaccagaagaattcatgagccaacaatatacttggagattctaccatgtttttcctttttttgtttcctgtctactctgagtttctgcttcttgccttcttaattccttccttcttctatcccctctattcccttgaatacatttacaggaaaaatagagcagaagtattatatataatataaaaatcaaacctattttaaaagtgagcaggtaggaaatatcagatgtcaagaaagtgaaaaagaataaaacctaccaacttagttgaatgaagtagtactcactaccttctcaccataacctctttgaatgtttataatgatcaagtcttaaaaattaagtatttttatttcatatatattttgtaatttttactttttctgcaattatattgaccaccaacaatgtatttattttagaaatgtattactctgtcgtttggtacatagattaaaaatgatcaaagtatttaaataatcttgagatgtcactgattaaattaattaagttaatgagaatagcctacagatatatttctgttacaactcctctggtaggcagtgtatttacaataggttataccatcatcttatcttggcacatatccccaattccttggattgaaagttttaaaacttaaaacaaattcgtataggtatacagcaaacttagcggcaaaaccttattgtactaatatgtgaatatttacatttttatctcaattaatgtgatgcctttatatgttctgctgcagaactactgttattttggactaagacctactgcagtggacttctaccagtgttagctgaaaacatcccgttgttgttgtttttttctttttttttttttttattaatcagatctggctctctgagttccctgaaaggtagataaatgtggatgtcactagaaaagtgtcttttttgaaaacacagaagcattttagaatctatatgtatccaattcttaactgaaaaccctaactcttattaagaagaaataatcaggttttggttaatgaagcatttacttcatagaaaacttctattctccagaaatgctgctagctcttttgatatttaacaggtgtgatgggggaatatgaaccaaagattgaagtgcgttttcctgaaactatacaagctgcaaaggattcatctgtaaaactggaatgttttgcccttggaaagtaaggtttttgtttttgtttttgttttcctggttgcattaatttttttttattaaaaacctttttgttattcatatattgctctaaggtaaattaccaagtagatttcaaatgctgggcaacagtggaactttctgatttgaatttaaacaaacatgtctaatactgagacaatgaccaggcctgtaactgaaaatgatcagggctgcaattcttccctacaggtgctgatatttccttagtttaagcataatgagacccatttaggcagcacattgcaagggaataagtgcactcgtataagatgatgggcaagtcactaaaccttccacatatccttcactccatcttgtcctacatccagaaatacattgcctggagtatttccttgcttaattaaccaacaattctgataaataaaaaaccactgcttgtttccaaaataagactaattaaagtccattgttcatagtgggtaattagaattgagcccaaccttccctgatagtggaggcattttgttttactcagataagtatttattaggaacaggtttggaatacttttaagccaggaaaatacctacatttttgcatgggatatctagaacccctctttgctttttggaggtatacaaatttcatttttgtgcctataaacaccagaaaaaaagaaggagacagatagactagactgtcattttcaaatgttaatatgcatgtgagttacctggggacatggttaaattcatattctgactctagaggtctagggtgatgtttgattcctccatttctaaaaagctcccatatattagtcatgcttcttgtaaacagaacatactttgaatagtaaaagacttgactgactcagaggtaagctcggagggcttacctctaaatccaaagtctattcctaatgtggccctcacatttagaaatagtgacttagtctccaaattctagaaaacatccttaaatgtctcagtcatattattaagttaaacatactcagcaatccaaataatggtggttactaaatcttagtttgttttctatagatggagttttgcatatctttgaatgaaatttctcagaatagtcatttctcatggatttaagagaccgtattttattttcatagagtatgggtctcatagcatttatcaaataaataattattgattgattaaatgattcttaagaaagtgacaaataggggctttacatcagtttttaattgtctgccttttaagacataatgaactttcaccattttcaggctttttcagaagttaaggtttataaaaatattaaatgtcatcaaattctttgataattagataattaattttaaaagaaaaccaatgaaagagagtatctgaaaagaatattaatagcttatttaatcatatttggcatcaggaaatatagattcctgaaattaaaaaatggtcttccacaataaaataattgaaaatgttgaggctatttctcaagaatctaatgaaaataatttcatttgctaagcacctataactaagcatttatgatacaatatatataattgtcataatcttgcagggcaagttacgttttcattacatatgagaaactgaagctcagattggagaagtaacctgttcaatcttatgtttctattcagaggaagcaagcaattcaaacccaggcccacctgattttaaattctgaatttaggaacttctaagtaaatagtaagagaactgcttttgaaatcctgggagacagattcaattcccaattttctgaagagttatttgattgttagcaaacgtgcttataatctctatgaattaccatattttcatctgaaaggagttatgatgattccaccttgtatgtttgttgtgaagattagaatggataatacatgttaaaacattaagacttggcatttatgtaataaatgctcactgaattattctaaaaccaaaatccaaatttcattctacttttttttttgagacggagtcttgctctgttgctcaggctggagtgcagtggcttgatctcagctcactgcaagctctgccacccgggttcccgccattctcctgcctcagcctcccaagtagctgggactacaggtgcccgccaccacgctaagctaattgtaatttttttttggtatttttagtagagatggggtttcagcacgttagccaggatggtctcgatctgctgacctcgtgatccgcccgactcagccttcctaagtgctgggatgacaggcgtgagccactgcgccgaccgcattctgcttttatataagcaatgtttgaattagtgaggatgcccaagggagagtaggtgtctcagagggggtatgaattctcatctttcccagcccagtcctgttctctctgtctcaggattgatgacagtataagagagaaaggagcaattagggtcagttcaggaaggaaggaaggaaggaaggaaggaaggaaggaaggaaggaaaaagaaaagaaagagaaagaaagaaagaaagataaagaaagagagagaaagaaagagaaagaaaaagaaagaaagaaagaaagaaagaaagaaagaaagaaagaaagaaagagagaaagaaaggaagaaaaggagagataacatgatcaatatagtctttgaactgctcacataccagtttcttaaatttatttatttttatattattcaaacctatagaaaagttgaaagagtaacacacggacatcatatactctatctgaattgaccaagtgtaaacctgtgctacattccctttctctctctctctccccctctctctctttctttctccacacacaaatatatttaaccagatacatggtaagatctaatcaggaaaaatgaagcttgggatatatgaggtatgtggaataatttaaaaataaataaagcagtgtcttattttctattaactccatggtgatggaaataatcaacgtattattaaattgcaaaaggtaaaatttataatacaggagtccctaaacttttttttttttttttttttttttttttttgagacggagtctaactctgtcgcccaggctggagtgcaatggcacgatctcggctcactgcaacctccgcgtccccggttcaagtgattctcctgcctcagcctccagagtagctggaattacaggcacctgccaccacacccagctaatttttgtatttatagtagaggcggagtttcactgtgttggccaggcttgtctctaactcctgacctcctgctccacccatcttggcctcccaaagtgctggtattacaagcgtgagccactgtgcccggctcctaaacttttgacaaaaattaaactagcaatatttgacccagaaaaatttgagttggaaaattaatagtttaaaaaactctcaaaatgtaaaatctgatgtgtatgtacaaaagaaaccccctgataaataaatcatgttggttaagtttatgcaggaaataaccgttgaacatgaaataatgttaaatgggaataggaaaataatataaattaccaaaccatacctcatagaaaattgtcaaggaaattcttgatttaatagagtacactccctaaattgttatctaacaaaattaatcaatgttgagattatgtttattaaatgaaggcattaatatagaattgaaataccttgtggtaaaaatggaaagtctgaagcatctgctcggtcaaagcggtagcgttaagatgccctgtataacaatcttacattttgtgtagttggagtgcagatacatttctcatttcttcaaaacaacgaaatgtatgtgaaaatactttgactactttggaaaacttacaaatgtgagttactaccaaaaagaattttatatatgcttgccaatagttttcagaaaacaaattaaattatctttgacacattgcaaacatactgaaaatgcctttgagtccattataaattaaggtatttagcaaatgccatattgtcttctaaatatataaaattaacaagcataaaaggcgacacactcactagaagattaattatgttataggtatataattaacaatctgaaaataaaaagtcaaacgtcttatcttcaaaattataaatctgtatttgtaagtttgttgccaagtgtttttataaagtctattgtttattataaatcatattctctaacatctcttcataaaaatattgctgtgcagcatttggttttagtcatttttttccccaaatgtggggactcccttttactaatccttctaaatcttcctgtctactttgtgatgtactttactcttttgtaagatgttgcataacctcaaaactgagaaaagctagttgacttgaggaataaaatcaaatatttttttcttattacattactattcattgactgctatttaagctatagactacacatttattagactaagatgtatatattttaatagatgggggaaagagagagagaagagggaggaaggaaatcaataggtgggtagaaggaaaaagaaatgaaaatatagaaagaccagctccagtgccagatcttattacattttttatttttaggtcataagagagcttctgatataaaaattggcttttgttaaatgtttgtttaatgtaccccatacatgtgctcacataactaggaaatatcaccccctatcactgggaatattttttctcttgaggttgtagattatttttgttatttatttatcttgctttgttttctctgaaattcctgagtctatggtttggtgtttgtcattatttttgaaaactattcaggcatgattacttcaaacatttatttgtttgtttttttctccttttagtatttgttttacattatcttttatgccatttgtaatctcccttctgtccaagttcttaatctttttaaaatttttatttttatctttgcatctcagtttgggaggttctattgatactgcttgtcattcatttacttccccccttagctatgttcagtctactggtgagcccatcaaagccatccctcatttgtgttataacttattttatttccagcatttccttttgatcctttcttagagttttcttctctgtgcttacattatccatttgttcttgtatgctgttcacttttttattatagcacttaatatattaattatagtaattcaaaattacagtctgataactgttcaattttaaatcctcagcctgatagtcctaaaagtttcattgtatttgagtctagttatcatggttgttttgtctcttcagactgttttttagcaggctttgcacttttttttgaatcctggtcattattatatcagattaaaggaacttcaataactaaacttttagcgtgaggttttatgtttttctagctagggttagactgtaattactgttggctctagctgtggtatcagaggttaaattttagctagtacctttgcttttatctccactcttgcccttgggtttccctagagactctttcctaaatagcatctaaagcttgccgttatttcagctgtaattctctgcactgtaattatataggagccctaaataagtcctcgcttgctaattctatcatctcagttatttgtgggtctgtttctattggctgctttttctcctagtcacagttctcatttttttgcttgtttggatatctagtaatttaagattgaatagtagacaccataaatgtcttgttgttgaatgctaaattgtggtgtatttattaaaaagctttttgaactttattttgataggcagttgttatactactgtgaatcctcgagttttctgtggttattaaggctggtttactactaaaatgaaatccccaactgaatgcttcaaatgttcaccaagtttttcttctctggcatagtggagctctcatgtcttccaggcctatttgagctctgaaaattattctttgcccagcctcatgtgacactcctatgcagatcttcagagcacattatttgagtaatgccattctttctaacactgtgctctgcaattccagccacttcagcctctccaaatcttatctttgtcttctcagcttagtgacacagtactttactacttatgtctcccctacctactccctgatctggatggaaagcatctctacacagaaaataagggctaccaaaaccttacttcatttatttcccctctttcaggatcatacttttgtgttgccaattgttcaagttccagaaagaggttttttttttccatatatttgtctagtttttcactgtttttgaaatactaattacggaggtaaatacagtgaggcttagataaattaagtgacttaaccaatgtaagttgcataagttgcatatctgggattcaaatctacatctcatagattctgacttcaaaactcatgcttataacactttcatatttatattgaattaacttctaagtatctgacttacttaatcctccatgtgcagatgtagtatgaccctcaattatgtaaatattttacaagaaaaaggcttgaaagaattcagcaaaatgttaaaaaatgctttatctagggaatggaattatagatatatttcccatttatattatctataataactaatattccagcaacaagtaagttttaattttatatattaaaaataacccttggccgggcgcagtggctcacgcctgtaatcccagcactttgggaggccgaggtgggtggatcacgaggtcaggagttcaagaccagcctggccaagaaggtgaaacccccttatctacaaaaaatacaaaaaattagccgggtgcagtggcagacacctgtaatcccagctcgggaggctgaggcaggagaattgcttgaactcagagggtggaagttgcagtgagctgagatcgtgctgctgcactccagcctaaagacagaatgagactctgtcaaaaaaaaaaaaaaaaacaaaattcaaaagataaacttgtaaaaattcaagctgtgttttaatgagaagaaaaaagtgttttcaaaaacatcaaaaatcaggtttatacaccttattattttatagatgatgatggcaatgtacaccatttctaaaagtctggtatacctgattaggtagcactcagaaaacatagcttctgtcacggataccatcatgcagacagaatgtataaaaagtgaggtctagagaagaacaggtgaagtgtttactcatataatctaacaatcttaaaccactataagctagtgtgagtatagaataattaagacaaagcttcaagtaattgtcttaactttaattgctatgactttggggatatgtaactgacttcctttgttggagtttcagagctgacatgatcacagctttcaactctcagctttgtctcatttgtttaacatggtggactcttaattatgaaagctgcaaattaattgtattgtgaaataccctgagaagctccttgtataggtgctatgcaaatgtagtatgattgactgatagatatgtacgtctcctttgaaaaaaatatgggctcttgctgagtgaagaaattaaactgatatcccccataactctattctactgcttttataaacaaccaaacatattttcctttttttaaaaaaatcttaatttagtaccttttctgtcagtgttctggaatgtaaataacattagtagcagcactgaacgttcctgtgtgttctgaagccttcacacagaggactatatttatgtgtacatgtataacttatttttttttctaatttatgaagctaaagatacccagcttggctattaatgtcaagcaacaaatctgaagtctcaccatgatgttgttaggtgttccagaattttcaggtgacagaggagctatttcttatagtgtttgcttttcgtcttactaatgtggacatcattgcagattatactgcagaaagatttttcaagtcacttaagatgaaaataacatttttaaatcaagctaggcacactgaaatttttcagttccttagcgattatttttggtttattgaattaatcactcaggtatcttaatgattttgaaactggatgtctaaaaaattgtttaccttttgtttcccctcattgagttgagcagatagagaacagaatctcttcctaggcatagtttaccccattcactccagaaatgtatactgaaacctaatctttagattcttgctaatggctttttctataacacgatattatcaataacttttttttaacatgacgtggtattgcttggcataaaataatcaagtaaactctatagaacactcacctctgttgaccatgctcacaaatctgagaactaaaaaatcttcaagccaattattcagaaattgaaagataacattaaacccactacactctcacataaacaagcgctcaacctagcaataaataatttatcagtgaatttactagcatttgaaggcaaatggtatgctgaaaagtgtggactttaagttcaaatagagcaggattggagtcttaacttcacttgtcaatagctggatgactttggtcagttttcttatctgtataaggaaggcaaaaatgatagagagagaataaatagatacagcagaatgtttgtaaggactggaaatactattaagctcacttactaaatttcctgacccataataggcattaaatagtaactactttattaatcctgggaattgtcaaagctgctttgactgaggaggtaaaaaggaacatgtaagaaggagcgaagtggtttctgtattatatttttgtgttaagggacttccccagaagaatagatttatcattttaaattctgttcaatctttctaagagttactgacgtttcctcactcactcatttgacaaattgagcacaaattattcattcacttagcaaatatgtattgaatacctcattccatcattaattccttcatttcttcatttaggtagtcagtcaggagggattctccaaaggacagacacttggccctgggagataaagaagattacataaaggccccggggaggttgcaggctaatgaaaataagattgatgtaacaatgtgcaatcacacattctcttgggatcagctctttccttccagactttcagtgaaggaagagtcaaggatcctcactttgggagctttactgattatctttttcccacgctgccctttatcaaatagagactggagagggtcactgtcatttctttagcagagctaattttaggctattatttaagggtttcttgtatttctgagaaatggaaaattatttcttccttttttcccctctgttcataaatacattttttaactaatggattttaaagaatagttttagaacagaaatattgaacggatagtacagagaggtccaatataacccccccacacacaatttcccttgttactaacatcttacgttattatgatgcatttgttacaattaaccagccaatactgatgtctgattattataaagtccatattttattcaaatttatttggtatttatgcccttctattccaagattccatccagaataccatattacatcgagttttcttgtctcattagtcttctcttgtctgtagcagaatctcagacatttcttgtgtttgatgtccctgacagttttgaggggtggtggtcagtttattgtaggctgcccctctgttagaatgtgtctgtatttgtcataattagactggggttacaagttttggagaggaagaacataaaggtaaggaacaattttcattacatatcaaggttaactttatcataatgatttatgacagatgatgctggccttgattacctggctgaaatactttttatcagggttctccactgtaaaattactcttttctcccactccatactgactctttggaaatgggtgactatgtgtagtccacatttgatgaatagagtgttgtgcttcaccttctgcagaataatgagactatagaattcttctacctgtgaaatgtgtcacttcttcctcatttattaatatttaataatttacttctgtcagtactgactcacatataattattttagactttgggttgtaattctgtgctactttgtttattttgctgctcaaattgttttagcttttgccattgggagacttttaagttggatcttgtgccctttgttatgcactcatcaatgtatggggtgttttgtgtgtgtgtgtgtgtgtgtgtgtgtgtgtgtgtgcacctgttagcactttcttatttactggcattaaagatgttccaggttcatcttgtatgtttcatgccctagtcatagaagcagtcatgtctccaaggatagggtcttgttattgaagaatgacatcagaaaccaatatctgggtactaggtgtgcttgttgctgctggagtgtcatttatttaggcgctctcagatgacagagaaaagaagtatgtgtgtctatactaattattatgtacatatatctataagtatttctacatacagctatttgtattatgttaaattaaacatatgatcttgttgttgtctccgactctaatccattaccacatggatcactctgctctcctccacttactgatcagtacctttccactccacacagtgctgtcccattttgcaataccaccagtaataaattagaattttgatttctcttaatctacaccagcatttgatattgtgtgtgtttttgttttgttttgttttttagccattcttacaggtgtatagtggtatttccttgttgttttaattggtaattctctaacggcaaaggatgtgaacatcttttaatgtgattatttgctatctatttatcttctttagtaagacgtctgcttatatcttttctacatttttaattggtatgtttattttcttattgatgagctttaagaattctttgcatattttgaacataagccttttatcagatatgcgttttgccaatattttctcccagtctgtgacttgtctttgcatttccttaacaatgtccttaacaaagcacaaggtttttattttaatgatgtgcaggttatcaattttttttccaataaacggtgtttttggcattaaatacaaaaactcatcactatatccaaggttacctagatattctcctctgtcatcttctagagctattatagctttatgttttgcattttcattgatggtccattttgcattaatttttgtgaaagatatgacttctgggtctattcattttataacatatggacttccaatcgttccagtatctgttaaaaagacaaatttttctccactgtattgcgtttgctcctttgtcaaagatatgctgactgtatttgtataggtctattaccgggatctcttttgttccattgctctgtctattcttttgccattaccacattgcctcaattactgtagctttacggtaaatcctgaagtcaggtaatgtcagtactccaactttattcttcttcttcagcattgtgttggctattttgttttgttttgctttccttgtctttccatacaaacttagaatcattttgtctatatccatgaaatagcaattggggttttgattgggattgacttaaatctattgatcaagttgggaagacttgacacactgacagtgttgagtcttttcatccatgaacacagactatttctccgcttatttcgatctcttttaattgattttatgagattgtatagttttctgcatgtaaattctgaaatactattttatataaaccctagaatttcatgttttagtgctaatataaatggcattgtatgttaattgtggaattcaaattccatttgttaactactggtataaacaaaagttaactgactttgatatattaacattgtatcttgttgccttgctataagcacttattagtgctggagttattttttgttaattcttggggatttttcattgctgcctgggaacaagtattatttccttcttttcaatctatatacattttttttgccttttcttgtattattgcaccagctaggatttccaatacaatgatgacagtgagtgataagagtaaacatgcttgcctttttccgctatccaaaatgaaagcatccaatttctcaccattaagtaggatgctagtgctacattttttggcagacatttttatcaagttggggagcttcctctccattcctagttcattgagaatttttattttggataggtgttgcatttttccaaatgctttttttggcaccagttgatatgatcatgtgatttttcttctattcattagtggatttcatgaattaattttctaatattgaaccatcagtcctgcatacccaagacaagtcctattttgttgtggtgcataagtctttttaattgttgctggacacaatttgctaatatttgttgaggatttttccatttgtattaatgaaagatactggtctgcagttttactttcttgaaatgtctttatcttattttggcattatggtaatttggcctcatagagtgaatttaaaaatattctctctgcttccattttctagaagagattatgtacataaagaagaaatgtatgtacatcaagaaaaaatagaggccaggcgcagtggctcatgcctgtaatcccaggactttgggaggctgaggcgggcagatcgcctgaggtcaggagtttgagactagcctgcccaatatggagaaaccccatctctactaaaaatacaaaatcagctgggtgtggtggtgcacacctgtaatcccagctactcaggtggctgaagcaggagaatcgcttgaacccgggaggcagaagttgctgtgagctgagattgtgccattgcagttcccaaaggacaaaaacgagcaggagaaccagagttctagaagtgaatttgaaatgagagctgagggcaggcaaggaaacaagcaaggagattaggaagagttacttcctttgcttaaagcaaaacaaatacatacttaggtttttatatatacataggtgtatgtatatataaaatgtctttatatatacataggtgtatatataaaatgtctttatatatataggtgttgtatatataaaatgtctttatatgtacatatatgtgtatatatacacatatatatttgtatatgtgtatatatacatacatatttatatatacatatacgtatatgtacatataaaatgtatatatacatatatgtacatataaaatgtctttatatgtacatatatgtacatataaaatgtctttatatgtacatatatgtacatataaaatgtctttatatgtacatatatgtacatataaaatgtctttatatgtacatatatgtacatataaaatgtctttatatgtacatatatgtacatataaaatgtctttatatgtacatatatgtacatataaatgtctatgtgtatataaaatatctttatatacacatatatgtatatataaagtttgaaaaagtcagatatactcatttaagaaaattctgaaaatataggcaagaaaaaaggagacaataaaatcctttttatacttaatttctcccccaaaggataactactcttatttcagtatacatatatccttcctgtctttattctacttttaacataattagtataatacactgcatatttgtttgtaaatttttttaattcttaaaaatataccatgaacatatatgcaagtcattaaacagtcctctgcaccctcatttgtaatgacaatgagatatttcaatatatatttatagccaatctcctattggtggacatttagtttccatcaattttgtttccaattttttgtaatcatgaataataatgtaatgaatattcttgtggctgtattttgcttacgttcatgtaaacttcctaagtatatttttagaaaattaggattattggtaaatggaacactatgtaaaatactacgatttctaaatatcttgccagtttctcaagaaagattatagaggggccactgtcaaagaccagggacctgccctaaaagttggcctcttttaatcttaaagacacactccgaatctaatgtcaaacattcctttccatatagtttttgaaaatttttttttcaaggagcatagagtggattgttacagtgctgtttctaaaattaaactaatttaaaggttcttaaaaatcatccaagaagaatatatatatatgtatatgtatatttctggaagcaactcatcatcctttccatcccagtctatcaccacctctctcaggagacccacagttcttacttttaagtaattggcagtttacagtagagaaggatttcaaatctaagttggaactgggctcaggaaaaataataagttgtttgtttcctattttccagctgaccttggagcccatctctaagcttctactcaaatttggaggcatctcaatatgttttaaaaagatagtctccgtgatttcaccttttgcctcttatacaaaaaaaaaaaaaaaagcatctattgactggttgcaagacacattagttccttaggtgaagaatgtattgctaagcacatgttatacaccctaataaggtttgctctcattttgtacctggttaattcatgcagggggagcaaagcatggtgatttagagctccatgtctgtggaaagacagactttggttcaaatccttttttttttttttttaatttactgtatgatgttgggcatattacccaaactatcctaatcccaatttgttcatctacaaaatgtgaacaactgtaatcgtatgtttgatagtgctatagcatgatttaaagaaaatacttagcatggagctaacatataatatgtgctcaattcatgttaaataatgataaaatgataaactgttaatatgccatttcagtctctttacttctttatatgaaaatttatgattccaaactgagacaagatcaaacggaataaatttgaggtaacacaaggcccacctacctataccaaattatcattttctctcctaagagcagcagaggtatttatcgaggcttagtattatttattaataaaaaattatagacaagctgttagtgaactgctaagtgcagtatcatattcagctctaccacatcttgaaatagtgggcttcaattcatgtttcatgtgcagattagtattcatattatttacattaaaaggagtagaaattggtagtaaaattcttagagaatctttggacaatggtcctttcatgtctctgttcataatcttggtattaaggcaatttactaagccttatttatgcttcaaacattgtattttagaatgtactctcatggatatttcctcatttgctcttcctgtgtactcattcttatttctagttaatgtaaagagaacactgagtctcagagaggttaggtaacttgtattcagctctataaaatttgcctgcgtccttttttttcccccaactgcaggtgccattctgttaccactgctattataaacaaaccatttgtggcttttcaaagatgtcctccccaagggaaagctgatataggcatcatcttattcccattgggctgccatcacaaaatactgtagacttgtaaacaacaggaattggcttgtgaacaacagaaatttgttgttcacaagttctggaggctgggaagtccatgatcaaggcaacagcagacttagtgtttggtgagatgtctggtgagggctgatctctggttcatctagctgtgtcctcgcatggtggaagagaaaaacaagctccctccgatctattttataagaacactaatcccactatgaaggctctatcttcatgtcatagtcccacctcctaatactatcaccttaggggttaggtttccaacctataaatttggggaggacacaaacattcatttcctagtagggactgactgcaaggacagaatcatgactccatttacaccactcagagtaaaataaaaatgttttctctttttccgtaacagtgagattgcttttctacagaactcatgaatttatccatattgtattgccataggacaatcttacattccaagctctttgtatgaatatttcaaattggggaaatgaaagcagctagctgaacagtctgaaaatgtagcaaaggcattctttgctggttttgttattctgcttcactctctttgattaaaactggcccactgacaggatttcctgaaatgaggttcaagttaataatcccaaatacaagcatcttaagaaactcattctctgtaccagtctttagttaaaaacttagtatggcttggatttaagctgtagataatgaggtttaagaaatccaggggagaaatacaagctttctcaaatagcactagtaataaaaattctatttatgggctaaaggtatagaattgaggcacagtgtgcttctactagtgtatgtagagctttaatttaactcgaaatcaggatgaactaggtcagatggttaagaagtgtattctctgtcttcagataaaattaataggatgctccctttgtaaaagcataaagacatgacaggatgaagtaaaagtccatatttatggcaatgcgtattccagaagcacgaaaccacagcagaggaaaagaaaaaagaaaaactttgcttttatcatctagtagtatttcacaattgtgaagaatcacatttcaggcaaccttcatttagaaaataggaacaaaataagaaaaggcttttgcaatgctccttttgaaatacaaggttcaagaatccctcatctatggtctgaggaatctttgaataagagaattgcttcatattggttttctttattgagatttgcatccaagctcaatttttgtaaaaagagagaggggagaagtgtaaaattggagtttaaagggaaatgttgccagaaacgactgatatctgtagttaaaatgataatggcaccatttgttttgactctgtaacatcagtttcaagagatttaacgataatctccattctgaagaccccttcaaagatccaccttcctccatggtgttctttatctgattaatatattaacttttcattttaaagagatcatttatcttgaagcaaaacgaactcctagtaaatactgcattgctagtatcaacatggacaaactacacagagtctaaaaagaatgctgaagccacagtaggagaaacagtctattagtgcttttaatttagtgggtggcaactcaaaggaattagaaggtagatcacaataaattagcgtgctctggaactctaagtggaggagaactggcaggtaataatttagttgaaattacccatctaaaggtgagtatcattccaaaaagttaattagcattgttagcagctgcaagctgggtatttagctcagatggcatatggaagccatctgtcacaatgcctggtacatagtaagcactcagttaatgattattaatattattttaaaatatctaattttcctataccatttccttcagtttggagagcactgtctgattgctttcttccctactgaaatggtactagatgattaaccacgttaaagaaaaaggtcctccacacccacacatccatgtctcacctgaaagattcctgcccttgtcatgatgaagtgaacatgactactatgatcaaggttgtatctccatagcagctaggacattaaatggtgagatgcaggaaatttacacacactcatgcttgtgtagccgtttcattcatagtgtggagatctgatttcagtgtataaatgattcgtaaatcagtttgtatcaaatgcgtagtcatatggatcccttaacagagagtaaaagacaaatacatgtgaattaggattcctggttttgaaatgatagtaatcacattataataatcttaaaatatttttattaattgaacactcaaacatattgtttaataggtgctaggcagtatggtaagcatgtgacatgaattatcttaatcctcaaaataagcctatgaattgtgtactattactaattaccatgctataaatgagaggcgtattaatctattcttgcactgctataaagaaataacagggactgggcaatttataaagaaaagaggtttaattggctcacagttctgcaggctgtacaggaagcataacagcttctgcttctggggaggcctcaggaaacttacaatcatggtagaaagtgaaggggaagcaggcatgtcctacatggctggagcagaaggaagagagagagagggaaggtgctacacacctttaaacaaccatatctcacaataactcactcactatcatgagaacagcaccacggagatagtgctaaaccattaatgaatgatccacccccataatccagtcacctcccaccagatccccaccttcaatactggggattacatttttacatgagatttgggcagggacacagatccaaactatgtaaagaagattcttgcttataaatgtgcaacaaaatttagctaaggatgagagccacatttctctctttactacatacatagtattatactagtaaaccttattgtaattgttattattattattaacacagaatggtatctcttggaaaaatacgcttacattaaaacattaaagctcgctactaaaataattttgtttttcattgattccagtttttcccacccactgtccatttaggatggcttcagaaaagagaaatggtgtcaaatctgaagcagtttatttagtgtcttcataaaaaattctgggatgaagtgggaattgctcattaaaatgcatacatatttttaaataacctgtgttttgcatttattctttctgcctctgtaccttacattaccaatgataagcaagaggaacatggcattcagatttagcagttatataactgagctgaaaaaaatctcaacatttaattaggaactgtgaaattgtataaacctgcttcacttttctcccattaaaaactttgttaacacagactattgccgcaaaatgcatttgattagacttttcttatttaaaaggtttttatcattattttttgataatttgttgttttttcttgctgtgaggattctaaaatatctagagcacacactataatagccaggaggaatccaccatatcatgtaattcaatcacacagatagaaactaacctagctagcatttgaactgaggcattcagaatctatttgtcaggtctgttctggatgaatacagcaggaaaatgactcaaaatgggcttaagaaaaaaataatatattggctaactgaaacgttcaaaaaggttgatgcttgtttgtttttcggggggtgggcatcaagcatgccttgagttaggtgtgtgaacaattccaagtttctttcctctgtgttagtttcggatttcagagatgctttctctatttggtggaaaattattgactagaatcttggcgtttatacctcactgtctcaaaaaacctcagtggaaagagatctcctcttcaagagccattctgcaagcagtcctggaactgaatctaattgtctctggttggtttgtcttcatccccgtgtttgtctagtcaaggtggctatgccctacaagcctcttatggcaagacctgaattatgtgctctcacctaatgccagaggtgtggtcagcccaactgaaatgagatggggaggattgggctttgtaaggaaaataaaaatgcaggttaaaaaaaaaaaaaaaagcaaacacatgtcctctgcagatttagaatccaggacattaattcttgtaaccatcttcaaaatggaacaatataacttttaaagcccagtactgtaccctgaatcttataaccttctccttaattgaatgttttatcagacttacaactccaaacacaattgagaaagaagaaaaaaaggaaagaaagagagaaggaaagaaagaaagaaagaagagagagaaagaaagaaaaagaaagaaaattctagaggagtttctttcttagtgagattttcttgtctcttttaagtctcatgtctcttgcgtttcttgccttttgctatcattctggtgtgattgtagctctgcagagcaataagttctcaacatatgttcacaattcatggtttttcacaatggttctactactaatttttttttttgtcttatatgccattcatgttcaattctctagacttccatttggatgtgtgtctaaagcctatataaaaatactataataagaaatacttaaggtttcctacagttggtattttaactaaagtagcacatgattagagcccgctgggaattctaattaattgaatttttaagaggcagaacctgaaagtataattttttgcaagtgatttattagatgagtttttagaaagaacccaaaggaaaagagggaagtggggcagggaagagatagtagccaagctcggtatactgtcaagcaaagttccacagaaggtaaatttgattcaatcctatagctctggagagaatacaggtcatacctagagttgtctcacaactaggagcacgggagctggagaagttataccctagaagccagtcatttattggttaatggctgctcctgggggtatgtaaattcctaggtactttcagttctctctttgtgaagataaattagctataacagcttgaggacagtgtccaaaaagagataacatgtactggctcttaagggtacaaagtacataggaatctggggcggaagagggattagaagggacgtgagtccagcactgacattttctgctacattactcgtctaagaaaggtgtatctaaataggagactccatttcttgtatcaaagggaaaaaatgcttgtccagtaagactttaatgttgtcactgagttatttttctttggacaaggtggaattctctttacacccacacaattgggccacttaaaatggagatccacttttgtaaagtaacaaatacctaggcttcaagggaatgatctaattaggtttgtgcaaaagtaatcctacttttgccatgacttttaatggcaaaagccgcgattacttttgcaccaacctaacacaacagctgtgaagtcagtattcctttgaattatactcatagcttctacttcaagaaaacctgaaaatgaatcccagctccgcctctttagctttagaaaagtaagtgaaattatatgtacgtattgtacagatacatagtacttggtactctgtattgtacaggtactgtgagtctgcataatatatgcatataaggtagctatttgttgtaatattattacaattatcataattgtcaaaatgttcagttacttaggtatttagttatgttaaaaaatgacttctgtcttcacaatcaatataaataactaagagcagagggaaaaatacacaatttttacttatattttgtctgaatgttttagattaaaagccttttcaattggatactttgcatgtatttgttataaatctcagagatttgctgtcataaaaagataaaggatcatgaattcagacaaatattagagctctatttttcctttgtaaaacaattttctcagaaaatttttattacactggtaatgcatgctcattgcaggaaaataatgaaaaccagaaataaacagagagcagaaaataaaataaaataaaataaaataaaataaaataaaataaaagacatttatatcacaactacccatagataaaaacttcacatgcaatacatacaacatatgcatttttaattgaataatacctcatatcctataaaattcactagacattgtgaatatctatgtgaataaagttccttctagaatttcgttcttattggttagtatgccataaaatgaatgaaaaagaacatcagttatctgaggttaattgttgccatgaatataccaatttactgaaatgtcaacttaaatttgtggcaagtggcaaggctttttaaaaggacaaaaacttagtatatgataataattattttttacttaaggcaattcaaaattcaagttttcactgtaattgtatgttaattctgagaataattgaatcaaacattgatttagggcacattttctgacaaatatgtttgagtgcatatgatttttatccttgtgctttatccttgatgtacataggaggataataattttttccaataaaaatgtctaaggcttcataagtgttcttgcttgaagcttctactgagacatcccaactttctgcagttgtttactgctcaaactctccaaatctttatttgccaagcactttgcatgtagttggatgagcctcccacattccttctgctgacttgaagaaattctgcctcttcttcaaggtttaccaattgactttgcaaaatgacttactaccattattattaatttgaaatataattagaatagaattattcaaatcatctaaaaatctataagggaatgaagaatgacttgacaagaggaaaggagagatattaatgtgaacagactggggattcattttacaattcattagtttagtagtgaatattttccttctggaactttgcttgcagcctgcccgttcttattttatgccttctaaaccattaatttctaaattcatcccttattgttaaacacttagtttcatttattataacatgtatttttgctcctttgaaagatacccatattagactaaaaataatagatatgagaaagtagacgaaattaatattaataaagtaactttatttacaagttctttataacaggggacaggctgcggtgtaaatccatctttgttttacttttttttaaatcgtatataaatgagtactttttttgaggatcatagagcctatttaccagttcatatgggtctgttttatagtgctgttttccctggataatttacctcacccatcccatgtcttcagttacctattagtaccagtttagatctggaatactttatatttttgccttagaaactataaatatatatataaagcctgcctagtcttaaatgtcatgttctcacaaagaatttccttgaccactataataaattgacataatcttgttactatctctgcactctatttcttttgtttcggttattgcagtttgcaagtgtacttgtttttattatttgtttatggtatgttttcccactagtctgtaagcaacataagggcagaggacatgtctattttattcaccactattttccctgaacatagcacagtgacttgcatacggcaggcacttaataaagtgttaaataaatgactgattgagtgaatggcgaatgattgcatgatctgaaaactagtcataatacaacagattgatagaatatttttcttgagagttatttgtatggatgctcttcttttattttgctgtcataaagattaaaccgtcttctattctaatgaggtgtaactgtttagtccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatggtgagctaattggatttcaaatatatataaaatatttggtaatgcccttcataataaattgtggaagtcattagcatgttgtgaaaaagtgtcacgggagaaataaggaaggcatatttccgggtttagatgcttaacacaatgattagcagatgggaatgaccacctttaaaatatggttttaattttagcatggtctatgaatgctattgtttattatatttgccttcaaaatatcagcagtgtcatgttaaagccataaaagtttataataaaaggaagcatgaactccatatatttcccattaaacgttctgcagcagattatagcaatcttgattctaattctaagtagaattaataaatgaaaaaaattgataggaaaaatataatactgcatggtggtttataatatttgttcctagttttcatattttgtctactcataagtaggtaatataaaaagaaggcaattacattatttaaaattatgtttgtctcagttacaaaaatctctcgtaaacttaagagagacgatgaatgcatatattatctaaaagctgtctttgtgtcttctttaatccaggattgaaattttctcttacttaacattaagtaaacaatacaatatatctcagaatttgcaaaatgctgtatactattaaaagatccttaacttctttgataaacttaatgtatctgtattagataatttttaaaaagtattgatatatggccaaaatactttcctatgtgacatgtttataatcaatgataaagtaattagagaaaatatgtgtgtatgtgtgtgtgtatgtgtgtgtgtgtgtaataactagaaaaatccaggatactgtaattatcccataggaatgttgattgagtgcccgtggggagaacatattgtgtgtctgtaatattattttccattttctttagaatttccaactttaacctgcaatgaatactactattttatatatagaatataattttctactcattattctcctacagttttagcaaacctagccaagaaaaacaatattttttttcagtagtacctacactttaaaggaaagtctttggaatttagtatcctttgtaaataaaataggatacaaatgggagttttagtagaatgaagatattgaatgctttggctagttttaaagaaatattttccattttatatataatagacaaagatataatcaagggatgaaccagaacacaaaggtatctgtaaactggaaatcaataataaagtacctttctgtatactgataaagcaaatgttagcttacatagcaattttacaaacattcacttatagaattcttaatcttaagaagtagaaatcttaagattaatattaagaggtagaaacaatgttcagtgatactataggcaaaaatatcttaagttaattgtgcaggatctcacagatagtgattgtcagattcaagatcagaaccttgaaatgtcttctgaaactgccatagcatttcaacatggtggtctaagctcattgtactatatctcaccacaaccaaattagccatttaattagcctgaaatggtccttgtaggggaataatggatacttagtcaataacataatcattatgtttcttagtcacatattaattcactttctgaagtgctttcaaaagaaaagaggattactgactcagttacctcagagttgaataataactgagaaattcaagaaaagaatctctcagtctgttatattgctgtgtttaagttataattcagaaccaagtaatattgtatatccatctatatcgtaattttataatctctaaaagaaatctctaaagtattattcatcatagaaaatagaacatgttcagaggagttaagtggcttttcataaccagtcaatatggcagaaaaaaatctaaaactcaaacctgtatggtagacccaaaatcctaagcctcttctcccatgaatttcctacctagttttaaatttaaaactttgctctccagaattttaatcatccaaagaatgttcacgttgaataaataaatgtgttctgtagccgcaattattgcattaagcataaaatcagatatatctgaaacctttgtaagttatgtgaaattacatatgagcatgcatttattttcccaggtcagacatatattaggacaatttctaaacaaatacttatgaattatataattttgttaataatacccagaaacatgattcaatttcaccaatagatctagttcttctaagttttgccttgatttgtccctcaaggctgcaggaagcacattctgtaactggaagttgtcctgattcctgcaagaggtaatcctaggcttagttcccaccacccagagacatcatgatttcttttactcgtttgtagtctcattgaagggtcttctgtcttggtgaaggcaggttgtgcagtagaaaaactctagaagtcagacagacttgcgttttatattgtgcacaatttcgaatcctctcggccctgcttcttacttcagccactgctacggtggccagttcagcactgtgcgttgtagatgtaacctgaaggagtgttgtctcaggtgcaaaactaccaagcacatcttgttttctgttctgggttttctttggctccttcgtgagcctactcagcatttaagcatgcccagtttggatgtgccagtagtttacacctgcactacccttagatgaccatggatgggaactaaatgatcccccttcatttccctgggtagacagctctaaagactgcttagaagttgacataagatggagaacaatggatcgtgttggtggtcaactcaataactcagccttgcattgacttttttttccttcccggtgactacctttttttcctgatgcttttcccttgggctaacattctcaaatgaacatgtggaactcaagccctttacttaggttctgcttttagggttcaaattttggcttccctgttttctaccatgtcatcttgaacaggttacctaacatcgctgcgagaatccactgaaagattgtagagggaattaagtgcaattacaaatataaagcatctggcttgccacagcctgagagtccaagggaagcgtcatatacttctgtatatccaaggacagaactaaataaaggagagggattaattggcacctccaggcagtttccagtcagtttatgaaagagatattcatgtgaaaacatttaatttccaacccgcctgtttccatgaatgatggtaaaaataatacaatcttactttcacgtcaattatgccagtttcttgttgtctcactactatgaagaactttctcaaattaaagaaaatttggaaaactcacacccagaattaaagtaagatactgaacctgtataaaactccaaatgttcaccattccttgtcaagaattttatctaggaaaaaagaatactggattatctttctaccaaaatgccaggaagctcatgtttgatttatgcttcaaggtattgagttgtaattgtgtctgaaacagatacagatttattacttttagtttagagcaaatataatcagtgaactttcagatttattccacaggttcagatttgatatacattttctaacttgacctatgttctaatatttagcatggatttattccctggccctgttctacattttgcccttttcccacagctcccaagttgttatacaggtggagcaaaatgacagatgacaaacatttaacttgagccaaatgcccaatgatatttgcaacaggatttctgtcaacccgcattgaagctcctgcatgtcccctccctcaaatcgtgtgtgtgcaatccaactggacccagttagccttgtccttctgatctctacagcccttgtaatgtagcataatgtcttggataactgccttttaccaaacagtggcacttgcctttttgaaacagctcctccagaatgggaacagaaaatccaaaatacacacctctctatctatgacaacttgctctgggaatgtaaagctagtggaaagccaaacccttggtatacatggttaaaaaatggtgaacgactcaacccagaggtaagcaactatgttgatattaaaagtttacctactctactaggtaaattttgttactaacagtactagtaactaacagaaacagctaatgttaatggagtctttggtatgttccaggaaaggatgcatacactgatttatttaatccttaaataaacttacaaagtaacccatctttcaaaagagaaaaataagtgtagacaagacaaataactttcacaaaatcactgttagccagtaatagattcacatttaaatatcatcatcatcatcaccgtcatcatcgacacggataacacttactgaactctcatatgagccaagccctgtgttaaatatttttccgtgcattatcttattgcaccctcatgaaaacattataagagagatacaagtattattcctttatgtaaatgaagaaaatgagtttcaaagaggttaggctacttgtttaaggtcacacagcagctagtaaatgttagaattagcattttaaacttttattttggtctgatatcaggacccaatctcttagtcactacccagtattttgcttttatgaacactgacgactgtctttaaacccctaggaaagtaaataactaaggcagttatccacatttctccatttaaagcatactttcttctacaatacctagaaaatgaaagatttgttttttacctattaaattatccagataattgtgtcaattctccattttactttgcacatgtaggcatagccagagacacaaagaacatctgttgtttggaagctgaatataatgctgttctttgtttcagcatcagtgaaattttcttcctgcatgccttttgcatatagcattctgtttcctccagcctattttccttttccctagaggatggtaatacatgccttgaaatatttagtcttaagttatatttgtactattaattatgtcactatgtgcactcaaaattgtatttctataccccacatggggttctgtaacagattttggctgtttaggcacactttatagtagtttgtagaaaggaaggatttagctactccaactcaagactcaattagaaaattatcacatcatcacatttcaaatgtttttgaaacttttggaaaatggaaagccaaggcagtgttctagtcatgatatacatgtctaacattattgttaaccgtgttttcctggaataattaggacggtggagtattccaaattactatgtataccaaataacagaaagttaacatacattttgtgcaaagtatgtcaattgtcaaagaaatgagataacataaaacacactagtaaccactaaaattatcctaaacatattttcgttttttaaacttaaaaatgctgctcagaatctagtagtgtattaatacaccaaattatcagatctcatagatatacacaaatgttgtttaataacatatcctggttaagagaatgctatattaacgtacaagcatctttatatgccttttcctttattaggagagaattcaaatagaaaatgggacactcatcataacgatgctgaatgtgtcagattctggtgtgtaccaatgtgctgcagaaaacaaatatcagataatttatgcaaatgctgaattgagagttttaggtaagtcgtttatttacaaccaacaaattcaaaatgacgttttaacaagctataattatgcataatcccaacccaattttttttgtaaattagaaattgctgtcccatcaaataatgggaaatgtctaaattaactttttacaaaattcaaggtggtaattattattctgcttgggcaatgcactggggcttcagaaaaaaacccaccattgggtgcatccaaaccggaggaagctcttccaaagctgattctagcatgaatttttgagtataactcaaagaatatctttaggaatattttcagctgcaaattaaaaagtaataaaaaaatcacaattcacagtaactaaaagaaacagtaatttattttatctcttagcaagaggggcattggctgccgggcatggcacctcaacttgacaaaatcctttacaccttcccttcagcatcaaagcctcatggttacaagatggctgctctagttatagaaatcaagtctatgctcaaggcagaagagcgaggttacagaaataatcacatttatctcttttattagaaaagcagaatttcccttagcttccatagtaaactttttatgtcattaactagagttctgtcacatgaccatccagacatcaagaggaggtagaaaaataagtccctatagtgaaaagtgctgagattaaagcaatttgagaatgatattttgggaagtccaaccagtggtgtctgccacaataaatgacgcgttgatagttttcaacccaagggtttcttagtggtaggaagaacagaggagataaaagagaggaaggatcaaacaacaagacacaaagttttatgagcttatgggtgatgagcactcattcatttgctcattctttctatcgctactgtttgattgaacatttattatgtactgagctgtatcaagatgaagtgatctttatcttcactcaacctataatttcaaggagaaaaaagtgtcagatttaaaatatggcaattcttatggctaagaattgaggagttgctatcgttgcacatgacaagttgaacataacctacattgaggacattccctttaatctaagatcagaagtaaaaacatgcatcagtaaggtgaagggtagagaagcaacatctgaaaagcccagaagcaagagagcatggcatacccgaaagaacttcagttcacttgagctttagattagaaatggagactggacacatggattccaacattcatgaagttggaaagattcagaggcaccctgatagcctaataatttcttgtccttctgaactggcatttgttcaacatatatttagtggggaaaaaaccgacatagtgatacagcatttctgatttatttcaatagtattttattgctaatagcaataaaatatttctgatttatttcagttgctaaccacaatacaataccactgaaataaatcagattggtatatatacatatataaatcacatatatatgtatatatgtgtatatacgtatatatgtatatgtgtgtgtgtttcttcaacatcatatgttccattgcttatatacatatataataaatcagaaacacacatacatatatacatgtatgcatatacatgtatatatatggatacacatgtatgtgcatacatgtatatgtgtgtgtgtgtttctgatttatcatatgtatgtatatgacatgtatgatcattgttttggctggaatagactttcctggtcagaattaaaattccttcttcggcctcttttgaaaccatcttcatcctctttgttgtaaatgctattagaaaagtgactttgtctaacttgcctcctctctaccacttgcttttattattgcaatgaccaccaacaaaacaaaaataagttgcatttattgagcctatactttgcgccaggcactatactataattccctgcaactgttacatcatttaatctccacactaactctctaaggtaatatcttttgtcatcttcattttacaaacaaaacataaactctaaaatgttaagtcagtatttggtccaagaacaccttgagcaaagtaacctgaaaagaggatacagctataaatattagattctgtctagcatagcaagtcacccctggagtcactacatgttaactgagtaattaaacaattttgtctttgattttgtttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaaggtaaacaaatctttatttttaaaaatatttttgtttgtaatataacatcttccaaatttttaggttttagtaggcctttcaaaatttcctcttttatgataaagtctcattggcatacctagagacgccagcattcttctcatcatagtaaaattgtaaaaaacaaaaggatcttataaaataaagacctgtttgtataagttagctgcaatattttcagtgcatgcacttgtaatagatttttaaaaatcttttaagacctttttctacattcagtttgaaggcttcctcctgaaccagcctgctgagaaatcagtgcgaataacatttcacaaaggagagagacactcattggcacacacctggtgttgtggtttttaaatagtcacacaggtgttcaccccatgacaaaatgaattcaccacatgaagaaatgtagagaggttcctgtagagaaagaagagaggtttcctaccataatggatacagttgagaaaccctaggtcagcactggcatgttttctaggagactttgacaaaagaaaacaaacaaacaaaaaaaaagacgggtgtttttctctacttgtaatatcttttattctattgtaccgtagagccttgtatacatgaggtgactagaccacagatgctgctctcttttaatgactcacatgtgttactctataatcagatatgcaattaaatcctaatgtgaacgagccattgtgctgaagatatgaaaatagtccctttcgttcaatgagctcttcttcagcatcatatgttccatgacttatatgcataccaggatgggcaggtaaaaggccaggtgaaagaaaggacaactaaagtgtgttaaaaaatgacagttgttactcttggaagaaatgactgtgacggactagaaagtgagttccctacctaaaaaggatagtcacaactccaaattctgtcaactggttgccttgcgggaaatgagaactaggtttgtagaacttccaatgtttcagagaaagctagaagtctgcattctggtattgaatctcccatgccagaaaaaagtagccataggatgaatgaagggacatcattttatcacttctaatcccaagatttcatttgtggccgaggaaaaaagaggtgaaaacaaacaaaagcaggggtctctgtggtttgtgtagagtccctttgtggttataactgctgccttgaagatccattccatttacacaatgaagtgtacatcagagagcccctttctagggcattctttctttccttattctctgcatttctttacatccctggactaaagcttttcccaggacaggaattatgtcacatttatctttgtatgtcctgtgccttggcacagaaccaaaacttaataaatatctgtggaataaatgaatgaatcaaaaagggtgaacatgtaaagcgttaccagctttacagaaaggctgttcttggggaaatccctcaagacataggaacaggtgcttcagaactaaggtgaaagaaaaggtgaaaggaaacctgttgtcctgactcaggttgggtctcttcttctgtgtgcattgcctaggagatttgctcccaacagatttagatgtgaattctttttaaatgtttcctcatgcattcctaaaatctaatcaaggtttgaatacactgctgtggaacagaaaaacataagagatcctgcagtatcaaacacagcaccttgtactgagggtctggacaaattgattaactgtgcctcatttaataaagtaactcacccaaggagcagaatgatggcatttaccttccacaagctttaaaggtccaaacacgaagtatgtgggaacaagaaagaaaattaggaggagaatttgagtaaagctaagataatgagagagagaaaaaaaaaagctaagataataagaaaaaaaagcaggagggaaactgctttttaaaacagctcttcaggtttttgttttattttgttttgtcccatacagaataaatttggggtcattttcacctcaccacagttactaataatcatatcagctcagcattgtctctctgtgattaagggaatgaaccctgtgagttctatttatacattattctttcattctatcttttcattgcttcagggtttcactgcaggtcttaacaaaagaaaacatacatacaaacaagcaaattatctccttactgtgcattcttaaaagttgaaaataattgagctctagcagaatgtagtaattacagtcactacatctccacccggtagagattacactgagcagtaattttcaaaaggtcacacagttaactccatgagtctatgtccctgcacactttctagcttgtcctttcttctgttgccatctgatcgactggctttattaagtgcatggcttcaagctgtttgttgagaaatacagcatctatgcttctgtttgtgtcagactattgccttttttatagtcttatcgtgggacttccaaacagattgaggtaaaaaattagagtagtgataagaaagagagaaagaaaggaaggaaaaaaggaaggaaggaaggaaggaaggaaggaaggaaggagggagggaaggaaggaagagaaagagggggaaagaaagaaagagagagaggaagcaggaagggcaagaagggtcactgctgtttactatagacgtggtgtgatatagtaaaaagatttcagcccccaccctgttgagagcctgactttggcaaagtcatttgtcttctatagaacttcatatgtaaaatgaattagaggtacttcattttcctaaaaaaggagagaaagtcaaatggtttcttcaagcctgttcaggcccaaggttgattatttcttctacatctttggtctgaaccattacgtggtagccaaattcttttttccctgatcagaaccccctcttctttttcaaaagagtattgacagaacagatcctaaatcctagcaaagtagctacatttagctttcaaattgtcatggctttaagaagacaatattaacgaaagctttggagaagacaacatcaaaatagcagttaatttcacaaaatatgttttcttacatttgaatacataaaaaagtttatttgattgagtatgtatgtgtgtatttgtgtgggtggggtgtgggtagatgggtacctaggaattggcatcagatttccaaagcaaacaaaattaaatatattaggagccagggacagagtattgcacataaaggttgactgggcaatttatttttagatttgattacaaatgcaagggttattgcatgtgtacatacactgttcaatgctatatttgaaaggagcactagagataatgtatcccattttccgaatttacagtgccagatcctaaactcaaacacagaacgctgagcccagtacacattttttaatgccacaccagactgattatttcactcaaatagcaatatatacataacttctaccatctcatacctctgttaaaacatgacacagttgtatatatatgaagaataaaaaagtcagatataggaaaaaagttcaaaattttacaatgattccaagtagaaatggtttctagttcttgaccttggaaatacctatgtgaggaaatgtacatttttagtttctgttgtaaaacttctatatggtactgtctactttgaaatttcattgtcactaactcttgcagccaataaagtataactacctagagatggttgagagggctctaaagaaacctattcaaagtaatcagactgaagtgctgacttataaaaaaatggtggcagtatatatattttgacaatttcttctagtcttacatgaattgaaacagcttccatcacacagctaataagtgaagaagcttagacttggtgccaagtcttccatctctgtattcacgtcttttcctctctatggataatggagtacacgctcagctcttcagtttttgaaaggctgttgtcacatgattcaacgtaatttgatgtgttgataattcagattaagttacatttctcaatacagtgaacatgtttcttattagcctatgtgccataattgaagtcttggctgttttaagagttctgttcctaaagcaaggatctgtatttatagcagcctgtcagaggagaaaagtgtttctcgaaccaaaaataggtagatggcattacagagtccgaagactgcctggtttcctgctgggaatgaatggtcatgcaacatctgtctcattctttttagacccaccagtggtttagaaatagcacttatattgaagagaagcaaaaggcatattcctgcaggagaaccaggaagcactgggaattagaaaacacgggttgtggtctcagatctatcactgataagtggcgtgacttgagtagaaatgctagactcctctttttattttttttttttttttgaggccactatttcctggatttatcttaagatgaaataatatgaaaacaactttaggaaatattaaacactatattcatgcagtgtctgcttgcacagagattacattttagaaatcaatagagaaccttagcccaaggggttgaaattgaaagttctatcttagttataactttatatatgttttaatgatttgcttgggtgaccaggtgactgagccaaacacggcaattgctgtgaactgtcaaaacagctaaaatgatttggttggatggattcagagtttacagagagccctatcagctaggctgtaagctccatgaaggcaccgagcaccattctttaattcaccattataggcctagcatccaccacaaacctggaatatagcacacattcagtaaatattttctgtgttgctaaattaataaaagttaaaatttaatttgtttaactaattttagagattttgcagctaagccaaaaattttaataattaatagaccgatggtatgattattcatttattaatttcttcattcattctgcaaatatttgctgaacacctattataacctaactgggtgctggggataaagtgttaagccagatagccacataacatataacattcttcttgccctttcttatgataatgtttttctttaaagtgatttgaagtcaaagatctgggttaaagtcccaactctatttcttagctgataacttctagcaagtcctttaacttcacaggttctcagctggttcatttcagagaaaatggtacttgtctctctgatgaggttataagagactcagattttatgtccggaatgacaggtgagctgtacacacactgctacattggatgtatttgttgctgtcatcgtaacttgtatgcatatcccagttgtgcatgcttttacctctggcagccaaggaacaaccacggaaaatcaggatgaattacagattaagtttatctctgcaaggcattctcaggcaactgagggaatcaattccacatctgctaagtttgattaatcacttctttttttccttgtggatctacttagcaagtgaactgacagaaatcaaagtcctagatttgtccccttatgcccagtgactgctgtctacctattcaggaatcacctcctgaatttaataggaagtgttaacccactggagagacagttcaatgttgttctctgacaggcagcattaaatacaattcctgaattacctggggtttggtcatagcggacatacaagctatcaacaataaaaacaaagagatggagaaaagaaatgttgtcctattattggaagaataccattatacaattgaatctggttgggtgcagtggctcatgcctgtaatcccagcactttgggaggccaaggtagaaggactgcttgagttcaggagttcgagaccagcctgggcaacatagtgagaccctgtctctgcaaaaaaattttaaaaaggaatggggtggaacatggtggcacacccctgtggtgccagctaatggatgggggtgggaacgggtgttgaggtgggagaataacttgagcccaggatgttgaggctgcagtgagccatgattgtgccactgcactccagcctgggtaacagagggagaccctgtttcaaacaaacaaacaaacaacaacaacaaaaaaatccctgaatctttggtaattgacagcattttctctcattttccttaaaaaaaaagcctactgcactttgcccagatttcttaaaatcaaataaataaaataaaataaaatacagctaaatgtcagaaaaagtctcattaataatgatgataaccactttaagcaccttctacatgctagatggtgtaccaggcactttacatatctcaaaacattaaagcacatttttttttcatattcagatatatttctgaggatcacaattgtcaccgattatatgattaaatttgtatcatttttaccctagtaatctcaaaaagttaaacacaaaggcatttttaaatttacagagaatcaaactgactcaattacagagattctaccccttagcaattggtttcagaaagtgattatattccccagaattgaaatgagcggacagctggactctctggaaaccaattccgttacctttatctacttactccaagtatatatatttgcagacaggtgttatcaaatcatggattctgtgtgatttatcctacaataatgctactgttaaaacctgtgtggccctggacacttggcaaatgcatgtaccttgtgggaaagagtgaacccattaggtgaattggagtcttattcaattattgaacaagcggtgcttcttcaatatttttgccttcaaacctcaaatttagagcagacccactgcacttccacctgcctggctccgcaatgcccagacaccttcctcttggacactatattccattgtgggaaaactacacaaggaaggtataaagatcgtagggaaagtggaaagtggaagaaggaagccaaagtaagagagaaggaaatggtagagaaagaaagatgagagaaaggaccagggaattccctgtgacaagatagaagtgctacttattgagcaagtcactggatctttcttttcttcatgggtaaaatggtccccttgggaagacctgtttgaaagccgttagcataatgcctgacacagacaaggaacagaaaaaaattagtttgtctttattcttctcattgctaagttatgtggacaaagcagttcttctagttacacagccattgcccaatacttagctatcattacattttcttcttggaggtttttccaatcatctgatcttgtggaggcaccagctaatgggagtctggctgcctgaatgcaagacagccaattatatgattcttcctccctgtctgacacttctctacatattttacaatatctaccttctaaattattactgttccttttgcttttgcctttacccccaagtgctcagtcttaataaaatatctccgtcgcacatgccttttcaagacaacattaaccattatatagcaactgcaaagcaggcttctctaccccttcctcctctttgcagagcttcctaatggaacaagcaaataaacttaattttattttgtatctccaactacttaatataatagtgcttagtacgtcaggtagcatgagtatcaaacaggcaaatgaaccatatgttcccctgtttaaggaagaatgacagtctgcataatgccaggcttattacaatctcccttctgtgctgcctctttgtaataaaattttaaattgttcatactcaactcctgagagccttgttaaggtgagcctttccaagggaatacatgttggagatgtcaagagccatctgatagtcttgcctgtttcacatgaagatgtaacaagctaaaatcctgtgtgtgcccctgtcagtcttgttttcattttcccctcttgccatccaattcccctttctttatccccactgacctccactgatctggggcactcacctttcacacagtgcctgcagaaccacccagatgccatggtctgaaaaagctccggttcattaaagttataaagcctgcctttaaatccagcctgcctaactcaatgtacgctgttttaccctgctgccttgtgttggcctattactgctgtagtccctctcccatgttttcgtgacaggtaaagccacccttggtggctttcaaccaagggtaaataggagaaaacaaagaagtttcacaaaataaatagcatcttataaattattaaactgtgtcttacaacagaaaatgggtaggcttccttgtagagtggctgtgaattcatgggctgcgatatcagtcagtttcaaatttgatcatgcaccataagaatcttgtgaaaaatgcagatcccagagccatgcccatgattttgatttagtaggtgtggaataggttaaggaacctgaatttgtgtaagttcactccctctgccttcaagagaggctgaagttgttgaataccacctagaggagcactggtttggtgcacacatatctacttagatagaaatgtgcttcattttatctctgttccaccccagaactttgattcctatcctagcagttcagccattcattctatctcactgttgaagagatataaatccttagttctcccctttttgaaaatgtgaatataattggctctagaatggtgtccacttattttacctcttgcttctaatttctgagtgacacttgtatcttcaaaattttacataaatattcaacagcaataattttatagacagaaaaggtcaattattcatgtaatttatacaaatgaccttttgttcttggtttgatttttgagaaaagaagtggttacttgataaattttaaagtataatgtccttttttgtttacttaaaaagaaaatggttgatgacagatctttgtcacacccacaccttctaatgccagtgagtgtatttaaaaaaataaataaaaataaataattagaaaaagcattgctgtctatgacaatccagtagaagaaataaaagctggagtaatagtatagaaatcagtctcattaaaaccttccaaacaagcagtgaagctgtcagagcactcttttttttttaagccactgactagaatttttcaattttttctttttttcatagtagaactttttaaattttttttcaaatgaaatgtatgcaagaaaacctttcattccacagataaaattgaactaatctggctaatgtcccggagggagaaccagaaccccactcaatgccctcctcaatccctctcaccctaaatctccatggtgtgccctagaaatcccctagctctccaaggagcatagtttgaggactactaatttgtagtgacaaatctgattctcaagtgtgacttgccaaacgattcatttatttataagtatagtggcaaaccaatttgacgggcgttgtgaaagattctgggtttataacttgaatgagctcagagtctcctggggaaggcagacaagcccacagctccggtgcagtggggcatgtgtcaccactaacatgtgaagagagtgagggcaattcactaacttggcttacaggagtctagaaaggtttcaacaggttgcaggtaactgaactggcagttgaagagtgagtgggaatttttcctggaagagaaaagtgggaggtacaggcttattacgagactgtcttactgtatatttggtatccagacttggtgtcatttcagaattttgggtacagatttcccttcctcaatacaagacacacttctcccgtgagtcctctaaatgcaagtaaagggtactcaaatcattttgcaaggcatccaagaattgactctttgactactcaaggaatgcttggatatacctaataacatatattttaattctatctccaattaaattaaccaaatacacccataaatctatcctccccatatttaaccatgagtttcattatataagaataataatgatgatgatatatccatttatatgctatccatcaagggcagatagtgtgttaagatgtttgatacatcatttcgttaaatttttacaacatacctatgagaggcatttattcatatttttagatgagtaaaactaaggcttagagaagttcagcatcataccgcgatcagtaagtgatagaaaaacattcagttctgagaagctctgactcaaagccttgtataatcttaaacacaacactgcaggattttaatgagatttctggtgtctatatgtggaattcaaggcagtccttcataatatacacatttttttgtttcttcagagttatactaaaaaaatcttctgaaaatagtgatatgcaaggtaaaactctatctttatgtcactaaaaggtatagaataagtcaacatgttgtccaaatactgatagatggagtcttatttattcacatcaatacaaaaatatcagttctttcagtggcacagcatcgtgaatacacaatgttcggaagactgattggatttttaacgtaacatacaatgtaatttttgatggcatggagaggtagatatgtaaattcagtaagcaggttaaagtcgctaagccccacaaaggaattaaaataggtataagactgtgtattataactaagaagaaagagttaaagttagcagacaaagagtcacacccaggttggtcccctattctcagccacttttgtaaacctaattttgtagactctgaggaatgctataattcagtagccaaagggaatccaggattggaaattccactagcatccatcactttcaaaaccatgttctatcttgatactcaagttttcagatactcatgtcctgaaatcatcagattacagggagctggagtgaaagggttaataatcattagcgttccagccctgttctctcacctttttatatgtgagggaagccgagaaccttaagtttcaagttggtggtttaaggtcatctgacttgaatctcatctgtctatcccaaagctttcagcagaaacaactttacatttataaaacttcaaagccctgaggaaatcacacaataggttcatagtcataaatgtaataatagcataggcagaatgtcctcacaatgttcagacttctccattctgttctgcataactctctcctctattgtattttcaatgtgttctcctctagtaactttgggagcatagtttgttggttttttttttttaatttatttctttaaagtcctgcattcacacatttttgtgtcctttgccaacttcatactttctagtcttttcttttgatttacttgggctataaggcatgttagcatatgaatctatgttaattctcttttgtgttttctcaggcatcccaaaatgctgcagcgaatggagacactttatctttcccttcttctactgaagagctaaatatttctctttggcctatttcactggattaatttagttaggctttccatctgatgctgttttgttaatgttaaattgtatttccttaacattttatgggagtcagcatagcagcacactctggcatgccatcagaataaagacacatcatggcaccaaataattacgctatttagcaactgctcttacctaccatctcctaatttgtgccataattcagtcaccgtgaatctgtgtttgtgttgcgtcagccactacaaagatcacacttaaattttttgtgtatattaaacaaggtgacacattatgataaatttagaggtctgaatatttgatgcttcctttctgctttggagtttaagacagttgaaccaaagacttaagatggaatcatttgttcactccagtaattacgcactagttgtaaatacaattacagacactaagaattctgaaaaagtagaaacgggcaccagtaacgttctcatttaaattaaaatgtatttgagtctatttctaatatctaggtaacccctctgaacaactatttgctaataaaaccctttcagttaactacctaaagaccctgaatcatccttgaaaaatcagttaatgggaagtatatccttagctatttaatagttaaaaatatgtatttctcgattttgttgaagagttgccaaaaaaaagtaacataaaagtactcaggtctatttcttttgtttgtttgtttgtttgtttgtggtggagtctccctctttcacccaggcttgagtgtagtggcacgatctcggctcactgcaacctccgccttccgggttcaagcaattcttattcatcagcctctggaatagctgggattacaggcgagcgccaccacacccggctaatttttgtatttttagtagggaaggggtttcaccatgttgttcaggctggtctcgaactcctgacctagttatctgcccacctcagcctcccaaagcgttgggattaaaggtgtgagccaccctgcctggcctgtctgtttcttttataagcacttgctttccagcaaaacatagcaaattggatttatttgttacctgtttatgatgtcacttcatgtaggttttcatttttgtttcctttcctttccctcttcctacggcccataaatatttaattacactctgcctaatataactcaatacagctgcccaaaggaacactattatttgcctggagctaggacagaggctaaaaaaaatactagagatcttattgcgacaattctgtgaatcagatgaatatttaggaaccaccaaacggggtctatattgttataataattaaaaacattttactctggcttgtattataccctttagtttcatgatcagaactgaaaaaaaataatgattaagatttgttttatacaccaagtcttatcctagtgatttgaatgtagagttgaccgttggacaacggggattgaactgtgcaggtctatttatacttgagtttttttcattaaaagttatactgactgtgcctgcctctcctgcctctcctttcacctcctccacctctttcacctttgccactcctaagagagtgagaccggacacctcctcttcctccttctcctcagcctactcagtgtcaagatgatgaagaactttattatgatcctcttccacataataaatagtaaatatgttttctcttccttatgattttcttagtaacatgatatcttctctagctgactttattgtaaaaatacattgtataatgcatataacatacaaaacttgttcatggactgtttatgttatcagtaaggctgctggtcagttggagactattagtagttaattttaggaagtcaaaagttacaggtggaatttcaactctgtgagaatgttggcaccccaacccctgcattgttcaaaggccaactccatttctttgcatcaacttttgtactgctttaaggggcatcagcaaactaacagaaagtcacttcaatgatcaaataaccacattgtttataagtataaagtttatactccttatttatacttataaataatgtggttgtttgactaaatcgctttctgttaggggactgaattgattgataatattgacaaatatacatctggctctagaaacaaaaggctgaatatttaacagcaaatgcaatcagaaaaatgcatatttattaagtacctgctaactgttgggcttcttggagaatataaacaaataaagaatattagctactaccttgggacacccattatgctctaggctctctctctctatatatatatagcataatgtatttaattctcaaaacaagatgatgatgttattactactcatatccccattctatataaagttggcatagaaatcaagcaactgctcctaaattaacatggccaaaaacagaaactcaggcacatattcaaagtgatctgactttagagtccatggtcttataatccctgtatcacctgcctcaaacaaaccttagcttttacagcatatttggagagcaaaaacttatctaaaaagaaaattaaaagtacaagacagtaaaatgatttagataatgactcagtagaaaaaacactgactccgtatcagaagacctgtatcggggctgcggttaagttagttattgaatctccctgcatctcagttttttgatgtggggagaaagcatatcgtgaactctagtgactggagaaggatgtgatagagaaagctgtatatcttggtggggttccgcaggaaacagtgctcagttctgcttctcagggaggtccacctgcagggcagcaatggatgattgtatcttactgcacacctgctgcctcacttcaagccatagtcacatcattggtagcttgacatcgtaggttgtcagctacataggttgcttccagacaggctgtatagagaaaccacttgggaacagtctgtggaaggaaagaaaaagggattaatttacctgactgcccctttgctggtggagctgctttacctgaacctttgacagtcagtggaactgagagaacctaaaagatttcataaggtgtgtctgaaacactgggaatcaaagaaggttttggagggtgaatgggattcagataagcagattggagagtgaaacctctgctagatacgaggagaagagagtttaggcttttgtctggcaggttctgtgaaggagggtactcaaagaaagatttgcaaattataaacatttgtttcctctttgggactcacacaactcttccctgaaaataaatatttgtgttctttccccaaagtcagacaaaataaaagagatgaatataatatttaacagtcctttctataaattttcctgaattttttgatatgtgtttcctcttgttcagaactgattaacaattgtctgtgcctgtgctttgctgaaagtgtgatctacgttacttggtacagtggccagatttaggtttgtttcctctggtccctcgatcatgtctctcttgagacagtacttcattttcacttcatctctgtctcttttgctttttttcatttttactacattgatgatcttataaggactgataaattaggttttcatcaatccactgattaaatctttgaattttgcctggacaggggtatcagatgttctctgtgtttaactacttatgtacaattactttttttttttttttgagacagggtctcacttagtccaccaggctgtagtgcggtggcacgatcttggcctactgcaacctccacctcccgggctcaagtgattctcccgcctcagcctcctgagtagctgaaattacaggcacgaaccaccatacccgctaatttttgtattttcagtacagacggggtttcaccatattggccagtctggtctcgaactcctgacctcaagtgattcacccaccctggcctcccagtgtgctgggattacaggcatgaaccaccatgcccagccatacaattacttataattaaagttactgacataaaatgatggaaaggacaacctttattttgatttaaatgagcaaactttgtaatttacttgtttgtagattgactttttatgtggtttgttaaaataagaaatttttaaaagatagcttattaaatgacagtgacattagcatagatattacacattaactataataattgggtgcaaaaatcattaaaatgcaatattaatatttaatctaaaacagattccggtgggacattttaccacaatatcagtatttgatctaaaatagattccagtgggagattttacctaaaacttaaattgtgaacaggaagaatttatacccacatttctatttcttatctaactcattttaataaaatcaattttacattttccaaatatcagtaaaattagagaatcaattaaaatttcatggtctacagcattatctttagacagaactggaagcaatactccagttaataatctaactataaaaatagcagtattgctctagtttcagcaataagaaattataattgcccgatgacctgattttttttttttttagtttaagaaatttagctatttctaatcctctttgtcctcaaactttgtacaaagttatggttgataccaaacaaaaaatctggagcatttcttattttccattcacaccttggaatctacatgtacagatctgttttctgtatgtaaataaattaaggattgggtagatattagatttgttatagtgacaaaaaaggatgtgaatgttaatctctattgtattgaaatagtttagttaattatgaacaggtattagttcatacaatgcaggtgctatcgtttggatatggattgtccccactaaaactcatattgaaattttatcttccatgtggcagttttgggaggtggagcctgtttgggccttggggacagatccctccttaatgcattaatgccctccctctgggttgagtgagttcttgctctcttgagaatagatttgttcctgctctcttgggaatagatttgttcctgctagacagcgttttaaaagagtctggcttcctcagtctctctctcttacttcccctcttgccatgtgacctctttgtacacaccagtttctttctgctttttgccatgagttgaagcagcctgagaacctcaccagctgcagctgcccaaccgtgagccttccagccaccagaatcatgagccaaataaaccatttttctttataaattactgagtctcagggagtctgatagagcaacactaaatggactaagacaccggaaaaacgagggtaaaatattccgcattagtctcgatgtagttccttaaagtaacacaaaatctgatgcacatgctgcgggtaaagaagccctccaagtggatgtgatgtgatccttctccttcctggtgttctgttcataatgacccatcaaatagaaggtaataggtacaaagtcaggcaaatgggtaggacatctgttacttttgttttctgtgtaggactacctaccttccctgacagtgggaagattaaaatgtcgcatgttcagctgctctttaaaaatctgccttcaacttatcagttaaacttgaaatatttatacgttattggcttagttttgtacatgctctatattctaaagccactataaaatctacccagtgtcacttaactgtcagacacagcttgttcttctgaattttgactcataatgcattagaggaattgcatggtacaatacaaacgctattaatttttctattagttgaatagtcatactatatctacacatataaatgcctttaaattctaattttacagaacattttaaatgcaaatgctataatcagtgatttaattatctaaacagaatattgaggtttggtaatttggggaaaatttttctatttaattgtgtgaacagttaaaatattctaattaagtggatattagagaataaagacatgagagaaatggcgttatcactaaacttattgaggaaataaggaggaaacataccaacaccgtaagtcaaatgtcagaatttggtgatgccaaaaccaaggagagtctggggactgataaccagagcttagttaaagccacataacatgcttctgagtccagccataggcaagaattttaagaagacattaggcatgagcaacaaacagagtgagaatcagaaatagtaactggagtcttggaagagagaaaatgtcaaatattagtatcagctaagaataagaattagattaatatctagcatttaattaacttttacagcaatcacattattattcctaaaataaaaattagagcattgtagatcaaaaagattaagtagctaagaacacagacaagaggttgcatgaattcacggaagggttttaagcagtgaaacttaatgctgaggacagttttgctggcattagactcctttcgaaaagcccagatatagttctcaggcctctttgttcaaaatgcagtgtgataaaacaatttcttctttccttgtttattcctcatggagttatagatatgcctacattcttaggcaggatgagaaatcagttcattgaaagcctacctattgactgctaatggagtccggtacagtgctaagcattttgaacgatttatatcaattaatcctcatgactctgtgacacaggtaatattagtatttctatgctatagacaaaaaaaaaaaaaaaaaaaggacttgggccattagttaacttggcccagtaacacaaaaatcaaatgttgggattcagattcgatcataagtagtttgtcctcaaagcccaagtttttatccactctgctaattacaccataattgcacaggatggcacaagaaaagaggaaaaacaatccttagtattagcatgaccattattagtacctcacgtgttaagatatctatggttaaaactctcttccagagcaggggaacggatattaagcctgtctttaagatgccacataaactaagaatcttgagaaaatgcacatacatgtacataaatgttgcatcacattttagagagttattagactctgaaggtcagattttaaatcttcaatattaaaggtcattctatgcaaataaaattatacatacatatatacacacatatgtacatgcacatatagcttaaatttatgctgcttttagtaactctgctattagtaaactatattttggaagtgaactaaaacggaacttgctaaaataagtgttttctggtctgaagaaagatatggttagaatctgagccctccgccatctagtgggtaccttgagtcacttattgcttctctttatgcctgtttcctgatttataaaataggggtgcaaacaatacctagcccagaagtttgtcttaagcattcgatgagttgacatttattacacacttactagagggcctgtgcagaaccagctccctataatatgtcatagcctccataaatttataacaatgagttttaatatggaaaagagcacctttaacatctaacactttttattttcgcatccccattgtaacacctaacataccgtttcaaacacagtagacatttagaaagtatttgctgattaagaaggaaaaaatatcttaacattgctccagtttcaatcatgtatttaaactgctgttgaatttttggaagtctcccatcatttcatggtgctcacaaatttccacacatatttttatgactcattatatattagtagtataacttcaaccttaaatcctcatataataatatacatataatatgtaatcatggtattaccttctgcttttttccctgtaactatatgctttgtactaatcattcatgcaaatctctacttttattatcagaatatttttcctgctttttacagatagccaagcttatctattcttctggctgtgtgtgtttttttttaaatgccagagaagcatatatgcaaatgaaggtagaatattttaatgtcgttcattgatatgttattaccaatccttgagataaagtatcttttttgcatattgtaaaagaagaatagaaaaaaatcagtctctctctatgaatgttaccaaaaccatcaattaaaatgttccagttaattcttacatgtgcattttgccttatctgaaaatgccaattgctcagtgccatttgatcttcactgagtgttccttcttttggcttttttaaaatcatttctgctaagacgtgtttagatatgttaaaaaactggaaattcttttatagtttttgtttaattttttcttaataaaattaagacaatgatcaggttgtttaattctgtttatattgtcatgagattaatttttttaccatattttaatatctcattaattaaaggagaaatctaagtgatacattcaaatatctgtactgtttgttatgccataaaatctttagttatgattaaatctttgaatgtctatatcctagatcaacagagagaacttttaaagtttattttaataaatcataaatcaatttggttactagtttggctatttttataaaacatttaaaatgtatgttattattcttttataaattattttcataagatcataagtaagatgtagtcttactttgaagtaaagaaaaaattttcagattaaagtttaatagtaaatagatcagtacttctcaaacttaattgtacatgctagtcactgtatgtactacagtgcatagggtgtcttgtgaaaatgcagtttgattcattaggtctgggataagaccacattttgaggagtaaacacatggaatatctttagggcatctagtgatgactctgctgaaacttcttggaccatataattaacatgcagaattattttactaaacgtaaggcaaagtaatggttctggaaaaagcctgagtactaggataattagatataacttcattctctcctacttagctagttagtctagggcagattttaacttttcttagtttgctctctcagtaccttaaacagtagtaagtacttaagaaatattgatgtgttgattaggatttcatagaaataatcagcctcaatgatggcaatttcaactcgatttagcaaacattgaagacctactgagcctgaaaggggtagtatactcagggtaccactgcacacttgaattattcctttctggaagttatgtgaaaaattatatgaaatatagacattggcattgacttagtggctggaaaactttcttggtggcctttagatatcagcagacctatcatttctgtcatgtgttttttattggccaatagttcaggtttctgtgttgctcaatattcctagttattcctaaatgttaggggtagatgcacccaaaagcttctcacatttacctcttataattcaaatcagataaagaattatatttggcctgagtttggtgcataatagaatagttttgttactctgtcaataatggcataattcaattgttaatgtaaattgggatctagtacactagacatctcagaaattaaataagacattaaatgtctgctatgggagaatactctaagataatgactttaaaaaatctgattatatgccatggaacattctaaattcagatgtggctccttccactcactgataacagaatttggaatctgttattaataataaatccaacgtcagaagctggcttcctgcaaattgtcgttggctggtattctctgtgtttcaaattgagtaattaattatattagctacattttgtgttatacatatattagaaacaacgatatgtttgcaatgcagcaaatactattttgttattgttaatggatatggcatgcatgccaattgtctagcctttcttgcctttaaaactgttgttaaaaattagtatgttgtcacacattttgatacaatcttgactacctactaatgtttttaaaaggttggtaactacatttgtaagatataaaatatggtagcctaaaattggacgaatatttttgtttttacattttttcagtctcctcttattacatttgatggtgaatttttcagggaacaaatctcagggttttttttttttttctgatttcagtggcattgtgctttagactatgctagagtttcagagaaaatttaatatggattattttatgaaagatgggaacttctttggcagatgaacctcctttttgtactctctcttttaggaatattaatattaattcataattaacccatgaagccttattctttctacttcttccttcctctttttgatgggatagccacataataagcatggccctctggccatggaaccatatagatagtttcttcaactcatcagcactggcaaatactgtcgtggttcaacaccccattctgtggccacagaaaatgctgacagaccacgtttaaaaagacacagactaattgtgaaaattagcttgcatttctcctaagccaagttcaatttttgccagtgagttgactttggaaaatacagagtaaatagttgcatttcttattcatcaagcaacttgacattatactaccaagcactgcttttatttttaatatgctttgaaatcgacaatgataattcaagttatagaatgataattatcaatatcgtgtcagaataaaagcaaatgccatttactgtaatatgtagactcagagatagctcacaatgaagaacagaataataggaaaggaaaaaattcatattatcacatacacccatgattttagtaaagttttaaaataaaaataagcacttatgatttaccagtgttgaagagccttacttctattaatgatgtattttctttttagaatatttctcttggaggatggcagcctcaagatatataatattaccaggtcagatgctggatcatatacatgcatagccacaaatcagtttggcactgcaaagaacactggcagcctcattgtaaaaggtatcatattatcttcatttgtgcttgatgaacattgtaaatatgcaggcatattatgacttgtgttatggtgtcaaacctgtaccatattgtgtatgtaaaattgttgatttcacaagttatctaagagatccattcccgtactcattaataacatgcacactttgccagtgggataccatggtagatgtgaatactttggcaattgaaaatgctgtcagagtgtcattcgagttaaaacctacacctaaattatttggctttttacataagccttaatgttaggggccatggacgttttgataaagtcactggataacatttttttggtcaaatatctttcagaatctttatttttatttgaaatatttacatgtatataaggctaccaaatacataactggctaatttgtttatataactccaggtacaaaactaatgaaatgcagggtcacaacctttagtaagcagttcttttcaaagagaaaaaattaaaatctgtgtgaatcattattatattttcatcacagtaagcagataaactcatacaatttatagagataaattctatactttacttttaagatttctaaatcagtatcaatccaaatgttcctacatttatcaccaaggacataattaatattagaagtatctattccctttccttgctgctttattttgttgaatctcagctcataaaactagtgtgtttactggaagctgtatcacttctatcatttcattgcctcctggatgataaaaatggctctcttgataaagcagtttaagcagctaattaagcccaaatgattaaaatcagcatttggtgctttctcatcttttccattaaaataaatatattcaataaaaagtagttagctgctacacttcaaccatcctttaaaatatctcaaggaaaataaacacccacctttgagcctggaagatatttctgccaacttgtctcaagcgtattacattatgacgacaattgtctgaagtattctggggaaatgtgactgataaaacttggtgtgtcaaaatccaaccagtatggcatattttgaaaaacttctcttccttaagattgtattgtcatcaatttttaagacagagatggacttaagtgtttcaagatagatgttatggctatatttaggaacagactatttctccagcaaatttttggcaatactcagacactgaaaaatgtgaatgctttatatttggaaaagtaacaagttcattaacgggaaaaaaagatatttattatatcatttcaaattaagaaggtgtaggtagtatgcaaattttattacagcagaagattaaaatgtggtgaaggataaaaaggcattttgcagttaaatcttctaggtatggaaaaatccagagggcattaaaacgtgaaatagaagggatagaaaacatcagcagtagcaatgtagtttttaaaagaaagtttctttagaatactggtgatctgggaggagggccaatggttttgctgttaaaatacaatgatggggattccttcactctggaggataagaaaaacacaagttaatggtagattgaactgaatgaataggcactcttcctccagtgtttcttaaactttgacatcataatattcacagtccactaataactgatgaaagaaaaataaaaggtgacggctaacaaaaatactaactgagaaactcggaagccactggactgcattctggatgtaacatttgcatatttcagatgtgtaatatagccatgttttctgcaagttaggttcctagtacttatgatagaaataagtttatctacactttcaagtattccataaatctaaccataatccccagctactctgctctttccataggtaaaacaataattaatcaagatagctcagttaacaaaaaaaaaaaaaaaagcctgacttacatttttgtttgttcatttctagtgctctttgctgaggttgttgaaacaaaattatcccactaggcattccttgttaccttaatcagttccactctttcttcttctgtaccactttttatcttcttacgaactgtataactgacttacttattatggttttttttcttgtcttttcttcccttctagaacagaagcataaagagggcagggatttttgttttaatcaatgatgaatcataaatcctagaacattgctgggaactgtatgtgcccagtaaatatttattgatttaataaaatgttattatcttatgcagcttagttcatagggatatttttcatactggcttccttgctctaaaatcggacagttttcaatttttcagggtctgagcttcttaggacactttgcaaaaaaagaacatcaaagaaaaaaaccaacctttttacatgcattcactttctaattgtagggtttgtaatcttttatttctgacagacatcgatcacctcactctcctaagggggtacaagcctgaacctacatcgaaatccaaaaattcgtgaagagaattcattgttttggtatttctagcacagtacaggagaataactcacatatacaaaaagggtacatgataacataactgatgtcactatgcctgattatcaagttactttcatgcatttacacctaataatgggaaggaaattttgctatattttaaccttcatgacacatccacatcccattttaagtggactttggggtcttttgcttctttgtcattaacaagaactatcctatgcaatataaacatgtacatacttaaccacacaaatacatataaataaaataaacacaaaatgtgtgtacagtatgaagaaaaacagccttagaaagttgctttattatttatctgtaatgtttaatctttatgaaattgtgtgactgtcatacaagcacagttctaagtctattattaccatgtcctcttaactagactgttatctctaattccctttcatataaaaatgttgaagacatcactgccaaggaattattattttacaacctacaaatttgaagcctagcataggaaaaaattataatagtgtacatcaattcaaccattttcttgactattgggtgtatagtcatctggttgtttcttaagatggcttaatagttgtgtatatatgtatgtgtattttctcatcagtaatattcatatgattgctgttacagaatcaaatataattttgtttctcaagccaaaatcagtgtatagtgaccttaagagtaatagagtgttaaggagcaaatgagaaatctcagtaaagctgataaaacaatcatctccctttgaatttacttatcagcctctgtcatgcaagaaatgttgttgttagataacatggaaaagataatagttacaagagtgagatattttccagcttagtttttagctgatatggcttatctctgttaagaggattctgaagttatctgcactgtatgttggaaatttctatttcactaatacagcaggataaggcgattttccattcaaacattgtgagtgcaattagcagcagcttttccagcgcctcagaagatgcccagtataatttaaggacatgtttcagaggcacaaacaaggaatcaagaggaaagagagtttacgtgttttcattttggaggactgagattaaaattacaatgtgtacatacactaagaggtatatgaaaatcacataaaaggagaaattatttgatctggcatttggaaaattattaaaaagcagagtaacagcaggctataaaaatgatcttgtttgcaggcaacatttgtttttgtttccccactggagaagttttggatgttcaattataggcctcattgcttcagtgttattttcaactgaaatgtcggaacttggaaaagcatatctaatgtgcaaattaagtttattgctgctcatttagttgtttattcttcgtgatagaagtctttattataccagcattacagagtggcctatccattttctccagcagaatgatacgggtctaagtttactaagagaaatgcccaagatatgtagataattggaggcttcgtggctctagaaggcagtttgaaggatttgaggtatcaagctcagctttattgacaagcccagtttgattgagcagaccaaaagtacactttcagagaaatgacaagatgtattggaatacatttgtcatatcgtagtacttgaaaacaccagagaagtctccagcagcactaaaatctccccaaaaatgttcagttccacacgccactttcctacacagaatgactgaaagcatttcaacagaatgaacatttgatttaaaaattagtgatggtaaaaattactttcaaggtgagaaaatatataaggagttattatactggtcagatgaaaaaatttcctgttccaatattgaaagtgatgctgcgtgaattattgaaacgtgaatactacaatctcttcaagtaaaaatgtaaaaacaagcaaaaacacgcatcaatttaagcaagcccactaagatcaatgttgtcttggtcttcatgaaaatttagttcacaatcttttttaaaatgcagcatatgtcactcagattaaattaccacatatgacatatagctgtgttttttcttaatgtatattttacaaaatataatgtaaaggatagatgttaatacagcataggttttaccacttttttcaagatatttttactgcatagtttaaacctattattggtcaaagttttgtttaattttgataaaaatagggggtgtatagctagtggtttatgccagttgaaggagaccagacacagaagagtatagaactcttactaaagtggtcaatacacagcctctggaattatattaacctgccattactaactaacgtggaacttgacgacttagtttttatggttattcatcttgttttctttattattattattcattactatttgttaaatacattctctgtcctaggcaccatgataggttctttgtgtatatcatctcatttcaactttcagagtaatgctttgaagcagatattattatctcaattttatacaagggagattgaggaataggttgctaaaaccacttgcccaaggtccctgcattagtaagtggcagaactttagctttccttcttttccatcttccaacaaatgtacatattaaaaaatgcatgagacaattttacatcgcattgttcaaagtctagcaggaataaaagtatagtaacatgcagatattagtacttcctcctaaataccgcagccttcattcattagagtgcaattttatatgtacatttttatatgtaaaaattcatttgagtgcaatatttatgtgcatttacattttattatatgtaaattttacataaatgcacatttatgtaaatgcacatttatgtaaaatttacatataataaaatacataaattttaatgtatattcactaaattttgaaaatggcatttgtaacccaaaacacacaagatatagaacatcattatcatccaacatctagaactttttttatgtcacttaatccttgttcctactacactcctagaagcagctactgtaataattttctcaccatagatttcattcaaatgctaccttatattgtgtattcttttgtgtttggtgtcattcatacagtataaaccactagctatccatctcctatttttattaaaataaaaaaacacttcaaccgatacgtttattctgcaggtaactaaatgcatatatacatgtatgtatatataaatctcaaactattaagtctttttgatctttagtttcctgcccaaacctgcaaacacttgtgctcacttgtttcttgagtttttagttaagaattggaaatttagtaaatttaccttgactctattctgaccgtaaaagaagcaattaggctactcttcttcttaggcattctctctctaaattagctcagtggtcacttatgctctagggccattttttttttttttaggaataaactatgtcattaagatggaaaagacttccccagaagcaagctatgttttcagtctctggatcctgaatactcaagcaagtagttaccaaatgctttcaagtccaaaagaggaatggggttgaagggcgtggaaggggaaaaaataatcacatgaatcaaacttagccttatcctctttttttgggttttattttctcattttgactccctcatcccaacatgaaacgttcagaagaaaatatcatttgtattaacacctattgacaggcacaataaaaatttctactttcatcttctacaaaactacaggctgggtgtggtggctcatgcctgtaatcccagcactttgaaaggctgaggtgggaggattgcttgagaccaggagttcaagaccatggcaagaccttatctctactaaaaataagaaaaattagtaaggcatggtggcatatgcctgttgtcccagctacttgggaagctgagatggaaggatcacttgagctcagaaattcaagattgcagtgagctatgatcatgccactgtactccagcctaggcaatacagcaagatcctgtcccccaaaacaaaaaaggtacagaagtcttctattgtataattcgctacagccagcatgaagttactattggagaatagtctgaatgaacactatctatttataagaaatataaatatgatgccataaatatgtagtcactgcctattatgtactaatagctttgaaacagagtagttgtcatatctaatttattacacagaatctacagagcatgttctgtttaaatagatgtcaggccctgctttgactatttgttaatataaaagatctgtgtttacattttacaatattatttgctagggaaatagggtaacattgcatgttttctcatttagacatctcaacttttagacaatgctttctctagactggtttttcacttgtttcttttaatctggggttctcagtagtcttttaatatttattccaaaccatttaaatgttgaagtagtaaataaatgagtaatggtacctgaaggtaaattggaatatattgaccatgattactttatgcattgaaattaaattttactctgtggtgaaatatgataaatgctgcatgtagattttaatctgtagatacacgtgtgagcagataatcatgcacttgtctaagaggatataaaacattttagacttacggattgtatttgcaaaaaggaaaagcttattaactaaagactaaaaacaactcctttatttctggcttgctacacctggagaaatgaagaccccatcacaccgatttccttgttcgtttgcctgcttttctctgtccaaggtttatttcagagtattagctttgattttcctgtgtttgctttcccttcttttgttcgtttgcttagttttctacggacttgccaacaattcatttcccaaatctatctcaatagtctcccttcaatatcagcctgccctgtgtgttgacgctccattgcctaactccatgcctttctgtttcttaacatactccttcactttggttgattaaaccttccagtggatttttgagaaataatccaagagatatacaatttttttaatctttcatgtttgaaagtgtctttattctgtgtttacattttattagtggtttagtttgaagtagaattctagactggaagccattatttctcagaaattttgagccgttactgtgctctgaaagcctaaactttgttgatttctaatctgttgtttgtgacaccttttccctcttgttctctagaattctgttttctccaatgtttgacaatttcaagataatgtgtcatgttttaaatctgttatcaactattacactgggcatttggcaggctttgtcgctgtagaaactcatacttcttggtcctaaaatatctttctgaataatttaatattttattccattccttctcctaaaagccctgttatttaaatgttatattttctaaactggtagtctagtttatggttatattcatctatatgtatgtatataaacatacatgtatattctatacacattctatatattctatatacatgtatgtatacacgtattttttttctttttttctctcttagtcttcattttatagctgtacctaccctttgtatctcatccagttttatgtttctaaatattatctataagttaattcccaaactcaaatcaagctaattccagctcagatatttctcttcaatccccaaattcaacagcctattttatcatcttcacttacaaatttactatatcctaaccttgaactcctgattcttactccccaaacttgtttctactgtcttctttctccactatattaatgacagtctgcactgacagttgtttagaccaaatccttgagattatttttaatttttttctttcatttaaaccccatattcaattgccccaaaatggtttcagcttcaaggtacatacagaatctaaccacttctctccgcttcaatgaccaaactttaagccatgccatctctttcccagagtattgctatagcacagaatggctcaaccaggatgattttgtctcccaggggacattggcaaaatatgcaaatatttttggttttcacaactgaagggtctcacccgaccccatccgctgccttgcaccacacacacgctaaacccacaccttgacacacacaagaaaaaattatttggaccaactgttgataaatgttaagcttggaaacccagtaatagcttcaaaagcatttgtcctaattctttgtttcccttctagaagctacaatgttgctattaaaatataggcaagattttgtcactcttaggactgaaatcttctaatggttcttcagtttggttttgttccttttgttcagcattcctactgatgtataatttggaataaggtaagggtgcaatactaattaaatggttttcaatagatgattgaataaacaattagtacatttctatgttaggaatctctacttctgtccaaaattatacttatttctttctctaactgacagcaattatcatactcttcaagctattatctaaaaacctactgataaatggcctaaatatttttaccaatacacttaatctattatgaaacattaataataaaggagaataatctgtcttaactagttgaagtaagcttatcacaccaacctcccactgatgttcaccacaaatattgttaaaatatttaaaaatgaacaaaaacagttttttcaaggaattgtgacaacagccaaggtgtttgcaacatgaggtgcagaagcctggagaaaacaaaagcacagagaggttagccccacattccctgctgtttttcttctcagaaatttgtcaattcctaagcagtataaatcaggaatgaagaaaccaatcagaaagtagaaaacatctcagcagaaattttggtagacttacagtgaaagggagacacaaatagaggttcagaataaaccaaatagaatgaagtctgctaagcagctcaaccttgagtcaggacatctgaaggactatgtcctagtaagaaacaaaacaaaataaaataaaattgaccaggacttaaaatgactaagatccagactcaattcatatcagtttcggaccagcttctggctctttttataattgcatgcttgaaaaagtaaatcttcccggtacaaatataacactataaaatcacttacatttttgatccacaacgtctagcattcaataaaacgttactaggaataactggagctatgaccaaatgaccaaaactcagagaaaaaaacagataatagtaacaggtcacagcgatagaaatattgaagttctcagacaagggctttaaaataattttgattaatatattaaaagatagatgacaagatggagaatttcagaaaggaaatggcatctgttaaaactccaatggaagttctagaactgacaattgcaagtgctaacattaagaacagaatacattgatttaacacaaggatagctataacagaaagaggattagtaaaggggaggatgcgtgaatagaaaatgtctaaactgcagcatggagagagaataaaatgggaaagacagaaagtatcataaggaaaatatggaatatagtgaataacttttaacatatataaaattgttccaaaaggagcagagaggacagaaagaaaattaggcatgagcaatatttgaagaaatatttgccagatactttttaaaaactgaaaatgataagtatccaattcaagaaattatgtgagtcccaattcagacaaatgcaaaggaaagcctagctaagcacacagtagcaaaactaaagggaaaaaaatcagataaaaaagatacattaagtcaaaaaaacaagactagcagttgatataacaaagaaaaaaggaacccagaagaaaatgaaatgacatttttaatgcgctaaagacaataccaataagaattctatccctatttaaaaatccccccaaataaagacaaaataaagatgctttcaaacaaacaaaacctgagagaatccccatcacttaaaaaaataaaaatttcatatatttaaggggtacaacaccttaaatgtttgacctacttatgtgcaataaagtggttactatactaagcaacttaacttatgcatttcctcacatagctgcctcttttgtgtgtgtctctgcgatgagaacacctgaaatctaaactcttggaaagttctcagtatacaatacagtatttatgatacagtatacagatatatatatacacagataactgtatcattgtgctgtgcattctatctctagacttatttgttctacataacaataactttgtacctttgaccagaatcttcccattttcctcacttttgtgctctcagtgaccaccattctagtatctatttgtatgtatttgactttttttgatgccacctataatttagatcatacaggatttttctttctgtgcctggcttacttcacctagcatagttcttccagattcttctatattgttgcaaatggtagtatctccttcttttatagagctgaataatatcccattgtgtacacatgtcacaatttatttatccattcatccactgatggacactaggtgatctccatatcttaactatcatgaatactgctgcaatgaacatgtgagtgcagatattcctttgactattgattttattttctttggatatatatccacaagagggattgctgggttgtatggtatctctatttttaattttagggaaccctccatactgttttccataatagctgtaccaataaatattcccaccaacagtatgtaagagctccctttttccacaccctagataacagtcatctcttgtctttttgacagtagccatcctaacaggtgtgatgtgacatctcatcatggtttagatttgcatttgcctgatgatttatgatgttgagcacattttcacatacctattggctatttgtatgtcttctttggaaaactgtctatttaattcagtttctacagttggaaggaaaaccatgtatatagaggaagtaataaagagcaacggaaaggactaatatcttaatatgtagcgtaatttgagattctgaggaattcattagaaaaaagaccaatttttaaaggtatttatttctagacattgcaagttaactagcaagagaaaatatgagagaattttgtcacctatttgaagtgctatttatatactagtttacttaatattgatttcttagcaacattttctataatgtcatagataaataaaggaagagccccatgtttgtacaggaggaagagtttgataatttttcttacacttttgtctatcctttgagaggagtttataacttcagcaacaccttagcagttattattctgaaaagtgacattgataagggtttcaactgagttgaaggaaaaaaaaaacaaaacaaacaaacaatattttctgtatggtcaggaaagatgaattatacatttaactgccatccccttgcttctaaaaatgtagttagagatcatgaaaggtaagagtgtatttatttggccattgatatagagaagcagtcccatttttaagtgtttaaagaaatcacaataaatggtcctgacataagttttgatgtaattagtcttcatgtctgctggggtccccgtaactaaaatgcattctggaaacatcattggctattatgaaatgtgaatttcagtaaggctattcatcaaaagcgtcacatcatatattctattactcttcttaagaataggactgctagatgaagctgtttttatataataacttttagctcactgacagagattgaaaatggtaaatattaaaattctgtggttttacaaactcttcatgaatgattgtcatttatatttagggcaatcttcaaaaagtggctagttcttatgatttcagaaagtgaatgagaaatgttcctccctattctgtatgtaaatattcactctcccccaacatgttcttccttttattattgaaaattgcaagcacacacagaagtagaggtgatagtataagaaactctcatgtatacatcactcagagtcaatagaaggcaactcttatcaatcttgtttaatctatacactaacctacttccacaactccaattatctggaggcaaatcccaaacctcaataatttcacccacaaatatatcagaatgtatctttaaaagattaaggaatcttctttttaatataacataaaaccagttttcttatggtaacaaattattatttctaaattatttagaattcaaatttccataatagtctcataaatatgtaagcttatatgtgtatgcatgttaaataaaaacacatatattttatatgtgaatatatgacatatttatgttgtgtttaatcctcttcaatcatgaaagcaacatttccggacattgtttctcagaagtccttatataccaagatatacttccatttctatgtacgaacactgtatgtatcaagaaatgttacatggattaaaaatattccatactctaccaaatgtaggaaaccttgaattaaataaaattttaaaaataaataaacttacttttaatgacaaaaaccgcaattacttttgcaccaatccaataaataagaattcctttcatttaggaattctcagagcttttaatatgttaaaatgtttaagaaatgataaaagtggagataatatacagaattaattacagttaaccttgggactccatctttctttcttgaagtattactaaccaggaacacttactggatataaatttttcctaaatccacagtattagagaatttcagacaatatattttatatttgaatgtttcttaaatagaaatttcaggttcaagttttaaaaactaagggaacatttgtcaaagcatggtctctggaataactatatcaaaatcaagtggagaagcctgatgaaaggacgtattcaaggtctagacacactgaatcagtatttctggtgcaatatgaggagctcacgttttgaatgcatgctcaggaaactcttacacatgttaaaattttaaaaccactagatcagacttcctacaaatggctaaggaatatgcaagaagaatagcatgacatgaaatgaaagcgaataagtaaccctttgttttgtttgaaaagacttaaagaatctcaaatttttacaaacgatagagtctagcgtagtcaacaactttcctcctttttaatttgttataattcaggccctaaagatctcaccgatccataaataccgagaagtgtttcagtgtcgatgagcctcgagtaactgcagctactctactggcacatatgcactcttaggaagtgagtagaatataggatctgagtggtttgaagaaatctctcagatgcttgagtttcttaagaatttaaggtgtatttgatgaggaattaatggactgaagcccctcttctttccacaaagtagcatgaacagttttgcatatttcaactgtgcaagcaccaatcttccagtccctgcaagtgtgatttttgtctctgtggggtactcatgttagtgctggggctgaggctgcacatggctgtagaatgaactctttgagagagcaatcaatggcctcatggctattagacagccatctgcacaggatgaggacaggtctgcctgtggtgggtggagaggatacagcagttaaaatgttcttgtccaagcacctcttcacccacacaggaggctactcccaggaggaactatgcatcccctttttctggataataagcatgcttatgtagagctacttcttttcaaatacagtctatttttcacactgcagataatggtatgtcatcatatcactcctctgcttcatacttccaaagtttttaactttttcagcaaaaaatgcatttctaaaatttttaattgatgaatagtaattttgttttatgtatttgtgggatataatgtgatattttgatacatgtttacattgtgtaatgattaaatcaagctagttaacacagccatcacttcacatcctatcatttttttgtgatgagaattaaaatcctcattgggtaattttgaaatatgtattacattaactgtagtcaccatgctgtgccgtaggtctctaaaacttattcctcccatctgaaacttagtacgctgtgaacaacatctcctcattccccatccctccctcccaccagcctctgataaccaccatgctactctttactatgctactctctactatgtaagaatatatttcttagcgtgacatccagagctggtttcatggacatacaatccagtcacacagagccctgtgctgaggaagtccccatgtttgaaatattctgctgtgactgtcttgaaattcttaatcattttacctctcaatttgtgttttgtacatactaaacacaaattgagaggtaaaatgattaagaatttatttgtaacctgtgtgtgcatgagctgctgctgctgctgcttcaccatacccacatgcatatgtggcagctcctgcacacacaagttcaggcttaaagacccagcagtcggcatgcgtgcacagcagttggtgtggtgtgcaggtgtgcacatgcttgcctgggtagtcatagtcctggagtcctgagggcatgggcacatcagaacctgggcctcttaaagggatggagataatggtggtagcagccatagaaacggcagtggatggcagcaaaggctgcaggaagcgacttcaaaagtagtcaacaggaggatccaaggtgggaggccagcttgcccatacctcgccggaggctgtctctgtgggatttgcaaaaatattaactctccatcctgagcaccagaacagaaattgttagtgctcaggcaataaactttgtcaataaattattgcaaaaggaaggcatacacatggacattgcaataaaatccacaggcttagaaatagaaattaaacttaaagattattccagtcaatgataagaacattatttttatatgatgctttggggaaaccaataattgatgagttttgctttgtaattgaagatacaaaaatggaatggtaaaacaggcattttgaactatacgaaaatcatgaagtccctttcaatttcttgtacaacctccacaagttacagtgtatgtcagaggaaacattaagattccattgcatacatttatatttaaaattaaattcaggctttcataaaacagatttgtataaagagttaaatctttttagaaaaatattggtgaagagaatcatcagctctagatatttcaacatttatatttcagtgtataattcatcagaaacttctgaatgttactacagtctataaaacagtcttaatggtttcataaaagttgcatcagagaaagatactttgcaaaataaaaacttatcaaaaagtatttgtgatcttgcatttgccaggagtgactgatgtcactgaagttatatcaattgaaaatgaagttgctaaaaatataaattctgttgatctagtaaacaattgaccagaaaagtaatggagaaaattatataatcaatcaagatataacctcaataaagtattatttattatatcgtataaaattatgacaccaaaatcatgtattttgtaatttgtaagtgtatgtcatcactcatctatgaatcataccctaattttattttataagttataaattattttaaagcgaaaagctttgtatttaatacctttaatgacactttttcctctttttcaaaaaagacaccccacgctttcattttgcacttggacccacaaattatgtagctgaccttaatgacgtttgtggcttatatcctgaccaaggctatcctccagcttcatcttcttcgctttcactcctctattactctgtgtttaatcctttcattttcagcacatggttgcacggagtctgccgatcacagttctttttcacacagtttctctgtgaacgctcttgcctgcgcaggaaatctagtttcctctctctacctgctacctttacccagctcactactacttgccttttacttctcagcgaaaacagttctttctccataaactgatcccctcaggatttgccaaacatttcaaacaagtcacttctagtatatggtgcttatcacacattactgtatagtaactaatatgattggattcatgctagcttccttttgtagacgttcatctctgtgaagcaacactccttatctttttgacttgctgcgggtttttttttttttttttcctcattttcttccctatcttgactccagtacttagcataggattggacatacattacatgctcaataaatattagttacaaatgagttaactagtgaaaaatgtaaccattataagtgatgaaataaacatttcttattcataaagctttcatcattattactgtacaacaatgagctatgtagatagggaataatttgtccaactttgccactatgtggtgtcataaatggaaggacttgctgtcatttttaatgtctgaaaattactttaattgcatgatctaaaactttaaatctgggcagttttgctctgtcaacacatccagttagccaacttatcctcctataaatgtaaataagacatttgtgattttttttttcagagtaactacaaaaggaaaatattttctctagttctaaaaaattttcttggatccctggatatcttttttttttttaaggttcaatcacactttattcatttatgtttttaagttttttaggtcatacatttcctcaattcttcatacattttatttcagtcaattaaattacaaaacaatacaagctttttaaattcaaagtctaaagtatataaagtaataatgattccctctctttctcttacccttcaacttcaccttgctaatgtaacaaacttaataatttaatgtgtatctttttttattttctactagtttattctttgattagaatccaataagatccaaaaaaaagaaagaacccaataagatccatacatggcagttggccaagtttttttttaatctattggtttctcctccatctctcttctttttctttctttttttttaattttattattagtatactttaagttttagggtacatgtgcacaacgtgggaattgaacaatgagaacacatggacacaggaaggggaacatcacacaccggggactattgtggagtgtggggagcggggagggatagcattaagagatatacctaatgctaaatgacgagttaatgggtgcagcacaccaacatggatccctggatatcttttacccttattttggttgcaaatctgtgaagaagccttggaattaagaatgggcatagtccacaaaatcattctttaaatttctccttagacaaaattagaatataaagtgcatgcatctggttaggtgcagtgattaacgcctgtaatctcagcacttgggaggccaagtcaggtggatcacttgatgtcaggagtttgagaccacctggccaacatggtgaaactctgtctctgcaaaaatacaaaaatttacctggcatggtggtgcgtgcctgtaatgccagctactcaggaggctgaggcaggagaatctcttgaatctgggaggcggaggttgcaatgagctaagatggcatcactgcactctagcctgggtgacggagcgagactccatctcaaaaataataataacaaaagtaaaaaaaagtacatgcatctaatataaatatggaaagtattttaaataataaaaaatgaagacatatttgatacagaatgagtttgattttctctattatattcatattcagaactatagcgtgtgtttttattttttcatggctcttttgtcagtatgtaccttaaaaccccaaattattacttcctactttctacttctaaatatttatgaatgaagaaaacaattaaaaatgtttaaatggtcaaataataactaaacattctattggtaaaatgcagttacacattaatcattgtgaacatataaatgcaatctcaatgttagtttggtttcttgagcagaatgaagaaggtagaagaaagtgaagattttagtccatttcttagagagctaaactttatcttataaattacccatggagaaatagattctccatgggtcatttcactatttttaaacttcttcatgtataattttttttttacaataacttgcctaaaacctttattcttaaatgtaaatctttcaaaacaatttattcttggtaagatggtacatatctaaatccaaatatttgtccagggccccttcatagatattgagttgctctttgatgaattctcaactctctggaatcagaactttattataaacgaagtagtcataacgatctacattgtgagtctcttttaatctgaacaaatataggactctcaagtacaactggcacaccctgggattgtcctttgaaattttggtcaatgaaatgctaggtcttgtaaaagaaagattgacatagagaacatttctagagggaaggtttttatgatggatgcataattttaacactggaaaatctgaattattaaagggaaaacttccatcttccctattcatgttgcatctttaacaaaaagaaaattagagctacgtcaaagacagaataattatgttgcattcaccctcttaaatataaacgtatgtctaaatctctatagaaactatggtggtcataatcttagaaacatggtttgtctcatggtatatgaagttaacagagagcatttagagctgttaccagtgtgtcaattgtaatgttatgactaaaatgttagaataaaatataacaaaaacaatgcagtgcatcctgtatatatggaatgccattttttgaggtctacagttttctgtaaactattttcatataaggtgtgaatatatttttaattttagtataagtaataagctacaataataaatacaagacatttaaaaacaggcaaaggaatatttcatactggacattgtagaactccaggttgcatttatataatttcaaatgaatgataaagtattcagaaatatgtattttataaccataggctagcatttcataagctttaaaaaataattttttttctcaacagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagtaagttactgaaattgttaagtgcttaataaaatgaatcaagtcttttacatgaatcaccatttttcatagttactctctccatctttatttgcatggataatcactgactgtttttgaagctacatttgtttttgttttggtttattttgtttcgtgtcttccgtagaaatacttgttttctagatgtaattataataagggggataataaaagggtttagatacaagaaatgacaatgatactagtatatcttttaatttcagagttgttttatgtttcgtatttatccagctgtaacaataaagtaggacttgttatatgggcttacgtttttatccatttctccctttctgtctgcaggaatctgttggggatttgatgataaggaatattcagttacatcattcaggaaaatatctctgcacagtacaaacaaccctagaaagtttatctgcagtagccgatatcattgttagaggtaagcataaatggtgaaaaagtgatcacattgtttcttcacagttacagtgttcatatctaaattgtagacctctgagaaaccacaccatgttatggaagtgagatgtaatcagatagagttttattttttaaaccccaggactccatggtatgggtagtgtgaatacagacatggaactgtgtgaatacagacatggaactgtgtaggatttgactatcatgaacggtcacgcttggcaagcggtgtcagtaactaaaacttagacataccttctgtttataataaatcattcttgtcaatccagagtcaaatccacatgctcctgtagttcttcatattagctgcaattacttgagttagattttaagaggaattaaagatgatggttctcaatctttgagtataggttgatatgcaatcatcctatgcctgatattttctaatctccagaggaagcactactacattaatgtcatttaccatgtaaagggaattaatagaactttatcgctaataatgtgctataaatacattatggtcaatattttacttcctaagcacaacaggtaaaaataaaccatcctagtaccaaattaatgaatgtaagtatctccaatggagtcatgataaaacatttttttcaaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacaggtgagtgacaaaagtgttttgggtcactttaaaaataatattttagtccaataattttaataaatgcaattacattttaaattaataattatataattttgtacaattatttgtttttgagtagtcccaacctaggtgccttagtgtctcattctttttagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcaggtaaagaatcaatgtgttctaaaagtgtggaagatttcgtatgatacagttcttaaaacaaaacaagtatttttatgtgtcttctaatacttttggctcaaaattgtttggcagtaaacgagtggctctcattttcttttatttttacatacacaaggcaaggtgtattttctccaaatagtaggttcaataagaaatgattacctttaagccaacatgtcaaaatcagagttcttaggaaactgtgtttgcatcgcatctattttctagtcaaaattcattagagaatctgtagatttgtatatgcaaatgagttactgcttgtttcattaaaatgttgtagccaggaattaactgagactctgttggtgcagtcagccatatattttcatctatttctcaactctgaactagttgtagcttcactgagcagtagtataaatttttttccatgcaaatgaggtaaatcctaagctcatttaacaggggcactaattgagcattaattggttcactgaacagcagaacgcaagaacctggatcagataccatgccttcttaagctcttttcaatggatcctctttgttccactcaaacttttacatccagggtgacatttaatctgctagctgtatatagcccacaaagttcacattcttattcgatcacataaacaaaggatcacttgtcatggctagcttaatttaacaaacacaaattaccttattaaagtgtgcacaattgtcagaagtcaataaatcaatccttaaactaaagataatgttatatgtttatcatagaattggggctagaaaaaggacatacttgacagtgatatcatccaattaaatcacgctagaagcttacagctgagaggaaatccctttgttttacagaagaggaaaatgaacaccaggatattagctggttgtttgtgacagagctaggttttgaatccaaacctcctgatttttacacccagcattctccataaaagaggatcttaatgtagatgagcaatagattagccaaagaaagtgtgtaaatatagaaattccccggccctcctatataccccctggatcagaatcttcaggtgttgtccatgactctggatatgagctttagtttcaggttgtttgtttacagttgatttatattttggtagctttggacagggttgacagaaactcttacattttcatagcaaagtttgtgtgccaccttctaaccattaatactctcttgtttcagtagcagaatgagactggtgatattcatacccactgagtcaaactctactaactgaaaacctactgagtctctcgtctctccctctctgtctctgacatcatcaaagactaacaacttgttctcaatatggttttaggcttaagtacaattaatttaaaattgaatagggaaaggaattttctatttctcagaacattggaaactttgtagaaagtaaatcaaaatataattcaaaatacttttccttacacagctaaactatgcaaagatcctgagatagtgtgcagttagtcactctaagctgtcaagcactataaattcagcaactctgtaaaatccactctgattcacatcgcttttgatcaaaggcattggaagtcttagaaaataaggtttaggttcacataacttctttctaaaaaattatgaagcttaaagctgacaaagttaagggtaaatttaaatacgaaaaggtatatctgaaaggtgcaattttgaaaaagaacaatcagattatcatatgactattttctggtcatgtttatagagctaaacatcagtatgaaatggaaataaataaaataagcaatctagatttatttaggtggtctatatggtggggaaaaatttgaaatgaggaattaaaacttacatattttaatccctgcctaccaatccccagacatatccaagtgcctcctcaaccaaccacctctcctattgttcagacatggtccagtatagacaatttcatgtaattccacatttaaaaagtataccctgctgatttagcgattatcacagatttaggatacttttgtcattacgtcaagaaaaataatgcttttaaacacttacgcatgtgtaaagtaaaacctcattctcgtgaggcactacaataccatatacacactcagcatttcctcagttttacagtttctatgatctattattcattgtgttagtccttacaaggatacagagttgaagggcatagttttttaaaactcatcaaaattactggtttctgaatcctctaccacagagccttagatcccaagaaataaatagaaagaacctctcccagtcgcattcttgacaggagaaaaacctgactttgcaagtgaaaagttagaagaaaatccctcttcttctctcccgagagatttgagattgtaacgaggagttttaaaacaagaatatttatttacatatttttcagtatttaattttaactggtaaaatatcctgatgactaataaaaggaaaaattagtttagtttgtttattgaaaaaaaataattaatatactgcctcagtaacttgtttacagctcaactgtataattaggcactaaatcagcagtgtcactgtcaccatctgaatggaacatcattttgccaattagtagatgatgcataatgatgtcaaatacccgatgttactcaatttttaattaattttggagccagggtgctcatgtatcaaacacaactgtgtcctctctcttagaaatttggatatgtgtaaacataatttacgttcattaaaaatgcaagactctctcacagtatgcctgtgtgagattttgaaaagtgaaattcaaaaacaaaattcttcctgatgaagacgtactttaataattgccatcccacatttctcttggttatttttagtccctgttgtggcaccagtaaacatccatggaggtggaggaagtcggtctgaactcgtcattacgtgggaggtaattttctgtccaactgagttattttgaagaaaagagatttaactggccagaaagaaactgaaaaacaaaaagatttatttgatcactattgagagcgtaaaaaaatatggtataaaaatacatcatcctgatgatgaattatttagaggaggtattaggaacttttctcatggtgagacagtatgacgaactcagcacaattttctcccaaatacacgaaaaacaacttcagtatctattgagcgtgtgtcagtagcattttcgttatcgcttgatgaattaggcattgtttgatttgttacctgtggcactgttgtattgtgaataagttgagcccagtagactgtaggcaaaaaatagttcttgtcctaaccctgctgttcacctctgatcaactcattcttccctgcatctagatgaaagcttaggcacatggagtagattttgtggtcattcttattacccattaacatacaggctcatttttttaccttattaaaaatttcagtctggtgtgtacacttcaaactggagtataaacgttagaatttagactttcaaccaatttaaagtttctcattttcagtatctcagtgcctcagcctaagaattctatagcgtgaaagggaatacgtggtcagttcaacttctctccattctgctctttaatttatctttccccattcacagtgttacctctggattctccagagctgtagaaggttggtgttggtaggggaggagaaaggaaaaggtctggattgctggtacatttctcgtttgactttggtgtgctctagttatggcaaattatcagacgctgccatttcatagggtagggtttctgcgttttttaatttattttttatctgggagatggccactggatgatcccccaccaaggactcccaactgcaattccttggtgcagacccaactggctgctgaagggtatcagttcctggattttggtggtccatttccagactcttccagtgaatattctctctcttgtaggtggtctttgtggatagagtccccttgaaggctgtccatggatgacccacttgcatgggtttcacatttgtcctcagcagacacataccctgctccatgtttagcggaagtgcaatgcatacccacttagcatctctcttcactctgccaccgtgggctgtctggatctcttccccactttaaatttctcagacatttgtcagttaaatgaacctgcgtcccttatgttccaggaaatgcaaaccaggtgtttcttgctgtagcctacttcacatagctaggctatgagagataactgggaaccagagacgttattctttatggttataaatgacagtgtcagaaactagatgcaattgccctgaaagtcaccctttcctctggatatcttgtttcatgtggacattataggcctagcacagtgcttggaaagtggtccaccctccatgaacacttgttgaatggaaggtagtgttttcagagagttggaactctcagaggccagacagagggggaaaccctattttttcaagcatttacaggatttcaggtgccacacagagcatttcatatcattcagtccccacaataatgctataaggtggttataccactttcaagtaagaaaactgagacttagaaaagtgacatcattgggcagagaagcatttgaacacagggttctctctttctgttcttttactgtatcctgtattacaatcccaattgtcttcatgcactgtgatggctgagggtgggcctgagtccttgagtatatctaccttaagtagtaagttaaccatattatacctactactccaaacatatttcccataaaacactgactttcaaatgagtctacaagagaattgtttgtgagtagtttatttaggtttctatattcatcaaaggccaaataagcattatcatcatagtgtacaggaagttttgcctgacttaataacttattttgttctcctccttggtaagaaattcctacaggctgttgttgcaattgcttgtacacagtctataatgagggcccaaatgctatgcattcattcttaaatagagatgagcatgaattaccaaagaatactgtctttccacgatttataatgttcttttttctttaaggcaaaggtacacaaaccatgacctatgagacaaatttgtctagtttcctgttttgataaataaatccacccatagctacatccattaatgtattgatgctttcttgctgttgcatgagaccatatatcccacaatgcttaaaatatttactatctggtagcaacaatagacgctagcgtctgctagagtgacgagaggaagggcgagggttgaaaaactagctatattaatgggtactgtgctcactacctgggtgacgggatccatcataccccaaacctcagcatcacacagtatatccatgcaacaaacttgcacatgtacccccgaatctaaaataaaagttgaattttttttttaagtttactctctggccctctacagaaaaagcatactaacccctatttttaaaaattaaactaaattaaagccacttcctctgtgtttattttttcttcctgaggaggaggtggggggtggatatctgatatgcagatacttgcagaaagtaaattagtgaaatcggtttcccatttatcactcatatttgacattatgtacaagcagatactgagccaacttcttctggtgcccagcttctttatggaataagttatgtatatttaggagaagattcatacattaggatgaatctgagccaccagaatgcaggtagtaattccttcaatttaatgaactctattaggtagcttctctgttcctatcagtggaatacaaaaatggatgagaaaaggtctgaatgctcagaagcgtagaggacagaatggtcttaacccagcctggaaggaggtcaggaaagacaccatcagaactgagtatatctgaactacgttttgaaaagtgacttggaagtagagaggccaccccaggtcaatgtcactcctgttgtagttgaaatagtacctgttggactttgaaaggcactgcgcgacacaagactgttctaagttcagtcacaatctgccattacgtttcataagtgacaactttaatgattatccttcatttaggctccctgtggtataatctgcctgaactgaactaaatatctttcccgtgttttccccagagccacacaataaatgtagattttttgtttatttgttttgatttggtttgtttccaaaaacctagacataatatcaaatttttagaatatagcaatgggtaattcctttttaagggcatgtttatacattattttatcataatgtgtatactcccaaatacttccaggtttgaggtgcttgtggtgaatgtctcataaatattactataaaattaggtacacaggataaagcactatagagtaagagatacatacctacactgagggttggcacgctttttatttaaagggccagacagtaaaaatattcagtctcgtgggccacatgacctcttttctaatgtctcagtctgcttttgtagctcaaaagagccacataccacttacaaacatataggtgtgggtgtgtctcaaaacctttattttcaaaaccaggctgcatgccagatgtggctagaagtacatagttttgctgattcttagtctgtactaaagatttggttcttacagacactgtggttgagaattacattattagtttatcaattttcatagattttactcccaggagaatttcacaatttctttattttactgaacactgtctccacttaaagaaaactctttttctggccttgttaaataactatatatattttttaatcatttgactctctgttgatgtaagaataaagggaagtatctaaataagtctcttttttcccctctaatctgcatatgttggactcaggtctttcttgagagagcaccatgagaaacactaattgtacttgactaacaaaaacaaaactcccctatttatgtagatgaactgactaagcatcgtgattaaatccgagatgaaagaaacttcagaaatgaatcaaatgctctagcaagtagcatcgattcttataaatctcttccatgccattcaaaattaactggtttacttctagtctccctatgaaaaagaagagaagtgttaatatgaggaaatactttgttgtttccccagatgtccggagcagcacttttcttcctcttttcactttctgtatttgttagactgttccacatggcaagaaatagagaccagctcaggtcatctcgggtaatgggggtttattttaaagctacatgggaagtaatgaggacaggaaaaaagtctcagcaagcaggcaggaaggtcagatgaagaaccggaacatggttcatcactgctctgggcactcgggcacaggagctctaggcaaccatcaacaacccctctgctgatccagccccggcttgaatagtctctcatgcttatgcctcagttcctcccatttcctttacttccagttttctacctggctgccagctaatttggatgccctctctctaatttacagcatctgttttctcttagcttctattgcctcactgttcctgctactccatgttctctactttttgcctgctctgtgtatatctatcattgttttgccacccaccatgtttcatatgcaaactctgtgagaggaattgaccaggtctgttagtcaccgtagagtacagagattctgccctcatagatactcaccaagacggtgcctgtggttctggcgctcgtgaattggtgctcgcatgggttccaagtggcaagtagatagtgtgattgatagaataaatggactcccatgaataaagagaacctctgaaatggagttgtggacatgagggactagaagcactgtgtcctgtcaggtgttgcctttattagtctgtcagaatatttattaaaaaaaaaaaagcaaagcattttccttgggaaaaaccaaataaattccattgatttttcaatacaagtttcttgccatcaggagatatgttggtctaaattcaagtacagattcattttaatttgctaagtttatgtgattgtttacaatttttagtatctgcagagtacagggggaatattaccaatttctattttgctattttagtaattttagatttgaaatgtattttatagaatctgatctttgtgagagttaacagtttattctttcatgtgaggaaaaatgcacacatgtcactaccaatgaagatgtatgcctaaaaaaatgatgggaggtcttttatacttttttaaagaaatattctgtgtcttaaagcatatgttatttcacagtaattccattacacatgtcttacaaaaacttgtttaaaatgttgtgaaaggaaaacatatctagtcttgaaataaatagttaagaagttaatttgtgctgagtttaaaaattcatatcaaaccacatttgagtgtgtatcataaaatcttttaaactgttttattattataatttatgaatgatcaaagaaaaatatataaatatgtaaagcttgttttatatttctatctgaaaacttaaactatttatctgagtatctttaactgggatcatttttctaattggcattccaaataaaagtgttttttaatacatcattaaacagaataaatatccatatttgtctctatggaagaaatgtgaaataatcaataaacattatagtagcttaataaaatatttttgcaaatactcagtgattgatcacattctgcccaagtcaattccagaagaactgcagaatggggagggatttggatatatcatcatgttccggccagtgggctcgacaacctggtccaaggagaaagtgtcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatggtaagttgtcctcaactctggttttctttgagactctatgcatagtttgtgttcccttgttccattttcaatgaaccactctgctaaagatggttatgtctttctctggatggtagaacctcaactggccccaaggggaacttctctccagagtttttctgcttctgaaatggaggtttcatggaatgctattgcctggaatagaaacactggaagagtgctgggctatgaggtaatccacattaatttcacttttgcttatgaatgtgccaatggacttcgcaatagctcctattcaacagtcctatcctactagcctgttgttagcatatgataatgtgtgtctaaagctaaagcagagaatgaagttgagacagggtaggtgagcccccacattgagaggcttagcctgggatgtttcttgtcctcgctcaagacagaattcgagagtgagccagtggtaaaaaaacaaaaacaaaaacaaaaacaaaaaaaaacagctttattgaggcagcagtgttacagttttgaaattgcttctgcagagcagggctaccccataggcagtgtgctaagagcagcagcttggaagcagttctacactcatatttatacccacttctaattacatgcaaattaatgggtgagttagttattcagaaatttctagaaaaagggtggtaacctccaggccattgccatagaaagggatggtaacttccaggtgttgccatggcagtggtaaactgatacggaactggtggttgtgtcttatggagaggtgctttagcctcttccctgtttcagtcagtcttcaatctggtccacagtaaagtcctgcctcctccctcaaagtaagggaaatctttctaggtaattcaaagcaaacaaattaacacatagtagccatttttaaaggcatacagattcagtaagtaagatgagtaagctctaaagatctgctgtacaactgtgcacacagagtcaacaattatgcattgtacccttaaaatttttcaagaggacagatctcatattaagtgttcttaccacaacatcatttttcaaaagtgatcaggtgattatatgattaattattcaaattgcagtcatttttttttcccttggtaagaggtgaagtctgctcctcaatcatcttacaccatggaagaatttcattgagaaacctgctttgtgaattgcagtataacttggaaagatgtaatcatctcagaaaaggcagttaagtaatgaaaaaaaatacctagattgtcttgaatctgctatttttagtctatgaagaataaggcaaattacatttgtaggccttcatctcacaaagtaaagagacaagaacattttaagggaaagttgttcatcactcaatctttttcaacttgcaaattcagtgattcacaaaatgggtaacataatttatttaactttggatttagaataaatgtataatcctaaacattcttaattttgcctatatatatatatatatatatacacacacacacacgtatacatatacatactatatatacacacatatatatacatatatacacatatatatacatatatatacacatatatatatatatatatatatatacacacacacacacacatatatatatatatatataaccataatcctctgattccaacagaaagttctactctcaggacaggtgtcttttccactccatgccaagaatgccttacctcttatctgaaccctagttacttctcaaatttcatccctagtcgcctcttctctctgagctctactcccatcaattcctgatgtattttgtcaaattcttgtagcatattttttctataccacttctttgcaatgcattctgtgacttattttcacatacactgtggattctaacctcttagctagatgataaggggcttgaaaataggtacttaatttattctctttttttttcaatgtacctaaaacaatgctaatgcaaaggtagggttcagtataaattgaattattaattaacctgtgattcaaataactctgaaaagaaatgccaatagcaagacattataatgaaagtctttgactgattatatacaaatgtgtttttgtctgacttgttatacatcatttgctaaagctggtaacctttagatagctcataaaatactttattttggtaatctaaaaaatcacgttctctaatttccattgtgaatttgcattcatgacttttttcctcataaatattagagaataacaattttgttgttgtataaccattttaattagaaaacgtttttgtcatctatacttctgtcttcttcccatattccttgtggttgtggttgatagttgttggtaaaaaatgattgatagttattggggaacaataaattgcttgttttggtttttaattatcaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcgtaagtatgcatacactccaggaaacaagattcatctgtgaagagcaacctattcctttgcttgatgttcatttcattcccacacctcatttctttactaattggttactttggttagttggtttgtcccttaaatatggatacttgttgaaaccttttggtaacaatcaaggtaattgttttcatatttctggaattccaaaagaggaatattccaagtatatcgatgaaagacagaagagcataatgtttaagactggccctgacgccctccttctaaatgcattcaaaaactgacctcctatccttggaacgttaggtggtatttatctttgagtctcagttgcctacctataaaatgaggaaaaagtcatatttatgttttcataggttttgttcaagattgaaagagattattaataataagtgtccagtacacaccttaatatatgctcagtaaatggtttttttgttttgtcatttgagtccgagtatattcacatgtgatcctacaactgtcagacacctagatctttccttttaggataccttattactacagcttacttggaagtccctgaaatctaagaatgaactcttctgttttgtcttatatcccctgataatcagccaggtgatttcacagaatcagaatctgctacataaaagatgaatgtttttcatcttttggtgattgttgctgcctttattttctgactgagtctggtaatgcacaaatattccataatacgaggcacagcaataaattgggaaaggtctgatcatccgacttagttgttcctgtaagatgatttttttgtggttgaataatatttacatattccttatatattattaatgaacacaaattattcataaaatcagactttttaaaacacatttttttgctctctgaatcctgatgaatgaaagataacaaatatagttgctgaattttgagaaagactaagacaaattcagtgccacttacaaaaatctagtttacctatacatgccgtagtctaattacaccaccatatttggaaagaagagatggttaagaagagtttgaaaataaagttatattaaagttattccccttatgcgtatatatgcgtatatttgtcatgtccaaaagaagttagttaggaaccatctcagagaataggcccttgattaaatagattatccagttatttccacacaaccagatcaactgtcagatattcatgttccaattctgggtacatcattgactcacaacttgaaataggacaaggcattccatttttttgctttcatgttcttatctatttattaaatagaaattatctctgtcctcactccttcccaaattacccatgaagcacaaacaaggtactgattctggaagcatcttagaaaatacaaagtgctgtggaactgcaaaagcctgtggagcaaaaatttttgaaccaaatttcctccagtccacccagttttagacaggctgggctgtgagttattttcaagaatggattagttaacaatgaagttctattccttttcctgttttactcaatgttgactaaatcaatgaagttgttgccagataacttggatgtatgatttgcttctttggtcttcctggagtggtttagcttctttcagctaatctgcaaatccgaatgaaaatctccaatcaatcagcagttttcagattacctagacatttagttctagttgactgagagatgccaaactcacagaaactcttgtgtgtagggggaggagccaagatggccgaataggaacagctccggtctacagctcccagtgaagacgcgtgatttctgcatttccatctgaggtacccggttcatctcactagggggtgccagacagtgggcgcaggtcagtgggtgagcgcaccgtgcgcaagccgaagcagggcgaggcattgcctcacttgggaagcgcaaggggtcagggagttccctttccaagtcaaagaaaggggtgacggacgcacctggaaaattgggtcactcccacccgaatattgcgcttttcggaccagcttaaaaaacggcgcaccacgagattatatcctgcacccggctcggagggtcctacgcccacggaatctcgctgattgctagcacagcagtctgagatcaaactgcaaggcggcagcgaggctgggggaggggcgcccgccattggccaggcttgattaggtaaacaaagcagccaggaagctccaactgggtggagcccaccacagctcaaggaggcctgcctgcaactgtaggctccacctctcggggcagggcacagacaaacaaaaagacagcagtaacgtctgcagagttaaatgtccctgtctgacagctttgaagagagcactggttctcccagcatgcagctggagatctgagaactggcacactgcctcctcaagtgggtccctgacccctgacccccgagcagcctaactgggaggcaccccccagcaggggcacactgacacctcacacggcagggtatgccaacagacctgaagctgagggtcctgtctgttagaaggaaaactaacaaacagaaaggacatccacaccaaaaacccatctgtacatcaccatcatcaaagaccaaaagtagataaaaaccacaaagatggggaaaaaacagaacagaaaaactggaaactctaaaacgcagagcgcctctcctcctccaagggaacgcagttcctcaccagcaacggaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatatagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcaagaagggaagtttagagaaaaaagaataaaaagaaacgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaacggcagccagagagaaaggtcgggttaccctcaaagggaagcccatcagactaacagcagatctctcggcagaatctctacaagccagaagagagtgggggccaatattcaacattcttaaagaaaacaatttcaacccagaatttcatatccagccaaactaagcttcataagtgaaggagaaataaaatactttacagacaagcaaatgctgagagattttgtcaccaccaggcctgccctaaaagtgctcctgaaggaagcactaaacatggaaaggaacaaccggtaccagccgctgcaaaatcatgccaaaatgtaaagaccatcaagactaggaagaaactgcatcaactaacgagcaaaatcaccagctaacatcataatatgacaggatcaaattcacacataacaatattaactttaaatgtaaatggactaaatgctctaattaaaagacacagactggcaaattggataaacagtcaagacccatcagtgtgctgtattcaggaaacccatctcacgtgcagagacacacataggctcaaaaggatggaggaagatctactgagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatctatgcacccaatacaggagcacccagattcataaagcaagtcctgagtgacctacaaagagacttagactcccacacattaataatgggagactttaacaacccactgtcaacattagacagatcaatgagacagaaagtcaacaaggatacccaggaattgaactcagctctgcaccaagtggacctaatagacatctacagaactctccaccacaaatcaacagaatatagatttttttcagcaccacaccacacctattccaaaattgaccacatacttggaagtaaagctctcctcagcaaatgtaaaaggacagagattataacaaactatctctcaggccacagtgcaatcaaactagaactcaagattaagaatctcactcaaaaccgctcaactacatggaaactgaacaacctgctcctgaatgactactggatacataacgaaatgaaggcagaaataaagatgttctttgaaaccaatgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctggcagaaagaaagaaataactaaaatcagagcacaactgaaggaaatagagacacaaaaaacccttaaaaaattaatgaatccaggagctggttttttgaaaggatcaacaaaattgatagaccgctagcaagactaataaagaaaaagagaagaatcaaatagacacaataaaaaatgataaaggggatatcaccaccaatcccacagaaatacaaactaccatcagagaatactacaaacacctctatgcaaagaaactagaaaatctagaagaaatggataaattcctcgacacatacactctcccaagactaaaccaggaagaagttgaatctctgaatagaccaataacaggagctgaaattgtggcaataatcaatagtttaccaaccaaaaagtccaggaccagatggattcacagccgaattctaccagaggtacaaggaggaactggtaccattccttctgaaactattccaatcaatagaaaaagagggaatcctccctaactcattttaggaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacataattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtccaattgtccctgtttgcagatgagatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactgcaaaccactgctcaatgagataaaagaggatacaaacaaatggaagaacattccatgctcatgggtaggaagaatcaatatcatgaaaatggccatactgcccaaggtaatttatagatttaatgccatccccaccaagccaccaatgactttcttcacagaattggaaaaaactactttaaagttcatatggaaccaaaaaagagcccgcatcgccaagtcaattctaagccaaaagaacaaagctggaggcatcacactacctgacttcaaactatactacaaggctacagtaaccaaaacagcatggtactggtaccaaaacagagatctagatcaatggaacagaacagagccctcagaaataacgccgcatatctacagctatctgatctttgacaaacctgagaaaaacaagcaatggggaaaggattccctatttaataaatggtgctgggaaaactggctacccatatgtagaaagctgaaactggatcccttccttacaccttatacaaaaatcaattcaagatggattaaagacttaaatgttagacctaaaaccataaaaaccctaaaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatcaagaatctacaatgaactcaaacaaatttacaagaaaaaaacaaacaaccccatcaacaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccacttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatatggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaggggaatatcacactctggggactgtggtgaggtggggggaggggggagggatagcattgggagatatacctaatgctagatgacgagttagtgggtgcagcgcaccagcatggcacatgtatacatatgtaactaacctgcacgttgtgcacatgtaccctaaaacttaaagaagtaaaaaaaaaaaaaaaaaaagaaactcttgtgtgtaattcagtttctatctcaagcaaaatcaagagtgattagaaatgtgtaagaaacaaacattaaaaaaaaaaacacattgtatcatggtagactgacagacattttagtgcagttattgagccaagactcaggtcaacttttattatacataatcccatcaaccagtttaaggtggattgaaacttgaacactgaactaatcatttacctcaggaagagagagatatatccatatgacatatataatacctatacatgttttaaaattcttattgagattttctgtatgatatatacatatatatattcacatctcactactaattttatataaatatataaaagtgagtagccccacactcccttgacctcaagggcagtctttgaagcaccttcttccctgctattcttaagcactgggtggatctgattgcccagatagggcactgcctttccccaaggtcacacagcaatgaagggggacagatggaggagagggggcctagatgtgcaggcagccccacacggtctcattggagtactgagaggcccaggcctcagctacataggagaactgctccttgctgctgggccagtaggtgccctccgtctgcctcatctccggaagcttccgcaccaatagtgccagccccactgccaggaacaagacagccaggaatcagaggaccaagatgatagcagtgacggccccccgaaacagggctccactggagctggagctggtgggtgtaggccaaacaatgctactctcatttgcagaaggggttgatatttgcgcccagggtcgttcccagggacgacagcagcggcaggcccagcgccaggagtagccccaggccgagctgggtgacgggttgacagtgccgaggaaggggcttctggcgcgcgcccctcctacagcatacagggcgggccatgggcacctgcaacggggcacctgacccaggtgtctttgaagtcgctctgtatatattctatatatatatatcagaacatctcagtaataattttttctgtcatctgaatttgctagtttcattgtccatgaaacctaaattaaaagtgttagtttgtgctaaattattctatgtttttaagcagaaacaaatccttgtttttgacactaaattttttcagttgacccaattgatcctacaaatgggttggacagaaattcacatcaaatgctaaagattattggtttgtctgatggttaacgtatgatcaatttgtcaaagagtaggagataaaaattttcgaaaacagttaaattaaccatgagtaatttcacccaagacacaacgttagaatacctctgctaaggaaaaagtgaaataataatcagaaattctaaactgaagattagcgttcctttaagtattcagctttcttaactaaatcaaacaagaaaaacctctgtaattcctagatatctagtttcaatagctcttaaatttgactcttaccagcctgtatgcttcagtgaccctataaaaatagccaacaagcacctgagaataagaagaatatacaagtctccatccctttgcatttaaatacctatccaacctctcattttattactttgacattctacatcacagacattgtgaaagcagaagagtaacttttctattattctattaatggccttaaactcagtgttttaaaacaatataagttgcttatcacacatttttggaggtcaggagttagacaggggtttcactgggtagaaatccagatgtgctcaagggctgcactagctttggaagctccaaaggataatttgtttcctgttttctggcttttggagaccacccatatccctggcttgtgaccctccttaggtttgtgaccccttcctccatgttcaatgccagcaacagtagggtaccttcacatctctgcctctgaccctctgcttctgtcatcacaactcctctaactctcactttcttgcttccctctttcccttgtacggaccctcctgatgacattggagccacctgaatcatccaagattatttcctcatctccagactcttaatcacatttgcaaactccttttccatataaagtaatgtgtccacaggtactggagattaggatgtgatcatgttttgggggatccttattttgcttaccacagtttcaaattattgagcacttctatgtccccagccctgtattaactttatcatactaaatctcacttaattattacaataagtcaaggagtttggtattttaatttctagataggaggacacaaatgcttagaaaggttttgtcatggcctctgttagactgatgagcatgaaatctcttcatcccactaccactgtgctcctttatcaccttcctccctaaccatcccaataatttctctccctgactgtcaaatcctccatctaaacctcaaactgctttgaaatttttcctcctaaaatgccgtcatacttctcttctcttcatcaaatgtcattgtctcctctattccagagaatgtagactaagaaaaaggcaagcaagatctttcacaatgtgtctcaaagctcctttctataacattcctcttctagccctgacatctcaaacttactgatcttctaaagtttaacattcacttacctggcttcatgaaatctctcagcttgtagtacccctgccaggcctatatatggtcaaatggtcttttttctgctctatagcttcccccaaaatttcccctttaatgtatttgcgtttttctaagaattccaataactttggcccattgtgaaacagtgttggaaaaagttggaatgggacttcagagagaattgtggatatggatccctgctcagccatgtactatctgtgtgccagatctaattatttgataactctgaatgcattttctcatctgaaaaatagagatgaagatacttacctctagcgatttctctgagaaccaaaggatataatgtacaccaaggtgacccagaggctgtcatacatcaaggctcagtgcctggtaacatgtgttattatactcctcctttagaggcaatttactttctttgcattttttaaagtaagaaaccacagctactttctttcactttataagtttgttgcagaattttcttttctttaagggtcgtagaaggacatccaaagcatgcatgaaaaacagctttactgaaacattgatgataaccatgattccaggtgctattcctgtatgtaactttgactctccatgtccttgagatgacatcaagattacctctcaatagtggtgactgaaaaaattctgcattcagcactgtcactgtctagatttgtaatctgatatttgatcttccattggaaagtctgaaaaagcagagctcacatttaccaaaatctctgcctgttctaattggctaagctaaagagaagacagaggtattttctttgtttgtttgttttctcacatgatcatccagtcatctactcaagagatagtgcctcccatgagccatgcctagagttagatgctgagggcctaagagcaattaaaccaagcaagatctttgccaaccggcaatttctcttttagagaagaggcaacctaaaacaagaaaaaaagacaaatgaataaaataatcataaattatgaaaagaacagtgaagaaaataaatgagaaactaagatgtacataaggagcatctatatgggataggctatgtattttgatacaaaattaaagataaagaggagttaaaggacaaaagaacttccagacagaaggaacagcatatgccaaacttcttaagtattattgttgctgttgatgatgatgatactagtattattaaacaaatatcagtgattcatctgcaagtaccaaagcctagtggaaatgatggatttccaaaagaaacagaggtactgcaaatatactgtgatccacacagacattacttaaatggaatttagatttacaaggaaagaaagaaaaatatttatgtcaattccaagcagaaaagaaaagtgaaacaaacaaaacactacttatgtggaaagaagtattcagacgcaataactaaaagtgtttgcaaatgttggctcaatttggcccttgacgttgactgactagcactttgtactcgattctttcttgctgcaaatatgcaatcaatccatatttaaacataaaggaagcattaagcttttattttatcttgcacttatgttctttctcttctgcccaaatgtcaaccccatgctgttacttagaggtgtaacataagaagttgtttttgaattgagttcacagtgtgaactacagttgaaaagaaatgccatctacagaaaaattgattacagggaaaccattagaattctgaggggctagtttaatgttgctctgtcatttgattaatagaaaatgatttagtctttggaaattgcctggaaagattttaaaagttagaaaagtgcttgtttgctgagtttaccattgacagacttggtacaaatatcatgacatgtgttttgtgctatccatgtggcagtgttttggtttctcaagatgatagaaattttaattttatcatagatatttgcaatccagtttaatcaactatatcaaaccagaactgttaacagtactcacattaaggtgatggccttctaaagcagctttcagaagttttatttgtcaatatcagacataaaggattgacactggagaaacatccattgataaaaataagaaaggatgtagactaagagatattctaagataattagctgagactctcccattttatctccctttctaaaaacatatcaagcatccaagtaagagcaatattattaaggggaaaacttgaatgtacactaattgtatctaagaagtgaatcatttgcaaacttcagagttggattattagcaacaaaccacttcgaacacaactgaaaaattgattatgtcataacaccacagtggagaactgctactcttggaagagaattaacagttacagggctttttaatatataccactaaccaaatgaggaatatttcatattttatttcatatctcataaattaggagttattcgtttcattttataatgggaaaatccggctcttggaagagattggatacaaattcaagtctctctgacatcaaagcccaactcttctcatctcccagagagcaagagaagtaaaacattctaaataatctgtataattggctattcataccaaggtactcactccgaatgcaactcttctcgttttatgcccacagaaagttgtgcttctgctttggtagatgaggacacaaatgcaaacatgtcaatgacaaagtcattgccaacattgcaaactgctcctttacatagctggaagaaatcaattctgtctcctagccagttgattttttcaatggatttatagtgttgaaaacaatactttttcctaaaacaaacaaaacatccggaaatacataaaacattcagaatccacactgccaatgacactgaagtggtgaatttgtattttctctgtattgattatataatggtaatgttagtgctgaattttaaagaacagagataaaaagaaaggtatcaagagtagactagatattaaaattgcaatatcctgtgagaattttgatattatatcttttatagctgagaaaaagattttaaaaggcactggaggataagttgaggaaggatagttacaaaataattcttgctgccattcagacctttagaaataaatatgttgataagcattataaatgacaagtacgttgtacattgacaagcaaagtaatggatgcttagtaagctaaaagctttcaggcctttaattatgggtttatattgtcaagaaatgtaccaggacatggtcaatccaattggcctgtccatcttataaataggtatggattgctatgagtctgaccacggcaattggtcttgatcataggacaacataatgaatggattggctgtattgtgtcacctatggatctgcccagagcccagtgcataatcaatacagcctgagaagatcaccacagggccctgaacagttttccttagccaccttattgtacagtcatttattcaacgtgtatgaattggatgtctcctatgtgccaggcactgtgctaggggttagtaatacagagttgagtaaggcacttgccctcaagaaatttaaacaaacacataaccaagaataaatgtaaaccaatgtgataaacctataataaaatatgaactaagcctcatgtaagcatacagggaaacatttctctatcacatcccaactggactgtaagtgattgagtgaacaatagtgatatcccagtggaagtggggtggaaagagaatgtatggtaatatatttgagacacctggattcagcaatatgtgaatcttccagtgacacacaggagattaaacagcagttgactcaaaactatgaaagaaatagtttccacttctaccagtgttataatgaattaaatattatgctcactcagcctcacaaattcaaaagagatgccaaaaacatcttgttgggcagttttatctttacttccactttccagatgaattattttatatctctccagtttcaatctcaaaaatagtcatgtggactcagataagcagcaagttgttctgcagaaacactagactgaaagcgctagaccaagattcgtcagctgcatgcttttggataagtgacttcccaacctggattctcgttttcttgtatgtaaaattctctagttggactatatccattactttagaagccagattctaaatctttcatctcttatctcccaccatctctcacgcagacaacattaatttcagaaaactaaaagtcgcagtttggatttaaagttgatgtcctttgggatgatcaatcagtttgtgatgattttccccttttctggcttcccaaaagctccatttattttaaacggcatgcatctttcacattgtccagacacagttgattaagctaagatagacatacgaccaaatgaagtcaatcatcagctttctcaggggaactcaaacttggactatctctgaacagaggaggttttaagtttcaggtgtggtgaacagtcatgatttctgccgtgtgcagtgagaatgacaaagaggtactctctggcaagatgagtatacagcagaccctgcttcaataagcagagtgaagactgtggctttgtgacatttttttctctcctcagactctgctgcaatctgccatgacttataagaaatatccttgataatttactacaaatattttgcttaaaatatcttgagttagttgtgttacagttagaaagctaactaatacaatgttaaaaagtaaagaattttaggaatgaacatctatgtgttgatatatataaaatgtttgcaacttgaatttgccaaacatgctcattgattgatggccaaatggaatcctagataaagagaccctctgtctgtttatatatgataaagtaaacaaactcaacagcaatgattaataaattaatactggacatgcagcaagccattattaattcataagtctgtcacaaaggcattcccaaatgaccagatttgaataaatttgcttactgtgattagaattaatatatttcaaatgacactgaagacattttagctccttctatgcaaatcatcgaagacttattttttcttttcatgttgatgcatcatactttgaccatgagctaattaacattcatttggatctttgattatctctttaaagctccaagccaaccaccagcaaacattgcctggaagctgacaaactctaaattatgcttgaactgggagcatgtaaaaaccatggaaaatgagtctgaagttttggggtacaaggtgagtttttagtttttcctttaatcatatcaattaagttactaaggaatgaaacatgtgacacccaaatggaaaacaaattggatgcatatggaaacactggaatctttttcaaaattattttgaaaataccattgctgctttctaattttccattgaaaatgttttacattccaaggtccagtaatgtattagggaacatcaataaatcaaattccataggatgtaacattttttcttcaagtggcatcccttgctatcataagatgatggcttatgtgcatagtagatgtgatgacaatgagatcaaaaaatatatctaaatagagattttagaacttaggctgcagtatgatgtgatcttttaacaacataaaaggcatctaacaagagtacaatcaagtacccagagcaactcatttccatcagtgacaatggacatcatctcttggcagacatatattcaacatttgaaatgggtccaaactcaacagtgactttccacagcaagctccaatgataatagcctcaagctatttaactaatagggataaatctactctccttccagaggcattggccaaaaaaaaaaacacctctttttcttaacaggagcaatggaatataaggaaaagacatcacttggatatttccatctgaggagtacaacatttatgatgatgtatcttatgtcttacagtgttccagaacagttgtgtgaaccttagaaaagcaacatgtccatgttaacttgatacctcattttattcagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtaagttgagtcaccattgctgtagtagattctgaacctagacagctgcagcatgaaattcagctccatgaaaccttccagttatggcttaaatgttgggtgataagataaattttcaattgtgagcaaaaggtgatgagccatttttttaagttattctccaaaattataacatacactataaatggttttatgcttcctcatttgaaaaccaaaaagagaacaggaaaaaaaatctttgtgtcattagagcataattgtatcactcattctattatcacaaaaatcagaaagatttttcatagattctttcgggtcttttacaacaggaatggcaaatatgaagcacaggtaaatatacaccctttcccatgttcatggcagacatcactaatcaagtgtggctttcataaggagctgagtcacaactttcaagtcctcctcaaaacaattttctaagccaaccaacaccagtcagtcagagttagcaggcaataataatgtatcatttttgcattagaaaaatcacttactcatctgcctgaagctgtgattgagtgcaagtcattagcatccaatgttggccaatcctttaggcagactttgccaatttagggattttccttttgcatttttatacttaaatcagatgtccttggacaaagacacggtaaggcactttctaaaattaaatataatgtgaatgagacaagtataataaaatatgttactagaagagaaatgatagtatgaaattggggttttgaaaaattaatctaacaggcaatactttatctcaaaatatttttgtcttatttttatattttgcaggtttgagttccagaggaattcaattcttagaacctagcacccattttctttccattgtcattgtgatttttcactgttttgctattcagccacttatctgatgaataaaaccataaatctttgagagttttttgaaagcaaatcattctgtatatatgctctccagcctctgacacaagatgcgttcttaatacagacttgtttgcaaagaaaaaaaaaagtatattattaaaatcctgtaaatatctatggtatattaataaaacaattttaaaca

SEQ ID NO: 254 - DNA, 106332 bp, Homo sapiens
gtttataggtatattatttataataaccaaaaggtaaaagcaaaacaaacatatccatcaacagacaaatgaataaataaaatgtggtatgttcacccaatggaataaaaggaaacattgatacatgccaaaacatgaatgaattttaaaaacataagtgaaatcatttagtcacaaaaggtcacatactatatgattacaatcatatgaaagtctagaatagggaaatctgttgagacagaatgtaaattagtgatgtttatagctgaaatgaaagtagagatagagggatagagaagtgatggctaaaggatacactgtttcttctcaaggtcataaaaatgtaatgaaattggtgatggtagcgtgtctctatggatgtattaaaatatactctactaatatactaaaaactgctttgaatatgaagtattatatgatatgtcaagtatatctcaatgaagctgttaaaaagtgcactatggttctagatttgtaaaaccaacttgaggaggtctatattgtaattaacactctcatgtacctatctcaacaataggccaaaccttattaaactagcaatatttttaatcaagaatattctttctttgagattagtataatcacaaggaggagagattataagaaaaaaacacaagtgttttaaatgggcattttctccagaaaacagaaaatgatgtacattattattgatcataaaaataaaaattagttattaagtggaatgcaactgattattgccctaaggatagagtggttttgcacttatttataaatttatttcaacatttttaatattctcatatagtgtgatattttgaattctcctttgaatttttgtaacatcttacttgttccttcattaattaatgagttaaacgaaatctttgaaacattttcattttatatttgtgtgagagccatgaatatgccctctttaaaaattacctttaaatacttatttttctttctaatatttaaacaaaactacaaaatgaaatatagtagataaaggagatgaatttctgaacattttcttattttgagacatcctttttcttctttcagcataagaaggagtttgcatccattgtagtatagttggatttttttagtttgaaaaacaaatcatgactttttcttaattggtttattgaattcatttactggtttactgaagactttaaagagggcaaaagatatattttgttaagagatttgttaattttgagaagtatcccattgattactgtaagaattatgtttataaattagattatttggcactgtagtaaatatcagtgaaaataaactttaactcataactttaatattttcatacaatcaaaaaatagagatatactctaggcataacataaattgttataattgatcagaatatcttgaatatatttttacagataactagtggtttctactagcagattaaaaccaagagaaaattaaaagtaagttcacatttaaaaaaaattataagcaataaatacagcactacagccaccactaattctatatacattggattacatttaaacaaacactgcattccagaatgaatattttatgaataaatgcattggaaattaactttaggaaataaaatgacaaattagaatttagaaaattaaaatatgactttcacaagtaatcacagtaaaatgcagatctacattttaaaagctagaaatttccccaaatttatttttttgacagcaaagaagtttgctttaaaaaaagtgtcagatttactttgctttatgagtatgatacaaagatattaagtagcatttagcttttgagaaatctaacatttaaaactattctaaaaatatatgggtacaaaactaacagtgattaatcatgaatgactgctacgcctcaagactctacaacagacaaaccctggctataaaataaatctgatctagaattaatattataaaagcacaacaaaaatacttgaaaattacatgtttattttaatataatctctgatcattcaacattttttactgtcacttctactgtcaagatggttgagagttgacagtttgtctagaagaaggctgatatatgtcaacatggtcagcaaaggatttaaatatgggtctttgaataataaatagctaataattgagtttattaaaatgaatttttgtataatttaggcagttgaaggtctagaacagcctgcgttcctttctatggcagcttgctatgaaattcatgtttcaaacaaaacaatactttttcatgcatagataaattataaatgtactgaccagaccattctatatgttaattcttacgaatttagataatttgtcttagcaatttgaaataagttctgaactcaccatctattgacatattgacagcttaagaaacaacttatgatgagtaatttgtttcatccattttaatcagattgacacacttaaaaaacagatacccatgacttttcccaaaattgacttttactaattgaagtcattcttgttctttagagatttcagcggaaaataacattagagaaactgaatcccatgcaaatttcactttaattcattagcaaggttttcttctatctttatttaataaagtctgacaataattcagtaagatctgacaataattttttctcaatgatatattcaagtatttccctaatttgtattatatacagtagctctattaaaatattaaagcattgtatatggtatatatagtatccttctagttttttatatttcttgaatagcctgggacatttccaaagctatatatcttcacatagtaaaagtcagtaaagtaatattttaatggggtaaaatctataaaagtagcagattggtatttatcacagtagttgtttaaaatttctggattagaatgtgagttcattgtcaaaatgaaaaaagaaatatgtcaaacacacctattattaaggtatgagttatcaaaacaaatatattcaataaaatagtgaccttgtgtttttaaaataaatatatcttatgatagatgtttctgttctcttagttctcaaacagacttctgatgctggcatctggttgtctttaaaatatttaccaaatatagcattccagactctattttatttaaaaaatcagcccagatacagtatcagatattaacatacacacattgttgcattatatatttgctttaaaaattacataggttgtatgtatttgatttgagactataaaataaaataatggagtatttacaagctcatttttcacaatttctttttacaaaattccaagaaaataagaaatccttcattgattttctttatataaaatgattgctaatttgtttatacagtagaaatggaagggacaaaatttatatttacagctaggaattccctcccactgtttggtaagacaggaagaggttgacaaggtgttttgtagcatcaactaagatgttttcctaatgatatagaagtaggattgcatattatacatcctgttcatccagtttccacaatggatatgccacaagatataactgatgtgtcagcaaatgagtagatcataacaattgtactcagttgcttttcatagagaaaagaaagccagcagggataattcacttctggtattgtccatttgagagggtagttacaaaaaggactacggcactctgggcaaaaaaaaagtcaactgccccaatcaagatgggataaagagttttaaaactaaaagctaattttcccttcatgtttatagaccttagctaggtctcttggggcaataagggtagaatcatgcccaacatgtatgtttagttttacagccatttgtttgtgaattcatgcaatggtgtgctggaactggcttacaccagctcagaaaagttgattgtgcttttctccaattccacacttggtgatgtcaggttagtagcgtcacatcaggcatagtgggagtatttactgacaaacattacaaaccaggatttcttttttcccacatagagctggatgttacactcttatcaacacactactaatttcatgtgaaggctcttctttatgacattcaaaaagtcatttaatattgaagtcttctggctacagagtcatgggtccaagtccttgagttaggagaagcacaaaacagtgagacaaccatccttctattttcaattatataaattttctggttttaagagaacattttcaatatcatggatgctttttccatttaagtgttcactaggacagtcatgactataacctggaccatcactgattgttgacactgtgtaagacgcactacgaagagcttctgagttggaaaagctgtttccaaattggattttgtattgattccagtttcttctcagaattgcttgaacctatcaatcaaaaggaaaacagaaagaacaagaacaacccattaattgaaatgaagacactgtttttgaagcacaattaaataggtcttggagaagagcttttttaaaaaaagttatgttaatcagtgaataatatagcttcattttcttaatttaaaaaattaagtgtaccatcttcacattaggaaatgtattacaattacattgtactttacattccattaatatttttcatggcatgttttgtcttcaaagcttttataattcatatgtatttattgttgccaaacaaataggtaatctggacccccatttacaagatttcatgtgcaacattgagttttatattaatgtctttattaatagaatgagaagacaattcgtgacaggataagcgaaagatacacaaaagaaaagaagttaggatacgaagaatacaaatcagcagcagcagcagcagggcagtagcagcaacctttgtttctgagtgactcccatatgccagaaattgtgctacattctaaaaaagggagcatgatatttgtcttcatggagcttactacatagaggaaagaaaagtgttgaacaaataattataaatctggtgaatattgtgaaaaataaatttaggaatgtaaccactccatttttatatatttgaatcctcttctgctgaataaatttgcagtttaatgacttccttcccctctgtttgaagctagagatcaggggtaggtgggtcctatacagtaaaatattggtcataatggaatgtaaggcacaagagtgaattttcttcattgtcagtcaatgggcacaaatgagaacatttaaatacatctctagctcaagtacgttgaggacttttccatgtctgatgagtgagcacactggcttggagcagcctgcttttaggttatgaatgtgttagccaaatccttgtgacccgatctatatctgcccagagtgggtttgctttgaatggtcttccccaagctctctattgctctttggctctttcagtgcttttccaaagggaatctgagcatctcacagcaattttctggtaattcattttctacgtactgaggtataattgtttaactttctactacttatatagaattcctcaactttctcttcactatatccatgtatacaaatcaatattaaatctttaaaaagggcttacttctctcttgttatttcctagtctaatggattaaaacacacacacacacacatacacacacacacaaaacctcaattcctccaattacaaacattctatagaaaataggtgttccaggatgtctgcagctttacaggatacttcagagttcctgttaaagtatcttatagtctgtcacttaaaataaactcaaagttttattgtctcatttcatgtaggaaaaaagaaggagcaaatataaagccaacaatgtgtttaggtaaaattaaatgaggtattaaaattatcagttaatttcactctactatatagttcaaaaattatataattaaaatgaaataacttcgtattgaaagttacattatgatgaagttcagtaacttcagccctttcaagctcaatttaaaaaatatatggtaaccatatctgaagaaaacaatttatattcatgtaaatatgctttgaaaataaaagcatttataaggcaacaaatttatttatcttgcaaaaattaaactttcctctcaatttagtaatataattctaaatcctccgtataaaatatctaaattcagataatttaaaaataacatctgcatatgtaacaacctcaagatcatgagcaaactacaaattgaatggcttcagattgtgaattttaaatacatattcagagattcaaaataaaaatgaccattgaccaattatctagatacatctgatgagaaatatttttgatccttattttttgtttcataaacttctcctaattttgttactaaatgctgaattggttgagtatgtaatcaatatagtttctggttgaggggaagtggcatatagctttgtataaaaaattctatataaagtatgagaaaaagctgagaggaagtaatatcttagctgtgagtctagtacttatagtcttaaaaaggaaagcttaaattcaatttggaaggaaaatggctattgaaatatatgactgtttgctcttaaaatatctactttgattaaggtcatcactctatttcttccttgcaactaaatcatcagaaaaaccatagaaagccaatttcatgaactgtgaggtcttactatagttaaaaataaacctaattaaagatccacaggccttgtagacttgtttgtttatgttatttgctctaaggatgttacatttttcttctgcttcctctaatacaatatcacacctgttaaatacgacattaaagcagctactcttaataaacttttaatgagaaaaaatcagtaggagcaaatttccattgtaagggaagatagctgggtgttattaaagatatgaatgtttttattgttttatgcatgaccatgtataagtagtaaggcaaatgtttagaatgtaacattacaactttatatacccattaacacccaataaggaactaactttatactccttaatgggaatcaatttaaaatatttacgaaacttttataaaaattctacgtagttctcatgaaagaatttgggtttaattgtctgtcctcaacaaaactttttgctcatcttatggaatatctaccctcaggtgttgttaaatataaccttctgatgactagagtccctagtttatgatcacagtgcacatttttgtctgagggcactagggataaaatgaaagtaatccaagcacttgtcaagccacatttatttaactagtgagaaatgctaatagcaagacgttagctaaaaagtgcataaaaggtgggaaagaaaaaaacacaaatattaagctaaaggcaggcatttgacctaatgtggaaaacaagaaggaaactaagcctgagcaaatgattttaagaagtacatgacatagttggaacaaaatgaatttggcagttgtttcttcatgttatgagagtgggaaaaagtaagaggcattgagacaaaaagggagggatcacagtatttcttaagaagagaaatgaatcatactgaaacagggattgtatctccagagatgaagaaaaggaacagatattagaaatgttgtgaggaactgaaagatttgggaacaacctagctcaaacattgtgtattattgtaattttccaatgtcaaaattttctcaattttaggacatggcagaagatcaaggttctgtgtcccttttgtttacacagatcgagtgtaacaggagtgttaggcattactttagatattccctgggcactctttctaaataaaagagccaatttgggattttgatccaaaatgattaatgttcctgttggcacatgtgtttttgaaaataagtgatttgacaaatcaaataataagtatactgagaatctcatgaagtggggcatggtgctaaaaactttatctttcttagcttgtatttatttttctgagacctgtgtagagaacttgctttaatttccctttaagaaagatagacacaggctcctgaaatttgccagcatttgccaaaatatcacagccaagatgaaaagtagcatctttggtgattaaatgcattgctgtgtttattctacactgcctcctgttacaaaatattttactagtgagtgtgttttgaatatttaaaaattagttcatggaattaaaatctgtttctgtagatacagaggtctacctttcctatttcatgcatgttctttagcatgttgtccatatcactctcatctatatttaattattacatcctatacaagtagcatttagggttgtctaattcagtgtatataacattaaatttatagaggtatataataaaatctatttgaattttactatcaaacaaatgatttatctattttttgtaactgcattctgtctatgcttctctgatttcagaaaaagttgctcttgtcttctgtatagcagaagaattatggaagtaccacttaaatgtatgaaatatagtctacaatgtgtggcaactctacacctcattacaaataaataaatatagataaataataataatataaataaatacgtgttgaacttgagatatattttaattaaaaactaaacattgagttttattatatgtcaagatgaggaagtaaaaatattacttaagcaagcgcaaataacatgttatagtttttcatgatgtgtgcatgatttccaatgttcatttgttttataggaatggttgtcataggttataccaactggtcccatgtgttccccatctgaagctttatgataagcttcacattatcaagtgtctgtgtctcactcagctgctgtctggatttctaaactttgttcaattttgccaaaatcctcctacaggttaaattgtgtcgagcagattaaaaacatataaagagctaagtcaatagagctcagattactgagctataacacatttgtatgcataagaaatatgttggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcgcctgtagtcccagctactcgggaggctgaggcaggagaatggcgtgaacctgggaggcggagcttgcagtgagccgagattgcgccactgcaatccggcctgggctaaacagcgggactccgtctcaaaaaaaaaaaaaaaagaaatatgttaccagctttcaaaatgcctgaaacttcccaagtaggaaacgcatggataaaaatctagaagtactgaagagtacatggtcatgttatgaattagagcattctcttctaaatttcctaacccattgaatttcttccctgtataaccaagagtttaatttttaaaatcctttcgtatttgccataaagttgtttccataggctacattgtaagacaggcaaaaaagagaaagagggaaaatgagatgatcctatttcttatttcctattagagtgtatgttctatgagatttgggattgcctggcactgtatctggggaaaagctcagacttaatgggactcaaaggtatctcaaaagattagatgaatagcatttgaaatatttttaagtgaggttgacttttccctggctttgaactccaatatgacctgagcatttgagaaggagagttaaacctatggtaagagattctatggttctttccctgatggaaacagaatttaacatggttgttcctggggaatttataattttatctcatttaaatacatggatagatagacagatagcaaatataaaataatagaaggaataaaatcaattatcatacctctccattaaagaagcagaaaatggtagagaccaaaagaccctgtaaaagaaaaatagaatgatctgaatccaaatggaaagatacatgtatttgtaatcaaatagctgtacaagtagtcaggagtaaaccaaagctatatgtatatttaattccaaacttctcaagctgccttcttatcaagaatgccatacctggaagtgcataaggatgtgcatgatgtagtcatatacctcctctgcaatctttccttcaggtcgccatggaatcagcacaaattcaatgccaagcaatggcaccaagataagagtagctctcacagctttcatgtacagattggattccgcttggtgtgtaacttttaacttggtgatgagaacgcgtacaatatttaacaagaaaaaaagattcacctaaaaacgaaattaaatggcatctgaaaatcatttcatatttaatattaagaagcattattcaagtatctccaattttataaatcttaaaatatttttaatgtacaagaatatttttaaagggtattattgcctaaggcattaatttatatttctggaattgtgatttatcaatttaacaagtacatcaattttaataaacaagttttaaaaaagtaaaattaaattatggtataattactgtggaacatattcagttgaagaatatttcagtttttctcagctcattttcacgtgcaattaaaaaaatctgtggtctaaaaactaaagattttgaacattttcatatcaaagaaaataattgtttatggaaaaatgctaatttttaaagcatcccctctttatcatgtccatatgacatactttctaaatgtatattataccataataaccattttcatctttcaaaccaaaaactttcctgtttcttctagtaacaataatctttacaacacctctccaaagtatcactgtaatcctcttttacttatgagggaactttgaaccagctgatattcaaccccagtcattctagagctaaaataatttgacattctataagacttcctgttaattactgtctgcaatgacataatattcactatttttgtgcctcaacaactttctcgaagagacagtagtttctttggatgggagacataaacctttgacactctaatgtgactcagcaaacagggtcctactgaaacatatttatttctctttctctcgcataatacaagtttatctttctcttattttcacccaagttagagtttatctctttcttattttcacccagtcaatatcttttactttggtccattttctctatgcccattccttatgccttccatagaatcatgaatattaattccagaagagctccataggggctaattgctattctcttttctttttcctcacccttagttctggcatctgccctttgtttaataatcttaaattttcaatctatgcaccaaatataatttatatccacacagtttaaaaattgcaaaaaatagtagtttcccatttattatagaaaagaattaacagagagcctgcatttgctaaatggacacatgtgtcataaaaataactgggcacaaaaatattctaccactatttttagaaaatttaatagaacatatgcttcaaaaatatacagctcactaaaatcctaatggaaacacatctatgaaaagcaatgtttgcagacacagaaatacgataaaggcaaaagcagaataagccatttcaacaggtgtgagaatgaaatgtgacaaatcaacatgtcagctgttattccactcatcctaatatattcccttcttaagcatccattgctctttaaaaaaagataataatgctcttttatctgcttaatatcaaatattttataatcttaatacattaaatcataaactataaaaagacagtagaaacattgcaatttagatgatcccaattatatgaaaatttttaaatgcaaagtgcttctccacatgggaagtctgatttaaaatgtgaaactagaaactagagttgacaatagagtttattctattagctattttataaataattgtcttagaatgaattggatgctatttttccacacaacatagttttgagaattataatcccttcatcttactttattttctgtaaatatttccatttactataagcaaaaataaaagaagaattttaaattttagaagaactatgtctgaatttcacccacccttgagcaaaactagttcagtagaaaagaagaaacctttaactgacatactcataaagtttacatagctagtaggcccatcaggctattttgatatcacagtaccacgcttgggtcatgacaggaactggggtaaatctatacagtggctgtaggacagtttctggaagtcattcccagacaatcacttaactatgcactgaagtcacctaaatatctgtcactgaacccaaattaaatgtatcatctctcaacttcccctcaacaggatctcaaaaatgctgtagtcactccagtaccaccctgctcacatggaaatgtgatggaggaagtctgagtggaatgacttgtgattaaaatatcttatttataaaaattgtgcaaaaacatatgataaccatgagaacaattactagggctcttctgaggagcttggaattggccaggaccaagaaggagctctggagcttaaacaaggacagaatgatttatccggacagaaaaataggttcctaatcttgttttaggccaacaagatgggaaagttttaggcaaataatgtggattttcgcttcttttcttactgaccagcttgatgggctatattcctgtatttcatccttactcttcttccttaaagtttacatgaacagatgtttccaaggatagtgtagatgacgttacattttgcatttgctaggtgctttcacttcctgaaccttactgatttagaagtctgaatcatgtacccctctgtgcagccagatcttttgtaataaaatattgtcttgcatttgttctggaatctcctgggtagcccaaacgatatattataatttcttcaagctctcctcagagtagaagcatggtatcatgcagaaactacaagtgaggaaacttggaaggcattttttcaagaatttataatattctatgcactaactgtgccagatcacttaacagaaagcatctcatttaatccttataataccctgtgaggtatatattcttattattccatcattacagatgagaaaacaaagacacagagaggttaaaaacaaaataaaacagaaaacttgctctgagatgatacacaggcagctgtggtagagccaggattcagtgctgactcttttatgcacacaatgcaaagccaggcagtctcagggtacaacttaaacacagtatgtcactcatgcccttagaatgtaggagaaggaagggaggcaagtgcctctgcctttgaaattttcactataatctacattaaggtatatcaaaaaatgttatgaaagtcataataaattctataagaatggcttaacaatgatacattttgagaatggtttgaacagtgatccaacgcaaccatatactaaactgcagctagcaaatatagttaaataatagaatatctgtatttaaaaagagtctgaagagacgaatgaggaagctttgaattttacatgaaaaatatcacatacatacacaagcacatatataaataacttgatcgcagctgtaaataaagggtatttgaataggaggagaggaagtcaaattgtctgtttgcagatgacataactgtatatttagaaaaccccatcgactcagccaaaaaactccttaagctgataagcaactttagcaaagtctcaggatacaaaatcaatgtgcaaaaatcacaagcattcctatacaacaataatagacaaacagagagctaaatcatgagtcaactctcaatcacaaatgctacaaagagaataaaatatctaggaatacaacttccaagggaagtgaaggacctcttcaaggagaactacaaaccactgctcaaggaaataggagaggacacaaacaaatgaaaaaacattccatgctcatacatagaagaatcaatatcgtgaaaatggccatactacccaaagtaatttatagattcaatgctatccccatcaagctactattgactttcttcacagaattaggaaaaactactttacgtttcatatggaaccaaaaaaagagcctgtatagccaagactaagcaatcctaaacaaaaagaacaaagctggaggcgtcacgctacctgacttcaaaccatactacaaggccacattagccaaaacagcatggtactggtaccaaaacagatacatagaccaattaaacagaacagaggccttagaaataacaccacacttctacaaccatctgatctttcacaaacctgacaaaaaccagcaatggggaaaggattccctataaaataaatggtgttgggaaaactggctagccatatgtagaaaactgaaactggaccctttctttataccttatacaaaaaataactcaagatgcatgaaagacttaaaagtaagacctaaaaccataaaaaccctagaagaaaagcgaggcaatatcattcaggacataggcatgggcaaagacttcatgactaaaacactaagagcaatggcaacaaaagccaaaattgacaaacgggatctaattaaactaaagagcttctgcacagcaaaacaatcaccagagtgaacaggctacctacagaatgggagaaattttttgcaatctacccatgtgacaaagggctaatatccagaatctacaaagaacttaaacaaatttacaagaaataaacaatcaacgccatcaaaaagtgggcaaatgatatgaacaggcacttctcaaaagaagacatttatgcagccaacaaacatatgaaaaaaagctaatcatgactggtcattagagaaatgcaaatcaaaaccacaatgagataccatctcacaccagttagaatggtgatcattaaaatgtcaggaaacaacagatgctggagaggatgtggagaaataagaacacttttacaatgttggtgggagtgtaaattagttcaaccattgtggaagacagtatggtgactcctcaaggatctagaaccagaaataccatttgacccagcaatcccattactgggtatatacccaaaggattataaatcattctactataaagacacatgtacacgtatgttttcttgcagcactattcacaatagcaaagacttgaaaccaaaccaaatgcccatcaatgatagactggataaagaaaatgtggcatatatacaccatggaatactatgcagccataaaaagaatgaattcatgtcctatgcagggacatggatgaagctagaaatgatcattctcagcaaactaacacaggaacagaaaaccaatcattgcatgttctcactcataagtgggagttgaacaatgagaaaatatggacatagggaggggaacatcatacactggggcctgtcggggggtgggggtgaggggagggatagcattaggagaaatacataatgcatgtggcgcttaaaacccaaatgacagtccccagagtgtgatgttccccttcctgtgtccatgtgttctcattgttcaattcccacctatgttgtggggtcgggggaggggggagggacagcattgggagatatacctaatgctagatgacgagttagtgggtgcagcgcaccagcatggcacatgtatacatatgtaactaacctgcacattgtgcacatgtaccctaaaacttaaagtataataataataaaaacaacaacaacaatgaaagaaaaaaaaagacccaaatgacaggttgacgggtgcagcaaaccaccatggcacatgcatatgtatgtaacaaacctgcacgttctgcacatgtatcccagaacttaaagtataacaacaacaacaacaaaatgaatagcagctgtaactaaaataccactcctaaggactgtaattgcactatgatctctaatactctctgagacaaagcatgctagattgctagtttgtattaatttactttctcattcaaataatgtaatacacttgtaatcccagcagttgtggaggccacggcagaaggatcactgcagcccaagagttcaagaccagcctgggcaacatagtgagatcctgtctctataaaaaaaaatttttaaaaattatccaagcatagtagtgtatacgtatagtcttagcttctcaagagcctgaggtgggaggatcccttaaacccaggagttgggggctgcagtgagctgtgatcattctactgcactctagtctgggcaacagagcaagaccttttttcaattaaaataataaaaataataatagtgtaataaaagcatcgaatgtgacttctgttttcctgcaattacactaaaatgtctaattcatgcactcacattaactgataataattataatgtaaaatttgcataggtattttgttttttcttatttgtcacctcccacccccccctgctagattcatcctctattcctctctgtgccacaggaggatgatgtctgtgaacagcttcacccagacttccttgccctgagacatttgctgcatctggctaattggaaaaaccaaaagataagagtatgggaataaagataaatttgagtctttgtttctgctgcttctattctgccaggctgtggttttggcagtggttgtttttctctactcaagatcagatctcttactgggtgactcctcccaatgctcatttcactgcactaacatttctctcttcaggtctagctgtgataacagcattccattgttggtccctaatggctcaccatcccttactaattagttcctttgcctttcctgcgcatacatcagatatgataccttcactaaacgctattcatttaagcactgtgaacatgcatgtccatctgtgtccactgggaccctgaaggataccataggccagatgattcagaaataaagttgaaatgtgagcaatgataaggaaaggagaatttgttacataccagtaaagcagcacaaattgggccatggataatgtagaggagatgggtatcagaactgatccagcaactagagaaaacataataacattatgttgaaaatttttattttacattattccagtagaaataataaaaagagattttcttacttgtcattgtaatataagcttctagcaatggcatgtatacaagcaggaatcagtggaaatcctgtaataacaaaaaaaaaagaaaataaataggcattttttctacagatggtatttcaaaaatatgtaattaaatacaaaaattcaaagatactctaggagcaaaaaaactagccactatatatttgttgaataaacattatttgtatcatcaacaatacacattataaagtattaggtatttacatttttgtgtttgtgtgtttatgtgtgtatgttttcttctactataattcataagtcattttgaatcagtggacttcagagcttaactcttaagatgtgtttcctaagccacaaggattagaagaaattcagcattcgtgtactttctgtgagatggaattggccaacatttggtacattatcagatgtggaaaaaagttgagaatcacaagaacttccactatgagagagattactactagtaagccattatttgaagaagagaagaagaaaaaaagtgattaatttatgtaccaaaaatttggcagcctttgaacattctaaatcagctcttccaaatatgtaattaagcaatgctttataaagttaatcagaatacactaaaattgtgggtgtgcgtgtgtgtgtatatatacacctctgtatatgtatttctttctagatatagatagtttagatagatgatagagatatagatagatagatgatagggtagatagatgataatagataagtacaacttcagttttgtttctggaaactagtcctgttaaattcatttctgcacttcatattttgtattattctagttatttttaatatgtcagaagtatatcactgtttgctttgtgaataataccacatcaggatattgtgtagaaaaaataaatcttttgcatgcctttattcaattactaatccctctactcttaccgtaaaatgacaatattttaaacaaatatttttagaatggaacttcaaagatgtttgaacccaatgctctcattttacacgtggcaaaaatgaatattcagaatggtacaaagactaaatctttaatttatgattctacttctattgttttagtcactacatattcagccaagataccctattcattggcatattcaatagaaaaaaagacactattatatattgacttgtgactactgaaaacaatggatgagtcagtgatactttgcttaaaatgttgcaatttacaagaataagcaaaagttaatcacctgatattctttaaaaatgattactcattggtatattcatattacaaaggaacctggcatcctccaaaggcttctttaatccactgaatcaacaagtatgtataataacacttaccccagccaagaaaataataccacattaaatgttgcttctctgcaaacacggccaccacaatgagtgtgtgtaggtaaatgccttcacagagcatccaaaagtaattacagcccatcaggtaaagatgaatgaactgggacactttgcaactaacctgtgaggaaaaaaaaaaccccaatatttacttgtttatgaattcacatgtaaagcaatactctagtttagctcaggaaacatggaacattctcccctacacacaaaatcctatacattaatgattaggatttgtggaatgccagtcttcgtattcatgtaatgatgcctttagtttttagccacagactccaaagattgataatggtatatcttccagaaaaaaagtgtaacttctaaatctactttatttagtgaatgtgtattttctgaatgtgtttttgttgttatgtaattataagtataaaagtgtcacacataaataactttacacttatttatatcatcatgaatcccttgactgttacattctgttggaaataatagtaattttaaaaccaattcattaaaagtgcccaaatacttgaaaagtttgcatattacatgctcctcatgcaaatgcttattaagaaataatctaatacatccataggttatcctatccaaatatggagtctgagggctttgtgtaagtaaaaggaggacaaaattatggtttcccttccatttttcctgaggtctccatttttgcttctctacttttaaacaggcaggaagagagacattcaaattacagtaaagaaaacacaaaagagtaagagtgagtttactcttaaacaggagaatacaattaaagctttcccaaaaatacatgacctgttactcctattggctccagtttctagtctgaaaatcaataaaagtttagtggcaattatcattatttttgaaatagtttttttaaccaaaaataaaattgaaaagaaaatgcactggattgttaatattgggtcatcacagaatagtaataatggcatctgcataggagtcagcctaaaaatacttttacatatattgttttatttaattcttaacggtagtcctatgaggtgtacattatcataggcatatattttatagataaaaaaacttagtaccagagaagttaaatgatttgctaatatttatacatcaatcaaatctacaacctgaacattccaattttgttttcattatatacgatgcctcctaactaaaggatatttgtaaaacctatttattcattaaatgtatctgcagaatacgtaacattaaattttaaataatgtacctgtatgtaaaacacagcattatattaaagttcactcaaaggtgaaaatgagatagtctactatatggagagaaatcataaatttcagcttcaactttttatctaaagagtttttaagtatttatatttaattcggcttctaattcttgatttcattaaaaaagttaatcgataaaccattacaataaaaaagaattaagagcatactgcagaaaaatatttctatgcagggcattagtaacagagacaaaacaaaaatatatgacaatttataatgtgtttattaaacacatctttgcgtacaaatatgagatttagaatctcatgctctgcagcttcaagacaaaactctgaatctccttgtcttacagaaattcactctaaaatggcaggacattagccagatttttatgttgctaattataccccagtgtgttttctaatccaatgactttagagtggaacatatacaagattaagcaatctggatgcacaggtgcaaacaatgcagggacttttagaattttgaaaattactctaaaaacacacataaaacacacatgagactgtttattgacccacttggtaaaaattctttcccttcctgatttcagtcactagataattttttcttttaaaaaacactttatatagacacacacacacacaaaatatagtaaatatcccataaacattataaaagcagataatttttaaaatttgaatgtatgtttatgtatgcagatattttaatttaaacattttacatatgcatatagcttacacaaaatatttacatttagataagtaaattttaaactgtttgaaaaatatggcctgtaaggcaacaatttataaatatttattgagactgaacactgtagtttttaaaacattatgctatgaagtttaatcttatgtaggatatgtacaattcattcttttcctggttttattgactttttaaagtcagcctgatacaaaaaatataatttatttaaattttccatgtgcgtgtactatttttcgaattacgcagagttcattgctttgagtttttcatttggattgaataaatattatgtagtgataaactattatgtgccatagcaagaggactctacagctataaaatgaagtgaagatatgtgtacatgtataaataattgaagcaaagaaattattacacttttttatgttcactctgtatcttggggaatactgagaatactctgagggaatactctgtagagtatatgtagctatattccaatgtagaaaggtaaatatttctcaatattccccaagatataaagacttgaaaatatatatatatgtcagacttgaaaatatacatatatgtgtacttaattatacacattatgcatatatcagccatgttccccctttcccattaggcccttgaaccaagggcacaatcttggtttacttacaggatttgtggctactaaggcctggttgttggccactgcagtgaggtgaatgattgttacaacagagttacaaacaaatgagaagaacagatttttgtgtaaggtaatcctttggcaacttaggctcctaaaaagcaagaaaaacaagtgtgttgacatcatgaaatgtttttttattaatcattattcaaataagatacattcccaattcatagcagctgatccacttttgaaacaattattttttctccctaagatccactcattacaaaaatcttaattagggaaaacctgtaagtgcttaaaacctagagacaaatgagttgctccagaagaggtagatatacatagggatagaaaatttgcctgtacaagtcctctacatgactttctctattaatttctgaacataattaatagtttaattcattttgcaaacattgggattcagttaagttagataattgatcaaaactcctgcagctaattaatttgaacactttgtatttgctgtcagattctcatgtggataacttttttcattacaccatatatattgttctgtttaaataaaactgtgtgttttgttgtgatggtggtgattacacagaccgatctggaaaaaataacaaagtactcagaatagatgaattgataaaaatgtaaatttagcaaccaatgagatttgcacagctttactgaatttttctaattggtgcagccatatataaggtaaaaatagtaccaccttttactagagttcctcttgtataaaacaaaagagagttcactgtgtggagttcacatagaagtagatttcaagaaaaagtgtcactaatgataactgatgtcactcttagattgaatccacctccactctaagaagattgtgcatatatgactgcctgcccgtgttcaagcgctacttcctttataatgcatttactcaaaggcttattatggataaagttttaaaatagtagtatgggatccacttgaacctgaatacttaatgtcaagtgtgaactcatatgaaggaagacctgaggaattatttcactacagaggcaaaaaatttcatgatgtgtgtgtgtgttttttttttaaatatgctattaatatggtcaacctatataatccaccatatataattcaagccaaaggcttctattttggaaactttaaggagatctttacctaattttatcactaaatctctttatcttaaatagactgtgtgcccaggatattggaattagggtgggatgccacggttttctatatttaaaaattcagtttagagtatattgcctctgaaattacctttcttccagccacaggtctgtgattctatatatagctctagtaattaaagagcctggaggcatatttgatccaaatcaatattataaattgtcaatatattccttctacaagacttctatgaagggattcatgggcaagatggctcttggaatgattgctgagtgtgtgtaagacattcatatgccaacaaataagtgaaatccagctggaatccatcaaaatagaaacaactggaaccagctagtattttcatattaaagagtggtttactttggcttgactttgtagtgtataggagtagtgacgcagacagtaatcagggcttatctacaggttattgattatattctatagaaaaaaagaatctttgaaacttttgaacaaaggagtggcatgattcctgctattacttagagaaattcaacactaagagaaagacaatcgtatttttgataaaatgccacagcagtgacataattactttctgttcattgagcatgaagagagttaatgaatatcagaaaaagtctagtaaataatgttcttttcaaatcagttatattatgtgtggtttatttctgtcattcatcagtgttccattatgaaagttatagacatataacatttgttcatatggtcttattttaaaatgcctgctttgagcttaccccatgtctattgagtgccaagtattgtttagagagaggaactgcttatccatgcaaatatacatgtttttagtaatacaatataagtaactcagctaccatcaagggaaaaaaagtaaagcatttttcttaactgggcgattttgtcattttctgctgagcacacatatatctaagtccattggctaagtccatatctataaacaacaaaatttcatagttttaaaactatgacgaaaagattgagaaggtttgcttaaacagcaagtaagatatatttgtaagaagtaagttggaataaaggaaagcaaacatgaaagaagactttcaaaaatagaactattctgccattaaaaaaatgaacttctctcattcaccacattacggatgcaactggaggacactacattaaatgaaataagccatgaacagaaagaaagactgcatgctctcactcacttgtggaagctttaagtaagttgattgcatagaagaaaaaaagtagaactagaggctggaaagggtaaggggagagtggagatggggagagatttgttaaaggatacaaaattacagctagataagaggaataggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaagaggaataaattctagtgttctatatcactgtaggatgactatagttaataataagtagttttaaatagctagaaggattatgtgggcatattgcatgatagtaaaaattagaaaaaaattaaagatagctagaagaagaatattgaattttcccaacacaaagaaattataaatatttgggaagatggatatgctaattatgctgatctaatcactatgtattgtagatttctaaacatcactatgtaccccataaatatgcacagttatttcatgtcaattaaaaagtgaaataaaataaataacgtgatagaagagctgaaagataggagctaggaacataataaatacatttatattttaactgtttatattaataatattcacatgtgaaaagattggaagggagtaaaataaaatgctaactgtagttagttgataaaaaatttaatcctcttgtatacagttaaaggttaatcctctttgtataaagttcaatgtcctctatgatggtctatatttctgttcctctcagaattccattttttttaccctgctcccacctcaatttgtcttgaaaggtaagtacttaaaaatgagctgctggtatatattatcttccaaaaatgtcattattgtgagtataaccccacacacacacacacacacacacacacacacacacacacacacgacatcttattctcttattatgggataaaaggatataccatatttctctttttaagacccaaacaatatcattatgggcaaagttttgaaataatagaatgaaattcccttgaaatttactgaatgtttaataccaagacaaaacaagttcttaagaagatgcattaaataatttcattacaaagacattaatttagagtgttttatacaattattgaaataatgtggtcaaactagatagtccaccctatacaactcaaaccaaagactgctgctttggaaattctgatatccagtttagctgcccaaattttagtaaactggaccatcgccacatcatttcattttgtgttgtgtaaatatgtcctactgcctaaaatactatttagtttcttccatttctacctccaggcactgtgcaacttaaacaaatgcagacagatgctaagtaacatatggtttctatcaatgtctagtgtaaaaatggcactgatttttctgatgatgcatattgtttccttctaaacatattcattaacacatgtaagtagattggtacaaataaaatcaacctgtaagtgaaaaccaaaaacatgtaattggtaaacacatggtttgttcaaatgaagccctaaaatatttgtatattttttcaaatattaacctgtaaccaattttacctactttaaattcttaaatattcttattttattcaaaatagtgaaagcaattatcttagagtcttagagaatgtttacaaaaatccttcgatttctttaaattttataatatccctttctatccccgcataaccacagaacagaaaatggggtttgtgggtccagattgtttgtatttcatattttttacatataattattttaaaatgccatttcaacatttaaaatgccatttcaacatgcaattttggccagcagagttacagaggcagttgatgttattgtgtcaacaaaatcattatgctttatatgtaatgaaaccgtgtctttcaattcacttttggaacaattttagaagtaagtagcgtcaagtcactatgtgtagttcagacagtgaatctgaactctgccatctattgatggtataactttgggtaaattatttaagatcttgaatctttaatttcctaatctgtaatttagggctaacaattgtacttcataggattggcttaaaagttagaggagataaatcacttaaaatgttagcataacatctaacccatgataaacactccatgttaagttagctgttgttttttagcataattatcatatggttgattttaatcaaacgctctaatggtttttaggtacaaatactaaaatagcatccaggtttacctcagtaatgtcaaacttcctctatattaaaataagtatgttttaagtaactcaatcaaacagaaaaatagtcattttttttcttaccaaacaagaattatcattagacagaatttccatatgatgaagggcaatacataaagcaacctaaattatcttcccaggaaatttcattctttctatagttgttgccaaattgccaggttcactatcatgcagatcccaaatattatagtacttcatcttcaaatttctgccactagtatggacaataaccttgcctctgttttccatttgcttttgacatgagctaaaaacttccaaactacttttctcaatactaattatgagcaaaatgaatcatgaaaggagaaagtacaagcaatataagaatagcacagtctacaaagtattgctttcttattctagcttatctaatttaatttccaaattctcagatcttttcccccaaaaaacactagcaacatatccaaaaggaaagccctgtcaatctgaacactgccacaaaccataggcagaaaacaacaagtatattaaaagaatcagtagtgtgactatcttttgtctattcaatggaactctcaagttgatggaatcacatgtttacatatgagaagtagatataacctctttcaatagctctcttttggaggctgctggtgatccaaattagattaggccagattagaaagagggtgagtatttcaaccaaggtgctcaatgaaggtcctagaggataaattattgctcttcctccattatgctccctcttcccatgcccttgggctgcttatttaatgaaatatagtagtatcagactgcataaggaatagccatgtccattttgtatggacaactgattttctaccatttgtgaactgctttggtaagactgcttttcctggtcttctagtgagcaggaaaccaagagaagaaagtctttctgaatacctgtgattcttgggctccaaaaccaaccaaccaaacaaaaacctttttagaggcaaaatttataataatagcagccacgatttttgaaacccttagactatccccagcatagagataagcactttaaagttgctatcatatttaacaactccttgaagtattattgtcttttaataaaatggaggtaagtttctcaaggttacactcttataaaaagtgatctattgagtttgaattttgaagttctcaaggaagcaataaggcttctgactactttataatccatctagtcacttactattggatagtaatattttggccactgttactagaactggggaaacagttgtgaataatacaaagcaaaaccctgacctcatgtgactcacactatagcagagggtaaataggcacataaattaaacaatgtaatcccagatagtggtatgtgctttttagaaattaaaacaggactaagggatacaaaaagaatgtggccagggtgagaagaatacttaacatacagttgaaacaagagagtatagaggagagaagtattccaaatggggaagacatccctgtttgtcaaagccctgagcttaaagtttctgaggggcaagaacaggccatgtgacagagtacaaggtaaacgtccaccatggctttttttccattctacagaatgagtaaattaaattcaaagaacatcacttactgaatggctttttgattctgaagttcatactcttttgtgttatatagcttttttaacaattaatgaaaaattgtttactttattctgtttttaaattattcccatctctttcatgtaagaccttcttggtttttgacatcttaatgtttcatcagcaaatattagcagcataatatctagtcattctgttttttctttttcctaaatactaaaaatatgctacagttttgagagtgtgctttgactttctcatatatgtctgtgggtatgatcgagaaaaataaactgtctataataatggaaaacctgattgtaaaatatattatgacttttgggagaaaaaatgttatttatttctattttctatttcaaataacgaagttttaatctattcaaataatgatataattttcaaaatttattgtcattctattgccaggaaaacttaggtatgcttaaattaaatagcacatttaattagctcaaacagaaaagattaaattcatgattcagaatttgcatatttatcaaatatatctgtaggaataaagatatgtgatatttaatgtggatttatagctttatattttttatatcttaagtccaaattatctaattcagttactgtatttatatttccatacctgggactcttctccataagccagtaatagcaatgaccttatagcagacaggttaatgttaaagcatgtccattacttcttgcactactctgtctgcattcaaaccgtatactttatgtagaaatgcaattattttattatataactaaaatggacatattggaaacattttggcaccatctcactttatggcataagaatgttttcacctctcacaacattcagttggagagggatggatttttatgtacactaactgattaaaattcattaatttggagatagacccaataaaacatttaagaaaacctatagttctcacgcctgtaatcccagcattttgggaggccaaggcgggcagatcacgaattcaggagatcaagatcatcctggctaacacggtgaaaccccgtctctactaaaactacaaaaaagtagccgggcatggtggcgggctcctgcatagtcccagctactcaggaggctgaggcaggagaatgttgtgaacctgggcgggagcttgcagtgagccaagatcgtgccactgcactccagcctgggtgacagagcgagactccgtctaaaaaaaaaaaaaagttaaataaataatatctaatgtaaagcctgggatacagaccgcagaataggctatatctcaggaccatagtgtataacaaatttacaatgaataaatggacgtaccgtgagttaagagagcaagggtgatgctgggtaggcagtgacaggtatgctgttcagggaatactagatgactacttttgaactcagtccttgtcaaacctctgacagtgcagtattgccaggttttaaataaatgaaaagcgaaagttccaatttgtcaaaacaggtacaacatcagagtaattagtagagcaaactctataggtttcaacgtaggatttcattaatagttagctgtgtttaaatatggtttaaagattaatcatgtgggaggctgaggcaggagaatcgcttgaacccgggaagcagaggttgcagtgagccaagatcccgccactgcactccagcctgggcgacagagcaagactccattttttttttttaaagaaaagattaatcgtgcacaattttcagagaaaagttatagcttaaagaaaaactgtacttgctctaattgaagaaaaatatgaagaaactggaaatgagataacaggtcacaatattggttaaatatattcagatgtgatctaagaaaaaatgagaattttggtcatttgtactgagaagcagaaatacaagcactaacaggttattttaataagttaaattgagaatgctttggtctaccagttggatagaggttatttttttctgaattttatttgggacctatggcaagtacctacaaaagatatcattgtctacatagttccaaatatgcaacttggcttctaaattgtttggggtcagtatctgaatgttagcaaagacgttctttaaaaaaacaaaccaacaacattttctttttttttttccctataaaagttgggtagatgtcatatgctctcttttctgtggaaaaagatgaagccttttgtctaggttgtgagatttgctctgctctctgattttaaacggtaattaaaatataatttgtaactaattccagtagagtttattttttttttttatctaaagggttccactttgtttttccaagaatcattacgagtaagagtcattgcctctcagggcttggcaagccctaaagttacgtctctttctcttttcccctccctctctgttccctttctttttatctcctgctctgacttgttcctttaattggctctaatataaaactgaagtatatctggtgaatactgttttgtgttctctgtttctaatttaaagaatggatgagtggtagacttttctctctctaaataaaaaataacaaacagtaccctaaatcaactttttgtatggttcttggtttttattagggtgggtcagtgaccctcaattaccaaagaagaggaaaaaagtttcccataccgagtaagcaagaataagtacagtataaggaactgggttaagaaacagaaaggatctgctaatagtatttttatacacagtgaatgattttatgtgaaacatcagctcctctaggaattgttttcaggttagttggatgaaagctaataatttctattgcccctgactccacaagaacatgattcatgaaccattcaaattcaatattttctgaggtggccctactcttctttggatctagctgcagtctttcatcttgttttacacagatgcttctactgatttgaattttagagtcttagtctaatgcctttctttgttgatggagacaaataaggccagacaatcttaagggacatgctgaaggtcacaaataaggcatgggcaagtctgtcctatatgtaagcttcaaagccagttcatgtcttcattccttaaaaatttattgagtgcctactatgtgcaagatcctatgctaagccccgagatgtgtaaagaaacaaagcagaggagactcctgctctcacaaagctagctttataaaattattttcgttaattctagtggcatatctggtagatcattctatggaataaatgttagaagtatctaaattcaaagactaaaaattccttaatattgattcaaaaattgagtaagctacacggtatcttctggtcataaaaaaatcttattacttttgactgatttacttaaccatagttttttctaacataattattaattttgtttataaaaatgttcattcaatgtttacttatttttctacatgaatattttctttataaacatggtccatttaaaaccagaacttgtattatttaattttgtttttaaagatcttaatggtataacatacctaccagggctaaatatttatattcaaacctcgtaatggactaataagaagtgagaacaatgccaatcatagataacattttttgaatcagacgctctgcttaacactgcatctcactgataacactgccattatctcagcctttatagcaaatctatgatgtagatactaatatgatctgcatttttaatatgtataactgaggattagaaaaatgaaagaacatgttccacgctacacagcaagtaagtgacaaagtggaatttgagaccaatactgcctgtctgaagaacactctcaggctgggcacagtggctcatgcttgtaatcccgacagtttgggaggctgaggcaggaggatcacttgaggtcaggagtttgagaccagcctgggcaatataatcaaaccctatctctaaagaaaaaaatatttaaaaaattatctgggtgtggtggtgtgtgcctgtagtccttgctacttgggaggctgggtgggggaggattgcttgagcccaggcgtttgaagctgtagtgagctatgatcttgccactgcactccagcctgggtgacacagtgagagcctatctctaaaacaagaaagaaagaaagaaagaacacactctcctgtaatgacatctagacatacagaaagtatttaaaatgctatacatgagttttacttgaagacggtttctcatgttttacctaaggcctgagaatgataataataaaggaaaatttgcagttttgcttctctcttttcaaattcttcatttttaaagatttgtagagtcaattaaaataatgaagtgagctagaacacagatcaggagaaatcttgaaaatgttaattaattagaaaataagtaaaattaggtgtgagactagatgatctcttcactgcttatggcttataatttctatctgttgaagttttacccatcattgaagtgtttgcttcaattagagtatcacctcaggaatcttcagattctatgagttagaatggttctttcctttctcagtgttccccaggtctttgtagctccagaatagcactcatttttttgttttgttttgtttattttactttgtattactattatatgagtatttcagatgactacataaatgtattctgagtgcctatatgattgatatagtctaatgaaaaaatcagtaactcttactactcattgacgggctcctaaatgccaggtactatatgagtctactttgcgtagtattttcaataacatcatgacccactgtaaacacacacacacacatccctggggcttatttaaagcaaaatcaggctaagtccatactattagcaagtagtgatgacaagtttggaatacatcccatgtcttaatcattgtattatactatccattaaaattgagttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaattgagttatgcctgaattcaactgcatacctcttatactaacttgccactgaaaaattcttttttttcctttcagttcactatatagaataaacaggtaattgtactttcagtgaaaacttcaagtggaagtaaggtaattatttgaaaaacatattttttcttttatgtagaggtcaaatttcttatattggcaagacattcatttgctttaacaaagtgttgccaatgtagcatgttatacatcttgtttaaaagcatgggcattttagcaaataacaaatgcatgtatttattgcacatagtaatctttattttaaaaaatattatttttctaaaaaattggcctatttatatgtaaaacacgaggacagtatttgggagaaccaaatttctggcctcttttggaatgaggaatgtgcctacaggttacatctttaaagttaataattttgtaaatatatacacaatatcatttttaaaaagcacttctctatagatgaaataaacattctctggttttaaattttaacccttcaattaaaatttaaaattacttgtgaatatcagttgaacagtatttgttcttgaataaaacatacataaatacagatataaaaatattgaacatgattttattccaattctttatcaataagaaatacagtttatgtgtgtagactgctttaagcttgccaaatactttaacagataccaacttccctgatatggagattatatattttgattaaaaagataactctttcattctaatcctctttattcaagtactgtttcattcatagattcttgggtgtggaaagagcattaaagatcctcaggtctagctatgaacccagtataggaaagccatctacttcaactttcctgagtgacaggaaggcaaatgcaaggttcattacattttgtttagttatattcgtttttttaaatttttttaattgagctatttttttctctgtttattataccaactgtattctcaattatagtaatttggattcttgaaatcatacattgtgccttatatattttgtctttttctggcttaacactcttggtgtggtaccttgatgcccggatcagttgatattttcttcaatttcttcacttgataagctaatttttatgatatcttgcttttgctctcatatagtgaactaggagaataagtggtctgatttgagatttaaaattgaatactctacatttgttggtatcatttggcttgcagcattgttttcacttggcagccctactcttatctaattagttcacagcaagcattttccattaaatcttagactctttcacatgaaggaacataaataattttgcatttgactttaggaaattggtgcaggactttacttatctttactaaattctaacttgtttgggactgtatgacttagaattctagaaaccattgtccttccctgtagccactggttttgacaggcaaatgtaattattatactttgcaactttatcttcttcaaaaatttaatgtgctcggatatttcaacttatgacatgcaaaataaaaagagaccatttaatctgaagactttcagctgtattagtttttaatttgcagagatagtggtcttccaaatgttaattaaaattttaccctatgtctactatcgttaattgcaattctggaaatattacagtaagtaattcgggaagatttcactgaggaagtgatgctaaaatttaaatctaaaagataaatacatttaattagactagggaggaggcaaagagaacaggcagggcaagttaatgattttgattttatattaattacaatggaaaatctaaaaattttaaagcaaagaatggcaaaatcaggtcaatatttgatctaaatatttgaaactactattctggctgccttggttagaattaaatgaagagagaaagtgaatttactgaggctagatagaacaagactgctggtgatggcagtagtgatcaggaaatggaatagattagaagggtttcaaaaggttaagttcacaggttataaggaaagagtgacagagaagaaaaatgagagaaatgtatcacagattactcttaaatttctggccaatgtgattggatttctggtagtgtcatttgtaaagatgggtcactctggaagaaaaccagcttgggttaggaggaggtagataatatgaatttgttttgaacatgttcattttgaaatatttttgagatgatgtgtttcaagagccataaaaagatatagaccctttgaccaagaaatcccaagactctgggaatgtagcctgagaaaatagtacaaactatgggaaaagttatagtcaaaaatgtccattgcagtgttttttaattgaaaaaatgaaagcaatgttaatggtcgaaaatagagaattgataataacaacttttgtacacctactaaatgaaaaattatttagctgctcaaatgattgtttaaaaactgttcagtaacatataaagtgctaatgataaaatgctgttataaaaatagttaaaatattttaaatactataattaaaactgtagaaacaatatgaaataaaactagaaaaatgttagaaattgcttaatagggtattaaaattataggtatatatatcttctttgtttaaaattagtagaagaaggaagttggaggaagaaggaggggtaggaagaggaataagagaagaggaggaggaggaggaaaaagaagaacaagaagaaggagaaggagaagaagaaacaagaaagagaaggaggaggaggaggaaaaagaagaacaagaagaaggagaaggagaagaagaaagaagaaagagaaggagcagcagtggcggtggcagccacaggagcaaaaggagcagaagatgactacaatgcgatgaagatacaatgaaacatagctacttactcttgtcacgctgaattctatgattatatatatgctgatgatcaaagttatgaaaatcatgtgaagggataaaataatgcatgcatgacttagaatttaactttctataaatttaaaattggttgttgattgctttgttcaaaaaattggagctgactcttcctcctcaaaatggagtgaattacaagtaaaattgaaagtacaattaaacctttttaatgatgacccgccaaacgaggaaaaaccctaaacaaagtgtatttagattatatttttgatgatatatgttaaatgcctttgctattatttgcacaaaattccggtttctaaaatggacacttattctgttattaaaattgtccaaaagctaaacacacaattaagaaggcctatactatttaacagttcccaaagcaaatacagttaggtttatatattagtttggactcccttcttattatatgtcttcacttttatatgcctactaattttgtaaaattcaggttaagatatttcatcagtctcctctacatattttacaaagctaagatcaacttatttcaacttattttaaacattataaatcatctatattggtatattttgtcagacatgatgtaaatatgcacatgatggggcattcacccaagacatctagtaattttcttaaaatattttaaatttacttacttgaaataaaagaatatgccaagcgagataagcagtgatgcaatagacaatccgtgtccaattatggtcaggtaaaacaaatttagtgcagtctgtaatttgtataaacaaaaaaatttggttcatatcaatactataagtatctgtaatcccacacatgcagaagttcaaattcagttgaataaactatatttttagaaatatgtgatctgatagccttacaatgatgagtttacaaaccaataaatacttgaacgtgtctggaatgaaaaatatctatccagtgaaattatcaaaatttataagttgtatgcctttttatttttttaataattttttaaaaaattagaagtcaaatattaaatctatgaggcaaaacttttattgatctagattatatactatatgaaactagtattttatattttgtgcaccttcaaacaaatgctacgtgatgatttgttttgttcagatgtaaatgccagataaaggtttattttcaaactgagtttctttttcctttgacaaatttgaagctcagagacaaatctcaatttgttaacttagaagattctatgatctgtacaaatgtgttctttctcatggttttcacttttttatttttatttgtctgcattccatttatttgtaacctaccactttattgtgtatttgtataattctcttccaattcttacctgaataagctgggaatatgttatttataaacataatgatagctggtagttatcaagagcttactatatgctaatcttttaagtatttcccttgtgttaaatcaatccttatgaaaataatgaggatggaatctattcttaccctcatttcatatatgaggggactgaagcagagagatgtaaaatggctttttcaaggtcaaacagctggtaagaagtagaaataagaaatcaggttttaggactcacagttgtaatcactgtgataaactgcctctattacaaacacatgcaaatacatgcaagtgttttctatcgaagctatattatagtgccaaactgtaattaaccttgactccaatgtgtagtgtttaaggatgcgatagttagtgcgaataacctaagacccagtcagaatgagatccttctgctgagggagggacaggactctttaaaccctgctgggcttatcctgtttacttgagcacagtttcagaggtcattctagaaattccactgcaaatggaagattttccttttcttacacttttaaggtatgttttctttggaaaatttgaaaccccaatactgaaacattgacttgtaaattacactattacctaaaaggattgctttttcagtgtaatgacaaaatcaataataattttttccacggatatatttcttctttattcttctcaaattatattatgaaaaggctttataagggaatggaataatgactttattttctttaatacagtattggacaaaggagctgtttaaacagatactgtaagttaaatttcaattcagaattatgacataccttcactttctcgtgggtgttaacattacactgggtataatttgtccatgttctgttgcttgctggatgtctaaaccagtttccatcttggtcacagatctttgtaactttttctttaaaattaaaaaaaaagggaaaacaggaatttaattaacctaggatttattaaatagatgtcaaggagatatgtagatacatttctgcttttacctgatggatcaaagtcctgaaagtaatcagggcagagctgcattgattcagttcctgctgcaacatcgttccagcagagccatccatcccaggttctgttgcagtaaacgccttagtggggaaataataattggggataattaaatccttctacttatacatgaagacatagttttaaaagtggtttcacactgatgtggagtaaaggctatctactgaaaatgcagacattatatgaaaatctatatatagaaattatttggcttcccaccaagtaatattataataatttctcaattaaattctaaattaaatttaaaaatatctaaatatataaagtttagatttaattttaattgtcaaaggtagctatttgtttaataaatcaaatggtctttgctagttgtccttagccataatgtagtgattagcgtccctatgcttaaaataagaaaacaatgggaaattagaaacatgtttaattttagaaactgtatgcttagggcaaggtgttagtattttctgaagcaagccaataaatattccaatatttcctattataccattgtaaccctgaaagatacttatttaggcccctccaccaaattctgactcttcattccttttcttttcaaataaggtagaatgttcaataatctcacatttttctccaaaattaaataaagaacttcttacattaaaatatataaagtttttttaaggcgtaggtaaattaaccgaccaatgttctaatgttgtaacagtctataattaaaaaagtaattttctttttttttttgagactgagtcttgctctgtcgccagctggagtgcagtggtgtgatctcggctcactgcaacctccacctcccaggttcaagtgattctcctgcctcagcctcccaagtggctgggactacaggtgcccgccactgcgcccagctaatttttgtatttttagtagggaagaggtttcaccatgttggccaggatcgtctcaatctcttgacctcttgatccgccctcctcggcctcccaaagtgctgagattacaggtgtgagccaccacacccggcccaaaagtaattttctaacttgtcagatagagatagaaccttgattgctgcatgagatgtttattgtttttaacagatttgcaaggcaatatcggcatttatctagccctcatgaaaatagaacaaaattctgatggcctgtaagttcaagtaaattgaaataaaaaccaacaaaattttaatgtttccccagataatgttttctgctatgtcattttttggacaattatttaaatagtttgaatccatatatttctagataaaatacattttatggcctattagaaaaaaatttcttgatgtagttttagaaagcatctcagatatgtccatatcacagctccaaaagtatctaattcactacagcattggtaatgtgatagagtgcaaggtccagaatttttgaaattgtgttttatggcatttgagttagatctaagtaggtattccatgaaaaaagtttctctggtcaaatggattttagagacacaaagttgaaataaaaatagctctttattgcaagactttctagagtatttaaaattacaaagtacattatgaaacttcaagaaggtgtattatgcaatgattccaaacttctcttaccacagaatacttttattatgaaactttacaaagatattcctattgttcaacaattaaatttaaaatctacttttacataatatacagcaagaaggcttggaagggtttcaaagttaaaaatatctaaagagtgttaaattttattttactgtgagttttacatttgatattttgaagataaccctttctttaaggttgccaggtaaaatataggacctgtttttgttattgctttatctggcaactctgcttgtgctactcatcttttatcttcagaatctagtcaagtatctggtgcttagcaggctctcaatgaatgttatccaaaaaagcaaaagaatatcttaatgcaaacagaagcacttagatttcattaactttgccaccaaatgtactatgcaaagtgtgtgtgttatgaaaaacaacacttttgtattcattatattattaggcaacctcctgtcaagcaggttgttaaaaaaaaaagaaatacacaattacataaactgaaaaagtcaactgtcattaagatttgtgtttttgtgttaatattaatacttatttgatttaaatatctttgtaccataaaaagaatcatactaaaaagatcactgtcacatatttttattgtttttaaaaagcgatataacatgatgtcataaaatgttcttcaaacataattaaaactgcacatatacaaaaaggtagcaatctatttttaataatggacctaaagcacttataatgatataatgggagtagttttcttttaaaaatatgtcaaatgcatttacaactaagtagccatgcttaccttctgcttgttgaatggggtcttgcataatcttttggtaacattcatattgagctgtcatgattttatttctagtaactcccaactgaattgagtcctcaggactctcttctaattctgctgtaacaagaatctaagggattaaaaaaacaacaacatcaacttcatgaaaaggattatgaaaatgtgtttgtcaaaggcagtctgtcacagtagaaaacagcaagtgcggtgatgtactggaagataaactggcgctctagggaaaaaaccccaatttgtagtgtttgctatttccatggtataaatatccccaccatgtccaatttcaaaacaccaacaagatgtcaccattggcagagtgggaaaccacagttggttctcagaagcctgtggtagccagctccaggacattccttaatatgtgttttggaatgtagacagagatgtcttccaatctgacccgaatgtttttcctggctctatgaatgaaggcaagatattgtctgtcccctcccccaaagcctctgcttccttattgtaaaatagtataaaatagcatcaagataacagaggagacgtatctggcacatggaaatacttacaatgtattgccattgtcatgatattttgataatcaaaataatggcaacatcatttatgatgttggtaaatagaaatttttcttgtatgcacatcaataatgtttttggacaagttatatacttattttcttccaatatagtagcactattttaagcttcaattctactttagtttccacgtgactttttttctgatttataatatgaagcccgaatagacctcttttttaacacttttagcagtaattgttgcataatttctattaactatatcccataagctgttatcttcctatccttcctttgcctcctcattgtagtatttcttttttctagcaggaagttgaatttagtaaaatcaaaatgacattccctcactgggtagcacctctcaagcttaagttttaccattgtgtgaccaccatttaacaataactctttcattcctttgttgttttaatttccaaataaagatttatgcagtggtagtgctacacaagtaatacatggaaatgtagaacataaagaaaattaatatatttgaaaagcacgtaactcctgttcttcccaaaaagtccataaaattgcaaaaatccatatgatttttatccctacttggaacacagactctgatttgtacacgatcttacatgagttcaagaggaagagtcacaatttcttaattacaataatcagttgctaatctgttacagaattacctgcaggaaagtaatgttctatgcagctcgctcagtggagggtgtgagcttaagtcaacttaaagataccgtctaagaagtgcaggatttggactgctcctagacttggaaatatttgctcctagacttgaaaatgttttcaaatacaaatgcggacaggaatgtagtcttgtttttttgttttttgtttttttctggtttaggttttctgtattctcccaagtttctttgtttccatctttgtggtgtttgcttggaaacacctcaagaaaattcttagctgccacaggattagatgagagtatgtctcttggtttttcatgtttataatgagataagagcacagtcactgttttattttgaggtagagaaaaacatgggtgattcattactataattaaacataaaattaagtgtatgaagtatgtgactcctccagcagagcaattgagtttttgtcttatttgcctaccttccaccttgggccccatatccccattgtatacatgtagaggggcagatgagtgtgcagacttatgcacacacttgcctcaaatttaacatcaatgtctgctaatttgaatgaatgattgaggaaattaatttaaaacaaagtgtatggttctaaattgccttgcaatcaagatatgtcaatcaactggcagaacgggagaaacatcaatgagagaatcattttttaacagatctaactctgaatctacaattctggttgaaaatattttctctactatgtacaacatgtaccatagagtcattccatttttttttcaatctctgattactttcctctggtgtcttatgcatgtgtgtattcatctttcccattctgatcccctccaattccttctcattctatacctgttataggactaaaagcatacaccgaatgaaaacacattattgctgtatcaattggatataaaaatgtaactaatttctgtatctagtaacttcattaatattctttatcaattataggtatactggaagcaataacagacataatcatatatatttttatgcttaccataaaaaaaggcaagagaaccagaaaattcagggtacactttttctccatcattaagccaaaatgaaatatgctgtataacataaactgcaacagaaaataaaagaaatataattcatcaatatttatgaaataaatgcagatgattctcaacagaaaatttattttaaaactacacaataattcaataattttactttaaagatttgataaatcattttttttaagacaaggtctcactctgtcaccaaggcctagtgcagtgccacaatcttggctcactgcagcctggacttcccgagttcaagcgatcctccctcctcagcctcccaagtagatggattacaggtgagcgccaccacacccagctaatttttgtatttatagtagagatggggtttcaccatgttggccaggattacaagtgtgagccaccctgcccagcagattaaaatatattaaaactgcaaatgtttaagagcattatggtgtcaaatgtttaagaacattatggtgtcaaatgttaaggagcttataaatacattttaatttaatttaattagacttacaaacagaaaaacttcttatagatagatagatagataagtaattagaaaacaacttgcattttttgcctttaccaaaattgggatcaaattataaaggtattacaatagagagtttttcatggacataaaaaattttgatagcatattttattataaagcttacctttatttcctgtaagtattaatctcattttcaattttctgactcttcagtaatttaaggaaggaaattgttctcaatttcttgagaatcaacatctatacatcattaaaatgtctttataatttaatagaaattattcttcactactgaaaatcaattttttaaaattaggaaataaaagattccctaagtcatctacattattcaaataaggtttcagggagtgaagagtatcgaataaaatatttgtttgaatatttttaatactaagtacaattctgagctaatgaaaaatggcctctaaaatgctacccactagcttcctaattctaagagacaagaaatgctggagtgtttttccaaatgcttacaccctgtgaagtccaggagcaacctactccaacatattttcaggatgtagccataactaaatgatatggtttggctcagtgtccccacctaaatctcatcttgtagctcacataattcccatgtgttgtgggagggacccagtgggagataaatgaatcatggaggtgggtctttccactgctgttctcctgagagtaaataaggctcacaagatccgatggatttaaaaatgggagcttccctgcacaagctctcttctcttatctgctgccatgatgtgatgtgcttttcaccttctgccatgattgtgaggccttcccagccacgtgaaactgtaagtgcattaaacctctttcttttgtaaattgcccagtcttgggtatgtgtttatcagcagcatgaaaacggactaatacactgaacacgcaaacaatatttttaaaggagagaaaaaatttccgatcaacagatatttgccactgacctgtaagcttagatttaattttgttaggaaactagtaatgattttatgacagggctaatttgggaaaaataattataaaaacctttttacgtgttcacaggttttgcttattattcttcttatgacattcaatgacagcacactattaattgtcacacacaatttgtgccattgctagccctcgccaatgactcacctagaagttgtagcaatcttgttttatagcaaccttgtcaagttgtggttgacaaattgaagtttgcagcagtcttgtcaagttgtagtagttttctttttagtggtagcaatctttcaaatattgttttctataggctagtatgggtttttattattagacgatcttgagaaaaatataaccaaaataccatgaatcattgtattaattttaataaaagtagtgttgttatagacagaaaacaatgagtcagtttatttaattcagtaattaataagttaatattttagtttttattaaattttaccatgagaaaatttaatttcccaatacttacatgcacaattgtctccagtctcaaatcacattttctcttggatcatatttgacattgtctttaagaatttcttaaattcaggggtcaagacctgaaatattgatgaatgtaataatttaatattatgctaatgaccaaaattatttccatgataaattaaaaacttcaaagaaaatactgctactaagatcatatttttattgaacaattccaactttgaaaagcctcttttgcttacaatatatttgggttattatatagcattatattcacagcatgggatgtttcaatatgaattatagatctatattatgagaacacacttggtctagaaatgtacatattttctatgagtaaataatttttaaagagtaattatgtcattttcacttgaaaaattgttgattttagatatttacatttttttcatagaattactaaaatgttttccttaggcatttataagttagataaatatttctttatttattgtatctatagtcatataattccacaaatcattctaaattatactgcctttaaaaataaattttgtgttttaatcttctcagtggagctttaattattatcaagtattaatagcaaggtgaaagaaagaagagttgttttgtttttggtttttatttttttgtacacattttttgtggaagagttgaaaatagttaacagatacagtaactcctaaaactctccttatcatattaatgataatttactaggatttctgttaacaaaaaattaaagcaatttacagttcattattagacaatactcttacatgcacatttcacctggaaatgtgatagggaatgatactggacactacagatttgttgtgaccattaaatgattttgactatattgtggagccctgaaagttcccaactcatggcatactcttggctaagttctatttcccatgcaatttaatctaacctaatgaaatgccaacctattcagctttatttgttagattaatataaaaatttactttatagattctatatacaaaatcacttctatatttattaacagatatattttattttaaattgattattttaaacaatatcacattctttataattatgcattttgcaaaactctatcatttaatccatccctaaatataaaaaagtaattgatttttgtattcatggttttatataggcaaaattgcttttgcaaatcactgtttggtgtttaacatagtacctgacacaacctgagtgctcaagaaatttttgctaaagaaataagagattcaatactaaataaatgattgattaatagagatttaaggattctttctgatgggctaatttctttctcattgtctgcactttataaatatatcatacttttctctattacttcttcttctttttttttttttttgagaaagagtcatgctctcgctctgtaccccaagctggagtgcagtggtacgatcttggctcactgcaatctccgtcttgcaggttcaagagatttgcctgcctcagtctctcgaataactggtgttacaggcgcccaccactgcgcctggctaatttttgtatttttagtagagacagggtttcaccatgttggccaggctggtcgcaaactcctgagctcaggtgatccacccgcctccgcctcccaaagtgctgggattacaagtgtgagccaccgtgccttgcctctattacttctttaataatcactagtatgtttcttagtatgaatgaagatagatagtaacaagttaatgtggcaaactcaaccattttatccctaaatatatagaaaccaatgaagcagagctcacatttctgaagttatcacatttttccatctagaacttaaagtataatttatattagaaaagttacaacaatatcccaaaccagctaagcatagcaacttttttttcagatatattttattttaatatttggtcataatttttttacaaatgtttgttgttttttattagatggagaaacttacatcaattttcattttttcaggatggtggggacactgggtaatctaactgaatattttatttaagtaaattttaaagaactaaagtatggcaaaaagccttttgaattaaactatagtttgatcttcctttgattaactttatctacgaatttattggaatgtatgattattattagtaacgtatctatttcccttgcagatatggtttcatatctgatttatctttgcatcctttgtgactgacagttaacaaatgtttaccatatacatgaatgagtaaatgaattaaaacatgaaccagtaaagtactttaggatcctaaagtcacaatcaagaacactgatcataactactaattgtaatttattttattagaaagttttagacagtgtttgaatatgtactgacaatgaaaattgttgggatgtttcctatatctacaagtctactttcttacaaaataaaatcctgaaaactattcagttttgaatttgtgattacttagatgttaaataaacagtagttttctgtactgcatttggaagacataaaggttaaaccacatttagggcactgtagtacatatttaagatattagtagttcatatttttctgaataaaagtatatatatttaaatatgctagtaacaatgtaaataaatattattctatgtaaaaatcacgtatgttttacaaaataattttttaatgatttacgcatgagtcaggattaaattacctttaatatgcacatgaactccaaatattgaggggcaaagtgcttcaaaagtcatgtctgaaggttttccaaaccccacatatttgaaacacatttcatccaacattaccattatttttgttgcttatctaataggcttcaaaatcagagttccaaaaagtatcttagtgaaatatctcttagtggtaactaaatcatcctgacatcaataattaaaaagtattcaactcacaaaatatttattaatgcaaataattccacttttatagctttccttctttaccctattccctaatgatctgaaaattgtgctactaggaataaggtggtatttttcactgtgtaaacttgtgtattcctaatcaagggggcaggtgtatggcccctgggtttgtcaaagatagagcagcaagtttaggttagcagccattcaaacacataatgggcacctgtacactccatgagatctagcaatgaccaaatcatttggtagtgcaattcacttgagtcatctactttgcaaaggacctatcaaagtttccttgccagcagacacgtggtgagaggtagttatggaggaatcatccctttcaccaagaggtctcaaattccataatagatgaatcatggcaaggcatgtgcataatgccattgcaaatatagctgaaagtcaacttagatagactctcatactgggagatgaaatgatgacattgttctcaggagaagtatgtttaactgtaatccttggtttcagctcactggttctctgcatactgcctctaattggctgattcagcaagtacttctctctatatatttagctttttctaaatatatcttcactaaaatacaattgatgctagttaaccaaagctgttaagcaaatcatttttaatctctttcagatcttgttaaattatttactgataattgaactgcatgttacatcatgaaatataatagtttccttttaattttgaggacagaccaagcaaataatgaaaagaggtcaagttaagtgattaagccagccagagaatttttccatatgttccaaggtttgtttagtaggaaaagaacttcagagttgtgaaagctctaatttatactgttaagtaaatttgtaatcatattggcactgctagttgttactggcattttctcttcaagagctgctagtctcatagtttctataagtactattttattttcctttttaaaaattaaactaagtggtttattactggaaatgagataattttctttactatgcaaaaagaattttaaaagccctttatttcaaaatgttttccatgctttggcccccaatatcttcaatattaaaataaaaatgatatatttcatcacaaaaagaactgtgaaaaataaaaatgtcttaaaatctgaaataccttttgaaatattactgcctagtcactcaaaaatttatgtaacttacaattctggtttaatttcttaatatattatacatctaccaagacaattttcccaaatacttaaattttaagagggcaatcttcttgacatgcaatagtgtaaaagcatgttttattgtacataagcattagaaaccaatgtgacttaatcaatatttataagaacacaaaaaaacataaatcctgaacatgcaccagtgccttgcaagcctatttcttattttctaaaatgtgtattattcctatacatactttccattaatttatgtttctttataataattcttatttttcattgagtcacctagccctaatattgaaagtgtatgttcactccaacattaagaaaaataataacctaatcttttgtttctgtacttttgaaataacttcgatttttacaggctctaaaccatactctgtttttcatttatgtatccattcactaaaagttggctaacagaagtactttctacacatacttaatttgccataaggttcacccacctgaacctttgtgtgagcaaagttgagctatgtcctatatattatattacatgctttcccttacttatggcatattaaacaagctacatatctcttgaatcaaaacaaggaataaacactctactccaatcgcagagttccacacctgcatggcaaatggaaacttatttcaatcattctacacaatctaaaaaatgtcaaagttcaagagcctggttaacttatttttctcactgcttatttttggaaaacctaagtctttgtgctagaattgttgttgcaagttaatatctttacttccaatagagtctttttattatttattattatttttttagagacaggatgtcactctgccccagctgaagtgcagtggtacaatcatagctcactggtgccttgaactcctagtctcaagtaatcctctcactttggttccccgaattgttgggattacaggcttgagctcctgcacctggcctccaataaagtatgaaaaagaaattccagtgtaaggttttagtgcccacttcaacctagcttggaatgtcactcacacttttaatatataaagcagttagtgaaacaaaacataaagaagctttactttcctgaagacatgttacggatataagattataactcaagctgtatgtcctctttaggatgtcatttgagtcatgcattattttttaagctattgagtgagcaggtgccaaatcactgatgtagtaaacaccatgtcctcaaagtgtgaggttgtgggccacctgcatcagaatcacccccaaaacttggtgaaaatgttaaaatggccaggccccacaaaggacgctctggaacagaaccttttggagaagaatttaggaacctgcatgtttagtaagcacccaagtaaattcttggcctgttatacttggggaagcacaatataaatacttcatcctcactgggacatgccgaaacctgaacacatttgtatttcactgtttctagttactagccagactattttaaaagcaactataaagtataaatcaagcaaaatattctgcagtgttcccaggcattattaatgtcacagaactcccaaagcaagttattcaaatatctattttaaaacataccatgtaatcttataattatttctttatgtgtctctgccatgagattgtgagcacagtaagaatagggcaggcagcatattcatctccggggctacacaccctaacaaagtgatcacataaagagggtatacagaaagtgtttttaaagtagattgcttatgaaataaatttaatcaagttgaagaaacctgatgtttttagttattcctaaccctttcaagcctattataattttctgagtcataaaaaaagatcattgcctcgattctactccaaaaatttctgattcaggtcatcttgcttggggaccaggaacaagcattttttcaagtttcccaggtgattttaatatatagctagggttgaggatacctggaatagatagaagattcatgtggtaggcagaatgataggcatacaaaactttccatgccctattcaccagaatctttgattacagctatgatttaggttatggatcttaaaatagaatgattgacctaggttatcttgagttatccaggttagttgcaaataataaattgagctcttaaaagaagaaaagaaagggtgaagggtcaaagagatgcagcacaaggggaagcagaaaagatgaaagcctgagaaagagttgattccttgttgctgactctgctgtggagcccacatgcaaggactagaaagtggcctcaagccagcaaggaaatggggacttcagtcctacaaccacaaggaattgaattctgccaacaacctgaatgagtatggaggcaggttctcccccagagtctacaaaagggaatgcagccctgccattacttttattttgaccatgtaacacttgaaacaaagaaacaagccaaggcaacagaactgaccaatagaactgtgagatagatagtaaataaatgttgttttaagttactaaatttatggtcatttggtacagctaggatagaaaactaataaaaatccttacctgacaaaaattacatttttttccatcaaaccaaagtagtaactctgcttcccaactagccagtcattcctcttaaccttaacaatacattcatcctcctgcaagacaatcccattagctagaagtgtttcttctaagctgcttctaaattgctgtgtaattttaagaaaatcaactcaactattttctgcttggtttactcaactagataatgagtataaaacttgatcgttaattgagcttcctgttttctgttgcatacttattagaagacacacactaaagtcaaagaaacatatctttaatgccagttcttatacacttaaactctctcaaccgattttctaacctgaaaatttgcataaaagtagtggctgtttttagaaggttaatgtgaccagtaaatgagataatgctaatcaatgcctggctaaatcaatgttgcctataacttttatcatagctcaccttgtcggattattttaagtgttaaattacatgctagatataaaaaacttgcttaataataaatacacaataagcattagctattgctattttctgtatccctctataattctgttagtcatggcagtaatcatgttgactgaacaaaccaggcaaatccagcatgcaaattgtgacttggccaaagtcacaaagatgcttaggtctgactccaagctcagaactcaggttttctgaccttaaatttctaccctttgccctgtatcatactgactcggacaatggagttgtttatttgcataaagtgaaggacacatttctattttgcttattcagttattttgcttaaccaccagttttctcattacatgtcacttgtactcatcaaacacatttatactttttcccaacaatttcttcttttcattcctcttcttagcaatgtcatattcgattcttttacaaagcttacattaataaatggcttgacaactcatacttgccattctggcaaggtcccaaaataaaaacacatgtactgtctcgttttctagcactttaaaaaatgcgttttaaatgaagaaaacttcttctagaaattaaatttgttaccttaccctatttattgagcatctacttttacctagtttggtagggtgaaggtggtgagatatgttaagatttctgccctcaataaaagtatttatcaagttgaagaacagtattctactgcttttgaggcttacttcattgatttcaaacactctccatggaactcattcatgaggttctagcgagggatgattttatcaacatttaaaacaggaagttagtgtcttcctcagtcccatctctgtcattcattgaacctgggcaaattccatgccttcccaggtgtttcctactcatcaaacaaagcattagggtaaaaggattaagccttgggtaagagttcaaaatttatatgaaaagaaaaaaatgattgttatacagaaacagtttttactcctagtaacctaaagccaaaatagccttaaaaccaaatctctcctgacactgtttgttgttgttgttgttgttgttgttgttgtttttcctgtggctcaggaagactttgtgtatgtctcctactacctaatagctcacgggaaaaagtggaccatttggctaatttttctctcattacatgagaattcagggaaaacatatctaggccaaaaaaaataaataaataaagaaaaaaatcacttatcttgctctcacctcttcatatactgcctcttttgagctattcttacttttgaaaggccattcaagaaacgtctagttctctcttctccactgcagaaagtccaaattagaaaagcaagcacacttcttcattagccccctttccagatgtctcagaatggaatctggtaagttcatgtaccctaagctaaacttattaccatcatcattggaacaggcttaatgcttataggactagaaattaacattttctgaattttggctacattgagtttttatcttctttgcatttaagagaaaatcactaagccaagacttttaaatatgcagagtaacagaaattataagacacattaaaaaatgattcaacaatgtctaaactcaacaaagtaatttaaaaaaagaaaattattacatttaagccattaaattcctatggatgacctggtatagaaattgccaatttttaaaagtcatcaaaaactctcatgaaaacttctagaaagtattttatttttgaagagatgcctaaatttaattgtaactattaaaatccacattaaaattcatatataaggaagtatatattgttaatatcgtctcactggttaatgatacagtttttctttttccaaagagatactgaaatttttaaagtagtatccaactgatatttaataattcacataatgaagggatgatgtctaataccagttacaagtagaaacagtagttgtactggttataaatatgagttagacttcttgtttttaaaatccaactcagtcacacactagcaaattaaacaacttctttaagaatagttttcttttctgcaaaacaactcctacaccagaaagctattgtaaaataaaattagataatacaaacttcttagaatgcactaaatatgacttattataccacattaaaatttttgtaaatataagtaagcttattatacatattttcatttatttgccgtaatttcaataacactgtatgtggaaaactgactgtatttcaaggcggtggtcacatgcatcttgagtttttttttatcttctgcagaaataatgtggttgttttttattctgtcatttaagtagttatgaaaatatcaaataaagtgaattgtaagtatattcccagataggatatcaatctagttaatatgactgcacaattactaatactgagcctatatataacccaaagctctagcaaattttttataacattgtaatcaaatatggacttcttaaagaatataatgctaagccaattaaaaataagacataaaacctcccaaattttactttatttttttgttttttatttgtataaatttaagggttataagtgcacttgtattgcatgaatatagtgcatagttgtgaagtctgggcttttagtgtaaccatcacctgaatagtatacattgtacccattaaataatttcttatccctcaccccagctacaaccctcccacccttctaaaccaccaaagtttattattccacactctatgtctttgtgtgtacattgtttagctcccgcttataagtcagaacatacagtatttgacttttttagttgtttcacttattttaaattggttataatagcctttcctaacactgtactggaacaacaaaagaaaacattgaccctatgcttacttgcttatttaatgaacattccagattgaacagttgaataactattaaagagagataattttgtgattaagtttgggacttcactttacactgtaatgtacttactcacgggactgattttcccattgtgggcataattagccattttccggtgattttagtcaccctctttttatttgaaagaggcaagcggccaaatctcagcccaattagtaaaaggtggaagggagcctgaaaaaaatgctttgtacttgatggaacactctccctccaggagatctaatatggaaagaattaattgctcaaagagcactgaaacaaaacacatctttccagctctttggaatgagagccttatacttattttccttccacaaagtcaggagtcaaatgctatgtgaaaacatgtcttgttttgtttttcccaccaacaataaaatcagaaaatatataattctgatataattttaagttgcataccagtccataagcaaaattatgatattcttgttacattgagctttccaatcattctcaaaataaaatttatatggcacctactagcacattccaacttttaggaggtagaggaactctgttgatactgtctgattagcacatcttctttattgcccttaataaaatgaacctttttccctatagagaatccattctctctggttcaagtaagacctccctcttgatcactgaagtaggaactgattgaaatctggtcagactagcacaatcctctgattaaatttagcttggtcatggacatgtgtggtccaaccaacaccactggaattctccctgggacatttgtattgttgttattagggaagctttttctttctgctggggttgcaaagcaagtagggcatgaatatcagacgattctcatgcatccttcctatcatacagagaaaatgttaaaaaatgtggtcaagtgaaggcaattagctgagattgaggattggtggagaatccaataacattagagccctttaatttggccgtatttgaaggcagatacaattctagaaatcctcacaaattagccattaaattacgttttatgcctaactgatttatttggagcagtgtagtggaataatcactatgtgtggaataagaaggctccattttgcattctgattgtgattgaatgccctgaatattcttaggttagtcactttgctgggtcttcgtttcctgacctgtaaaatgagatggcttcaagcaccttttcatcttgtaatgtagatatttacagattgttttctttttcacaaaagaagaacatcatcttttacacccaaagcacattccatgcccagcaaataggagttcaaaactgacttttttatccaaatacatctacggagtaatttttttctaaagatgaaatagtcttagcagtatatgctcttggataatccacaactaatatgtacctatggcgagatattcatacccagctcaaaaagtaaatgcaactcttagatgaaaacataagggtaaaatgtttgtcacctcgggttaggcaatggctttatagataggacattgaaagcaaaagtgacaaaaaacaagtaaattagatgacatataaattataaactttgtgttcaaagtatactatcaagaaaatgaagagacagcacacagaatgggagaaaaaaattgcaaatcacatatttgaaagcgacttatagctagaatatacaaataaagcttactgctcaataataaaaagaaaaacaacccaattaaaaaatgggcagagaagatatggagtcaatctgagtgtccatcagcagatgaatggataaagaaaatatggtatagacacaaaacagaatactattcagccataaaaaagaatgaaatcttgtggcatcatggatgagctggaaggacattatgtcatgtgaaataagcccagaaaagaaagatgaatactgtatgttctcactcatatgaagaagataaaaagttgatctcatagaagtagggtagaatggtaactactggagtctggggtgggtagcagggagagagtgatatggagagaatggtaaaagaatacaaaattacagctagataggaggagtaagttctggtgttgtatagactatggagtaaatacagttaaaaataatttatattttcaaatagctagaagagaagattttgaatgctttgaacacaaagaaacaatataagttcgaggtgattgatatgctagttactctaacttgatcactacacattgtatgtattgaaatatcaccccataaataggtaaaattattatgtgtcatttttttaaaaaaattgatgggcaaaggatctaacaaatactcaataagctcatgaaaagatgttcaatattcttagtcattaggaaaatgcaattccaaaccataataaaataccacttcatacccactaggatagatataataaaaaagagagacaataacaagtgtaagaaagaatacgggaaattataaccaccatatattgcttataggaatgtaaaatagtgtaatcattgataaacaccttagtagtttttctaaatgttaaacatagagttactatatgacccagcaattccacttttagttataaactcgagaaataaagacagatatccaaacaaacgcttgcacacgaatattcttagcatcatttataataattaaaaaatggaaacagctcaaatattcatcaatttgtgaatggataaacaaaatatgatatattccctataatgaaatattatttggcaataaagaggaaggagtacttaatgcatgctacctacagcatgaataaaccttgtaaacattatgcaaagtgaaaaaagacagtaaaaaaaaagaaacatattatatgattcccatttatacgaaatatccaaaataggcaaatctataaaggtgaaggagctattgggggttacctaggactcaaggagtgtggcaatagagagtgattgctaatgggtacagggattttattcagagtaatgaatgtgttcgaaaatgatagttgtactaccttgagaatatatacaaaccattgaattgtattcttttttcctttatattttaggctcagagggtatatgtgcaggcttgttacatgggtgtattgtgcaatgctgaagattgggcttttaatgattctattgcccaagtagggaacatattgaattgtacactttaagtgagtgttctcatgaagtgtacgggtatagcttagtaaagctgtttttaaaaaagtaaatgccaaaaggccatgtgtatctaaggaaagacttaatgctgatcatttagtcttctctctcacctctcctgccttctttagttaagagacagatgatattcacattgtaaaacaaaacacatcgaccaaagaacctgcctagctaacacagcatatcatgcatgtaaactctgaattactccttcagttggatacattatttcatattcaacaacaaattaattctattttatatatatagaactgctttgatttgaaaaacatacatttttcttgaaatttattttcaacaactaatttttaattcatgcacaaaatattgtctttcctttgataaataaatttaagtttataaaaataaccattgtacatagttgagggaaaagatctatatacatacttagaaaatttcccttaattttagataggatctataattgtttatctttttctcctgtcagtgatttcactttacagattttaatttcttataggagtggagcactgacaatttacaaacaaaaatgtagatattttattatatttgtgatttctgatattttaattgtgttattacaaatagaaacatcaaaaatacaagagaaatattagcaagaaaaaatgttgaactttggtttattcttggaacttgacctaggttagaaattttacatcctaactatactccttctatggagctattacatggtgaaagaaaactaaagatggaaaaaagaaatcaaggaaagaaggaaggaagaaaggaagaagggaaggaaggaagaaaggaagaagggaaagaaggaaggaaggcaggaaggaaggagagaaatcaatatgtgtatctcaggtaaatgcacactttaaaaattgttatttttattaaaagtaaataaaatgttgatatactaaaatttgtttctctggtgtgtctcaatttcttacaaatactagatataactccatcttagtaccttttactatattaatacattcattcattcaaacatttatttaaaacctcatatgttccaaaagttatattaagttctagggatccagaaatgctaaaaatttctgttttcagagatacttaaaactttgtaggagtagaatgatatgtacaaatatgagtaataaagtattataggtactcaattaaattttatgtgtctaattgatcagctggaatgatgcattttacatggaggaagtatgtttgtgagtgtgtgtgtgtgtgtatgtgagagagagagagagagacatctacgtagagaatatgatacttttctggagtgtggacataccaggtgcttgagagatgcaggatacatgagatgagagatgaggctttccagtaagacagaaaagcagattaatggtactttctgttgtactgaggagttttgatttaatgctctaggatagatattttcattttgaatatctactctgatttgctggtagtggcagccagaactgctacactgagcaatgttaaagttaatctagtccagtgaatcagaaagagtctcctgagtcattaacgatgtctgccatggcagcatcctgagaaggaatggcatgtattccatatatttgctaatgctgttgcataaaatgaataataattgtaggaaaattatgcagtagagccatatgacaaaattttcattttagaaacatgaaatatgatggtatttggaggtggggcttttgggagataattgggtttagacgaagtgatgggattaacatccttatgaaaagagaaagaaagagataggcaatctctctctgcatgcaccaaggagagaccatgtgaagatacaacccggaagagggccctcaccaagaatccaaccatgctggcaccctaatttcagacttccatgctccagaaatgtaaaaaataaatgtttgttgttttacccaccaagtctatggcaatttgttacagaagccttaaactggtatgatgcagaaaaatatttaaaagagttattttaaaaggtttcgtgtataaggatgtgagagcttggcaagtgcaagtaaagtaaatggattcctgaaattcaatcatgggtatctgagtgggttccaatcactactatagagaataccatagaataaaatgggtggtggggaaatacctgagtgcagttctcacatcttgaagaaaaaattgtccaggagggtttttctgcacagttctgtagatcagcaaaggagggccttgaaatagaagtttcacgcccatcgtcataggacacatttgcagttaaagaaaggtgacattttgtttggaaaggcagtatgtgctaaaacatgtattggaattgaattataacatatttcaaaacattcgtgtttaaggaattcaaagttagtaacaaggtgaactggataaagggcagagtttgctaggtacaaggaactaaaagtacaaaggcatgggtacagaagtgagtgcagctgtgtaactagaggtaaaaggacaggcctgtgagaagcttgaggtctctggggaaattaataagtggaaacctggaaatgtgacttcagtcatttactagacaaagtaccatgaactgctgtaattttacacataccaaacgcagcttatttttaatcatttactcctctgactaagtctgggttataatttaaaaatagatcttccagtgtaaaagaagttgcacaggaaggagatccttgctgaattaagctgtgcttaagtgagaactgccgcttaagaacaacacgttccctgtgaaaaaagatggcaaatccatttcagtgagcctaacctttaccaagtgctattatcaactcaattgtatgttttttcctgtttcacaaacatgttcccaaaagacttttaaaatagctttctttcctgctaaattgttgtgccaagcactttttctgatttgcacccttaactggaccaggatgtgttaaaaaaaaatgccccgtcatgcttgacagagtttaatagaccttaacaacaacagcgaaacattttcctaatgtgactgtccctccctcaccgaatcttaagatggtgcatttttatcaaaatataaaataccctgaagaaactaaagaagcaatagtgtcttaaaaagttactctattaaataaaaacatctagtgaaaaatctgtccaccaaagtaagattttgttttcctaacaaagagaaaaatgtcactacagaaaataaagttttttataaaagttcaaatcatctaaaaaattaatgatatgaaatggttccctaggtatcttataaacacttttatttattttttttttttgtagaaaacacaaccataacatcctggggtctatcttggtcatttcaaaatgaatcccatgcactgctggagtatttttctcaaactgcagcttggctcgtagtttaccgtgtgtgtctgtctttccagtgaggagtttccttactaaattctttctgagctgcaataacaatggcaatctcaaaagaaaaaaaaaagacgacgaaagtaagtaaaaaagaaacagcatctgatggacactggtggaggctatggctagaaaactcacatgaatgaggctttctggagcaggagtcagtatgggtatctgaatagtatgctgctttagacagcagataacaacaatgaaaaataatagcagtagggacttgtaccagaggaaaaaaaagatagagcagtaggaagcgagacacagggcagagagcacaggtttcacacggagcgactctgagtttggatactagggtttggataccagctgtggaactgcagtatttcctaactggaatgcaggcagaaacctaacctgtaagctttaccttctgtagctctaagatggggaaatacatgtctcataagtatattgtgggggttaaatgtaataacccacacaattccatatcacaaggactaggaagtgataactgctaagtaagtggtggtctctcccctgcagcagaaatggaatgtcttggtttggtttaattggcctcagttagaagacttataattttgagtaaaattatatgtgaacatttaacaatgccaactttcccagctttctgtaaaggaggctttgtgagctcatgaacacatggtaggattttaacatattttagcgtgaataaggatgggcactgtctccaaaatcacttgttttctcaccaatactaattgtctctgtatgcataacactctgctttgttacggagtaccttttaaatatatattaaccttcccttctaagagtggtaataaacaccagtgttaaagtctcatcttttctcatcatcccgaggacagtattgttaaggaggtgaagacatttatgtcttgtcacaaacacagactctaaaatgacttgtgtatttgcattattactcttgatttgtatttgtttcatcaattcctagaggaagagcaaaaccagtgaaactgaaggtgtgggattcattacctggaattagcactcggttattagttggagataaatttgtgcaaggagataaaatgcagacggctgaaacagtaagaaagaaaagcttgcagccagcaattaagcttagcagaaagtttgttagtttggaggaatggctgctgtgttcctgagatacttagtatgcaataactagggaaatcacttaagaagttttgtccttatgaagtacttccattggactatttaagtcctgtgtgtgtatacctgtgttgtctgtatgtaggggtgtgtgtgtgtgtgtgtgtgtgtgtgtgtgtgcattcacatgtgcatatgttttaaccatttgggacaaaccaatgttgtgtctgttaatataaaatagtaccagtgtggggctctgaagcagttgggctttatcacctcactcagaatgacttgtcaaaacttgacaccagaccaccaaaccaccattcccaaccaacacaaaacaaaccaaaccaaacacaaccaaaaaaaaaaacacaaatctgatatgttgtatgtgaaaaacatcagttcatcatctaaaattattgtttaagctcaagagcaactcaaataatttcttggctgtaatattgcatatattttgttttaactctattttataaaaattatttgtaagcaaacgtgttccttgaaaaaatggaagtaaatgtactagtgtaaatgtacagaatattcaatacacatgtcaaatttaaatttctactaaaatcgtcatcataaaacatatcttaggtgaattctgtctctgcaaatgtagaacaccagttgctaagaaaaagggaaaggcaaataaataaagaaaataaaagaaaaggaagcattgagaagtctaactgtatatttttatttttatctatttttatctatgtatatgttatttttatctatggtctttgtaactaaccattcctggtaatgctgtggttggtactcaaaataaagatccaataattgttagaaaaaagatgtggtttggtcactttttgctgtgtacatatgagaaagagacagagacagagaaagaaaaagaagacagaaggacagtcttacttggtttatttcctactagaataggagtgatggaatcaacattattaagtacacacaaattaaaaactgaaaaatcttttagatgtatgcagaacagaattttggaaaaaatggagctattttgtacaataacgctagtagtgtttgtgaagtctaccatctatctttttaggacttaactatcattcccaaaaaaccttatttgaactcataacttctttagtttcgctccaccttatgcctacagcacaaataggctgaatgtgccttttgtatgtgccttctaacagcacactatcacactagataaagttacgtctgtttttgttttgttttcttttttatcttccccactaaaggtaaaagctatttgagggcattgcctttttaatcattgggattccccaaggtattgtctggtattcattaatcttcataaagttttttaatgaataaatacatgaaataattatccattacaaatatgcatccatagtgatgataattaacattgttttatactttacgaagtctgatcacagtaaaacccacatatatttagggagaataaagactggttaagataatttgttttgtctgtttgtaaagtaaataaggaaaagcacttgaactactcaaaggaagtgttttctcacatttttgaagaaaacaagcaaaaaaatagtaggcaataataatattgtggcagttaaaatgggaacattgtaaacaatttcaaatgaattatttcttttaattcagaaataatgcatattcaaaattttagtagtgcattttcgcctattaatcttagaaatttgtgctgacattgacttttatattacgagagaaaaacttcaattttaataatacaagaatgaaaagtctttgggcataaggtaaggactgctgtgcagtgaaagataaatatacaaagcattgacactaaatctttccttagcaacaagtacatatttaggtaacatattgcatttaaaaaattcaaatagcactacattgaatatgaataaatccaggttctaattttaactaaacctggggattacagaggagactgaagtgaggctggttccagcagcaacaggtgtgattctaagacttgttttgcatggtgcattaagctttgctaatgttcccacctctatatgttaactttgtttctgacactaagcaaactctacatagtttgagcaaaatcacaccatttatcttttggtggcctcagattatttttatttaatttgtaaaataagatactagactagattctcaaggtcctttttgttctttaattctatcattctgagggaaaaaatgtcattactattacatccaagacatatatattaatataaatacattaagtattgaaagccaaagttaaaaaaatagaaaaccttttctggttaatttacttcagatatacgtgaaacaaaatattacagtttgcaacacagtgctattttcatgtttatttatatatttatgaaacatttttggattttgttttcagctagggtgaggtttttctttctccttccaatcccttattaataaatgaatagggcaacattctcagaagcatgacagtatatattaaagtttatttaaaacattattgagaaatagagaatctagaaataaaacccaatgatgtttaatatgatgttcataaaattatattatgtactacatatctttcctttaaaacattacgatgatacagaagcctaaatgcctattgcagaaataaataaatgtatttactctaaccttgtgctagagtcctctgttctgtacagaaattaatagtaaataataaaacccccttctatggctggttttgtttttgctcttgggataactaaggattttaattttattgtaatttatgtacaaattctcacatctcagaaaacctaccaggaaaattttaatgaaataaattaagtaatttaataactgtacagtggagataattatattccagccagagttaaaaaatagctacaccaagaaaaataatatttataaatgcagttttttaatcatttttattccattctccttttctctgtgctttctatagtcacattgtgctgtataatattttatagaaatatagaacttgctttttcctaaaaataagtagcaattacattttaaagggagcatgaataaattaattcagagcacataaaatgttcacaactactcttggttagaagtctgaagtctttccttcttcttccctttctttcttccaacactgtaacagtccttgtgagctttttgtaaagaaatcttttacatgtgaatgcagttaattgactccctttaccaaataatgatggataatagccttggtctccctgggaaagtgtttacaacatcaagtcattttttttctccttccactgggtcagcctttcaaatatatttgctttgattcggggaataaccttagtagggtgtcaggatttctctctggatcaataaaggaaacgttattaagatctaaacatctgtcagaagatatttatgaaatacttattttctgatattttctttctaaaatactaggctcaaataactgtaggcaaaagaaatttggtacaaaatatttgagtttatagaaatgtaagtttagtgccatgactgcatacaccattgaagacagcaactgtccaaagcataacctgcagtgaaattattaaatgtcatgctgtaccttggaaaagtttaactttattcacacattcaacaaatgcttattgagccactggtatgtgcctaacacttggctgggtgttgggaaaataatggtgaataaaagattagatgcaggcccttgtgaaactataataggggagacaggtattaatcaaatattcatacaaattcaaaatgacaagatagtcctatgaaggaagaagatgacctaatctggagcattaaggatggttccccagaggaaatggtattttactcacttgatatctgaaatttgagtcctcatcgactagggaaagactggaggtgggacaaggagagtgatttggagggatgagaaaaacataagcaaatgccttctatggaaaggaatggagggcagaaggcaagggagagagctgtgtcaggtgaggctgtggaagatgcagggaccacactaagcagggagtttgatgacttgttaaagactctggcctttgtcttattacactggcaaacctgtgttttcagtagctgaccagaaaataggtggtttagcactgagcaacaaaaatcagagagaaatgggttaagaagtgagggtgaaaacaagaataaggagttcctttgagattttggttttgtaaagtcagaaaatggggtatagtggtggatgtgggagaatctgtagggtagaaagaagagttttgtttttgaatgagagtgacatgaacattttaaaatattaatgggggatccatttgagtggaagagtttcaatgtattaaaagacatcacagatattcaattttttaccaaattggaggaaatgaggtacaaggcagcaatggcaatctgttttacagaagagaagagatatctgccctacttcacaagttgagaaagaaagaaaaaaaaaaggacactgattctgataggcttataggtgtggaaatatgcaggtgagggagctgtattctgtaaacctcttgttttgaagcactggctgttgagagagaagggaaatatgaagtgggtgttagggttttgtagaaagaacagaaggtttgaaagcctgttttagacagtggaggaaagtattgactaaaccaagtaggatttctttgcagggaataaactggtttgagctaagtttaaagtttgctggtgggtgggtgtaacatcagttccacagcccacaggggaagaatgttaaggatgaagaagagctgaaggtgggatcaggggatcatgaggtactatggctcaagacagaggtgcatgtgggccttgataatctgtgcctttgtactttgggatgagagcatggttgaggtagtctcaagaggctcaaagtgtgtgtgtgtgttggtgtcggggcagggggcggggagaggtaggtggggccacaggatttaatgggatttaaatattttatctagtgcattatccttccgacttttatataaaagaataaataaaagactcattattttgtctggtgggtgacagaagaaggaattgcatgaaataaaaatcaacttcaattactcatgaaagctttaatagttggaaaccttgctaaacaaattttctcttttaaatggtaccctttttacttcttgaattcagatctccctagaaatactgaaagaaatgtactgaaagcacatggagaaaaaagacagttgaggtaatcttaaaaaaattaatataaactctatcaaaagttgtaataacttaacattatgtaatatctctatataactataaataagactactgtaaatactactaaattgattcttgttcatgagtgtatgtactaaccatgctgataacattatctgctacacctaaagagtttttaggtgaaacagcctcacacattgctatagttgtttagtcaagcagatcccgtatccaacagcagcaatatataaggtagcaaatgacccatggtatgatttagtgttacaaggatgaatttgagccagtttaaatctctttcaaaattttaactgagaaaaaaaaattatttagtgatggatcatgaaatgggatacctagataaatgctaagatgtagaatcggtgtcaaaacataggataaaggatacagaatcagggccattaaatattatgaggtattgtgacagagacaggagaagcagatagaaggataagccagggaagtagggggtgtagtaaaaagaattacatcctgcctgtaatcccagaactttgggaggctgaggcgggcggatcacgaggtcaggagatcgagaccagcctggccaatatggtgaaaccccatctccactaaaaatacaaaaaattagccaggcgtggtggcgggtgcctgtagtcacagctactcgggaggctgaggcaggagaatggcgtgaacctgggaggcggagcttgcagactgcactccagcctgggcgacagagcgagactctgtctcaaaaaaaaaaaaaaaaaaaaaaagaattacatcctgtgtgcagagaaagaattagcacctttctaacgagaggcattaaggacagagatgcagaggaggaacagggatctgggacagtaatggcacaggtttaatgggagtgaagttactgagaaggtctgcctgcatccttccagttttagaattgagtttcagtctgcgtgagatactgctctaaatctttcctgattttcagaaacattcttacatttcctatttccactagtcaggatagcttgaacgggtgtcatttcttaaaatccatagtctgtgtggaatgttcattatttttctcttgaagtggcccaaagacaagagaaatgatccacagggtagacttggaactgagtactgaaaagggggctcaagagcatgggctccagtctcattatggcatctgacttgggcaacctttgcaaattcgcttatctctctgactcttttctttcctcatctatgaagttaaatatttaagcgaaatgatttctgtctccctctaattctaactctttctggtttcacacggaaaatctgtttattgtattaagcagatcttcataaaatatatgcctgtatctggaatttaaatcatagactattatctgaattattcaagctaagggcagcctctgcttgacatactattttaaaactttttaaaaaaatagcaggtggaagatacaagtgtgaagagtgagagttgaatcaagcctcaaggccttaaggcttaatctaatacaaaatggaatatttaaatactgtaaatggctttcaggttttaaagcctaggacatctcaaaatatttgtcctttggtgactaattccacatatatcaataactaattagtttttattgattgttttctctcaactggtcctattatagttactatggatcataaatatgctttgttgattgttttctctcaactagtactattagagttgctatggatcataaatatgctttgttctctgcaaactttcaatttgtgaggaagacaacataagcatagtaagcattcaatttattggtatataaggatttatctctgtacgttttcagggaaggaattatcaaagaaggctggaatgcttagggttatggaaatagaagctccagggagaggggaaatctaagcttgcccttaaagaaaatgtaggagaaaaagagacagagggagagaaagagaattctagatagaagaggtaacatgagcgaagacaaaagacagggaaaaaaagagtgaacatcacatgggcatagcacttacatctgaggatttcaacaagactgaaacattcattgttttctttgatatcatatataattatatgtgataattatcagctgttatattttaaaccttgtaagtgaatcactatttttatctgactgttgctctatctataactgttatatattttaccagttaatgtaattatatcttccctcccatatgagaaaagcaagagaatgcgataagactataatagaagacattgtaatttacgtgtcaaaaagacaaacctaggggaagactaagtccccagcaaacgatagaaatgattctttcatttggcaattcttatagaaaaactctgcaaagtaattgttaatggcgtgaccttgaaataatcctctttatttaaactataacttgtatgttgacagtacaagggctggcacacaaaaaactgtgatttatatttcagtagatgtaaaataccagagagggaaatccagagttgctttggtcacatttacatcttaagggaagtgagagttatttggcatttgcaaagactggaaatttgcttctaattatggagctggacattgattgaggctgtattgtgttaagctatgaatgtaaactgaggctttctctgtgtctatgtaacttgggcaaattattttactcctctagactcaatatctacataaataaaatgtggataataatattatatttcattttatatcctatatgtgactattacttgacatattggaatgaggagaactcagaacattttctggcacacaacactcaataaatgttaggcattactataatgaaaatttcatattggatatcattacctgtcatctaacaggaggaaaggaaagcatcatatctaaattgggacagcaacataataaatattttatttatgtacatattttatttgtaggccggaagcttctgtctatcatgttttattaggatgtgagtatgggaaaggcatgtaattagagttgcctaagaaagttaatttgcaaatttttatctaagaaagtttctgaatttctcaatagtagtcaaccctactccattcttaattataaaaataactttaaatttaaaaagtataaatgcatggccacattttaaacccatcactcacacgtcttaatgtaggcagcagcatgtcatcctgaatttatttaaaattcactttgcattaagaggagttgtaattattagctgccaagcctggaagagattgaaaacataacctttctttttccataatataataatgcctaaactcaaagtatatatgtgaatcttggctaaaaaatgacatctgactggcatcctattcatgatatgccatcttctatctttatgccaaatatacagtgatacacagaagttgaagaaaaacttatggaaatactgacattgaagacaaattttcctaggactgtagaggcattcttattaatgtgaaactggactaagaaacaaccagtgtctacccaccagacaaacattggcacacacatcatcccaaatttactattttctttgaatctcagagaactgagctgtgccaccagaaaattatttttttttttttaaaaaaaaaaaggtagtctctttttttttcaaatgtttttcccccatccatccagaaaatgaatttcccagaaaacaagaaatacattttctttgttgattgatttagttggttaggtgtggtcactggtgctgtcacaataatctctgtggttaaatgttaatcccacaagtcaaagccagataggcaaggaataaagtagcaatatgttaaggttcctgcaggaagagttttctatgcatcctactggtaaaagtgtgagagctccagatgataagataaaagggatatagaatatatgaaaagtccacactaagtaaatgcttagacaaatgcttcctaaatgttaggacttttgctaaaagctgtgcttatatgcctgcttttgaacttctcacatgaaaacgggttttgaaagaacattagcgaatagtgagcacagccaaggcaattcacaaaatgtgtctgtgggcaagcagatttgtcttcaggccatgattagcaaacaaaataaaacaaacagatttaaaaggtggcatgcttgaaaaatatcaagacacaaaggaatcagaggaaaaatatacatctgaagtgtacttaataatattgaaatgttatataaacttttgtggtatctaacaatgtttgggacaggaaactctgccaatgtgtcagtggtggacctgacctgccgtctggaaaaacctgccaattatgatgacgtcaagaaggtggtgaaccaggcatcggagggccccctcaaggacattctgggctacactgagcaccaggttgtctcctccgacttcaacagtgacacccactcttccaccttcagtgagggggctggcattgctctcaacgaccactttgtcaagctcatttccttgtatgacaatgaatttggctacaccaacagggtggtggatcatggtccacatggcctccagaaagtaagacccctgcaccaccagccccagcaagagcacgagaggaagagagaggacctcattgctggggagtccctgccacactcagtcccccaccacactaagaatctcccctcttcacagtttccatgcagaccccctgaagacggaggggcctagggagcctgacctcgtcatgtaccatcaacaaagtcccttgtgctcagccaataataataatacaggtataaagtattattgaaaaatgctaagagagtggatgttgtttgtagcacaaaatgcaactctactaggtaacgcatatattaattggatagacttagtcatttcacaatctatagataaatcaaaaccttatgttgtacatgataaatgtgtataattttatctgtcaattaaaaataaacaaatttactaatggtaatctaataaagtaatgtttaagcaggacattcagcacttataatttctgtgtgtaaatatctaaaatttttcatcttgaatgatacagagttaccacgtcatactgaatgacatagaatatcttctgtactcctaatttccctgttatcctagtaatagatccaaatagatacaagagtggccctgtttcttacacctaaataaaacttattaaacacagataatattacatacatgaaaaaggagaaaaaataaaaatattgggaaatgtaaagaagagctagaaataagacattaaaaggccttgtattttattaaaaactcttgtgaatgcgggatggtctaaaattttgagtctgatccttctagtagatcaagttaccaagtgtatggtctgtggtatgaaattaatcaatttctaggaagaaatgctattatactctgaactaaatgcaaacagaaaatgtaggattctctcaaagagaacattctgtaattcaatgtatatgtttctcacgtgaattacaataataaaaaatgtggcaagttgcaaagggctgtttcttatgttcatcaataaagacctataatcaggcataaaaaagtattctatagcaattaaatataatgtggtccttcaatctgttgatttgacttcacctaggaatagactttgaattatctgaaaaaataaatgcactaaatatcctttgagtaaccctgactatatattctttctcttgaaagggatttttagtaaatatatatttgataaatacaattcttgacgaataatgagggtgaagctctcttactggaataagattgaaagctttttgtgtctgaaaataaaggccatttactttctatactcaagtgaattttaaaatgtattcccaagacaacgtttttcaaaactaatatatagatgaaaaaactaattgatgtttcaaagatatactcagagtagcatagttaacaactacaactatgacaaaaaaacaaaaaacaagcaaacaaacaaaaaacaaacccataaacacaccaaaggaaagaaaagaaatactaaaagcatcaatggaacccagaaaagctacttttggaatagcttccagaataaacatcttgtgacatttatgctggtgaggtttattattgtatagacttcaattgatttcaatccaaatcaaatatagatttaaaatatttgatgaaatatatgcctgtgttacagataatatatgcttatttattttccaatttaagcataactcttaataatttttaaaacaattttaacatgcctttgacctgtaatgaacaactacagaacctgaaagttgattaaagattcagtagtaacataagtaatatttgtggtaaaatattgatttaaaaataatgtaaactacattattaaagctatttaaataggccatgggagtcagggaagacaaaaggtctaaatacttttctcttcaatattttgttttatggaaatatttttatattgaaataattgtatttaaatttagattttgtgataaaagttaatttaaaggtatgaactataaaaccaccacaggaaagaggataatgtttcaacagttacttgttaatgtaacagtttatacaataaaaagtaacccacagtataggatttttcacatttacaaagtgtcaagtgtttacttcttcatcaatatcgcctacattttcattatttaacatctttgcccaattcccactgtaaccaagtgtatttccatgcagtcaagttactacccagcttagtttgaggttaaatgtaaaaagctttgacgttttctgttctcagagtcctcctgcagaagcctttgttctgacctttcacccacacccccaggacttctattcactaaaaatgtggaattatccatgctaatcctggaattctggtcattaaaagaaaaaaaattgtgtatatcattctctgcatcaatttcaaaagttattcttcacacctatatttagagatgcagctgaagcttaaaaatattcaattgggcatataattttataaaaatagagcgttctaaaaagaattgagaatcatgtaaaatttaacctgtttttactggatctataagtcaatataaaatatttatttttctgtgtacattcccatatctacttaatgacactgtatcatgttgattttgtcttttttctttcattagcctatatattcttcatgagagtaaataaaactaatcgtgtcttaaatatcgacttctattgttattttgaatcttcctaagggtataggtcaaggtttattcattcttaccttaccttctgttttagcatttaagacagctcatagtagacattggaagattggttaaattgctatttaaatgacctagaatacaattgtttaagtaatttaccaacctttgcaaagctgaattatatttgtgtattctgtcaatattacataatattaaggttctgagatgtgttctttatctttattcagcttttcctatattctagaaaatttcaccttcttcataataatttcttagaaacttgtgtttttttttctttttttcttttttttttttttttagatggagtcttgctctgtcaccaggctggggtgcagtggcgtgatctcggctcactgcaacctccgcctcccaggttcgagctatttcccctgcctcagcctcccaagtaggtgggattacaggcacgcaccaccacgtctggctaattttttttttttttttttttttttggtattttagtagagacgggtttcaccatgttggccaggatggtctcaatctcctgacctcatgatccacccgcctcggacttccaaagtgctgggattacaggcatgagccaccaggccctgctgatactatggactaaattgtgtctgcccccaaattatatatttaagttctaaccctcaatctggttatatttgggcatgacacctttaaaaagtgattacggttaatgaagtaataaatgcgtatccctaatctaatatgactgatgtcttcccaagaagaggaagagatgtcagggatatgcaaacacccctgtgaggatgcaataagaaggtgaccctctgcaaacagagaagagaggcctgaggagaatccacacctgccaacaccttgatcttggacttccagtttccagaactgttacaaaataaatttcagttgtctaaccttctagtctatggctttcattatggcagcccttgcaaattaatacagttagcttgggccagctcacagaacttaacaccaaagtgaaagctggcaaaaatttcgaaaattttataagtggaattttttaaattatctaattttaaacacttccttattattgagtaggccatttcatttttttcaaagataaaaacaaagaaatatattttaatttgcagaagagcaacttatgttaactgaagaaaatgcttactgaatatgaagttaaagtaaaatgtgttaaaagagcctcccttaaattattttagctagaagcataaatctgtctctaaacattctgtgatagcaaaatgaatataaatagcatattatgccattataaatagcagttttaagtgatatgattaataactgttagttctggagtcatatgctaatctttgtggaagcagaagctggctcatatactgacaacctctgtttgccctactaataattcaacccctagttgctattgtcacattgaactacaaattcctaacagaaattactccaaaacctaggaaatgaaacagatgctaacatttcaagaaagccttcaggacaagaacattaaaaaatcattttcatgtagtgcttgaagtaaatcaaatctgctggtatttcatgtgcttaagcgatcacagctttcccagccagtgagtatctttaaaagagaggtttctgtctttcatatcaagtattattttgattaaaataatcatttaatgaactagatctggaagaagtcaaaggtcttttataagattatgacataataatatcttagaaaaatctcttatttactgaaccactatttattttcaaagaataggaaaaacattatgataaagctcatcgaaggtataacttatataggctaatagttatacttagatttcttcttctttgatttttttttcaaaagaaaaaaattttttttaagttttttaaaagaatgcattaaaaccagttataaattcttgtccactactgccaggaaaaacaataaatcagtagggcctcatgcaacttatttggaagtccaaaattgatggtaaatattataatatgaatttacatttcagaaaaatatatgttcaagtgcattgtgagtgaaaaaataataattttgaaatatgcatgtaagagatgtactcttctgagagtagaggtgtagggaacactaggttcagaacagaggaagaaagagtaaatttttaatatctagtcttggtttattgatacacaaatacagtaataatccatatctagagttttactttcaaatagatttaacatatctgaatattggatactttgcatgagttttgtgaaaagattgagttaaaggtttcaaagccatttgagaatttcctttgaacacactaaagggtatctgtgaatactggcttattatatcatggctgatttacaataatttacgtgttgcctttcttagctggaactgtatgtgccaggaatagattaatccttatggttacatagatcagcagcaagacctcccacgtggaagtacctatattcatctttgtcatctgaaaataactttattagaaaatatcacatatcttcttattgccagccaggtgactcataggaaagtacaagataactgaaatcagctacataatcctatagttcatgcactattttcaaacactttgaaacttactgttggtaagtaaatgtttatcttaattatatctaaataatctcttccataattactcttgtgattgaaaccttgttaggcctcagaagcctctcgatatcaaaataactcataaattcctacttttatttgcacctcagaacatgagacttccagcatcctggaaagttcaaggtgtttcttaaactctctaaagggatggtttgcaagccagtctctttcataggaccaccataggccattctttctctaacagtccgatttaatttgtccatgacttctgcctttatagtcaactggaatgcctttactcttgctactatgtactattttatgctgacactatctcctgatgctctcaaagtcatcaactcttgggctgccagagtcctgctacattctgtgcacaactggtgaaaaatggccttcaattttaccctctgctgtgttgccatctgggccctacggcagcacaattcctgtcaagtgttttattaattccctcataaaaacaccattttcatcttcagctgtctagaagctccaaaccagttcagtgtccagtaagcatagacaccatgccaccctttgagcctttacattctcatcgtcgcaagttggatctcccaaacaaaagaaaaccatccaactttcttttccctcttcaacaaaattcaaagcttcttggcacattatttcaagcatacagatgctggtgggagtgtaataggaagtggacaaaaggaaagatatttggaccaagtattttatcctggctccaccttatgaataaaaggaaagtagacattgtcaggaattcactgatgtagcattaaaaaatctattaccaagagatcaaaggtagctagcaggaaataagataaaggactgacacccaattgtatccacagggcaagtgtttttattactaaaattccaataaaaaattagtgtttctagaaaatagatatttatatctgtgttcaggcagattaaaaaatcaatgagttttaaaaattacatttaatgaacagagtgatttatggtttgtttttgctttactaatgtgccagctcgatgtctctaataacaagtctggcttgatagccctgctaacaaatccagcttcatctagtacaatagaatatattttttctgaattcatttccatttactatctgctcagtttcttaaattagaaaataacttgactaattcaatggacaatggattggatatgaatctaaaatgaggcagtttcctgaagcccagacttaactgtatgtggcaatttgctttggggcattgtgcaagagaaggtttctcaaatttgtctaataatagtgaggctcttatagtaaatatcacagaatgctttgttaaatttgaagttcaacacataagaaaatgtccagaagaacacattaatgtccagaagacattacctaatcttgtcttttagaaattatcagcaacattgtgttgctgataacttctaagagacaagattaggttgtttgtggacatttatggaatagtcagtacaaatgtattgaagagaaatggtataattctgattgtgacactagattactattctgtttcttttaactttcttgcttctcaatttttagtgtaaaatatgaggggggtatattaaaaagataaaaggatctttgtaatcctaaggagctaggaagatagtctactagaagatataaatatagggattttgaaagctctgtgttcagaaatggcatcaaagtaataaagttccaatagagaaaaggaattacaattcacattacagtatttagataggactgtaagagaaataaatagctcttccttatttctcgtttaaaatttcagacaaatttgaccttcaaagatatgtctgaacaataacaatagaacataatagaaaaattgttctgactgcaaagaaatagacctttcccaacagtcacttcaaaatgcaaaccagaatgtatggtctatattgtttttaatttaatatatctatgtgaacaagcatacttcttcctcattttcattgcataaatttttacttggaatgcctttgaagttaaaccaatgtgcttcaaagttacatgtatgtatggtttttttttttttaccaactgtacatatgtctacaatttcccaccaaatatggtatcaaatatgtagaatctgagatgttataaaagcattcaaaatcatattttcctcataaaggaaacacaaaattgaccttaataggatattattgaggaatattttaattatctggttataaattctaaggtttcccaagatttagaaaacttactcttggatggcaaaatttactctaaagtattttgcaattgtgtgtgtgatagtgtttgaagtgacagggaaacctatgtatcctggaaacctatgtgtcaaggcattgttttctggatcatttattggcatatccaaaggcttgggaaaaaacttaggataaatagagaataatgaactttttcagaaataaataactaagattactccatgcaatagaatcccaaatgatttgaagttagactttattattagttatacagtaaatgtgataaacaagtttaccctgtgtgatacaaaaaataaaaaactgcagcatgaccataattttttctttatagataaggggctctcatgcttaaagtctgattaacatagccacatctgatttcaaaatatagatatgcccaatgaggtagttcttcacaatgggaatcgctggttaggtgttggttacccaatttcttttatttaaagtttaatggatatttgatgccatatagacaaaacatttggaaggagtttcaaattcccatctggagataggtgtcatataaaacagcctaaaaaaaataagaatggtttaaaaggcttgcttgagttaactaatggttggcaggtccatttgccaggcttattgaatcaagctttaccctcctttaaatgaggggtctgtttttccttggcaggaatgttttagattcagcatattaaaagctgcaaatatttgtgttgggttttcctttgtgagctatctacagcaatgtgagagagcgagtacatttagccacagcaggaacttcccataaaatcacagtaaatgactgtgcttttcttataagccacacccttcctaggcatttctcaaatactttacatagaaatgtgttcactttaacaaaaatcaataaatgcaaatattatttcatttgttttcattaactagtagaaatagcagtaatatattgttaattatattagcaggaccctatagcttaatgcaacaagtcaaaaggcatctggccattcctaagtattgtgactgatggagtaatatagacaaaaaaattggataaccttggaaaagtatgaagatgtgcagtttacaaagagctggctgaaaattaaggagaaatggcagatttgaaaccgtgataggtataaatgaattgtggtatggcctgattaaaaattttacttcatcatattcatactggagtctacataatttgggaagaagaaatattttgtcaaaactgatatatcccataaaatataactaacatactttgcagggaagcttaaggaaggcctgggagacaaaatggacaacaaatgtaacaataataatatttaagtgcaataaggttttttataatgtcattttttaaaaaataaagttttttataatgtctacataagggaaatcaacactgcattgactattagaattagtttgggggtctaatggactattcctgaaatttggactgaggggtcagattattaatggtagacctgaatttgtctcaaagaacaatgttttggaatctaataaaatctcttcagatactctctatttaactgattgcttgtttcaaaggtcaattcattttggaaaaagattatagatttttctcacattttatgacaacataaatgttgacaacttatgtttttgttaatgtatagtgttattcattatcaaaaacaaaaacaaaagcaagctatttgctaatagtcatgtcacaaatataattattatacatagaattatacagacccagttgcaatggacctttcttaacttccttataatttattatccttttaaaacacaagagaaacccatttggtatcttccacccatagcttgaaagtcttatatttatttgcttattagtagtacatttccatctgatacatgtaatattaggttgcattattctagatccaatttttccttctgtaagtgaagtttatgaaataaggttagttgttctagtcacaaatgcattgtacaatgaaaagcatggcattataactcactatattttcatgataagaaaaaagtatgcatatttattgataaacgtattttaagtgtattccttatagtgcgggaagtgcaaagatgaatgaaacactctagtaaagagcagtgtgcttcaagtttttctgttgacaccttgtgtaaaataattttgaaagaacttcagccatttcaactgacagatcagttgtaaagcatgtaacttttggcacattttaaatgttgacattctaaactataactgttatatcatttttaaaaattcacaatgaaacataaatataaaagcaattcaatatctaccacattcatttaaaataaatgagttcttcacagcggttggaaatggtacttcatttctttctctccttgaaatcatatcccagtccactacccacccttcctgttatagaattttattctattaaaatttatttttatactttaaattatttttagtgataccctgaaagagagccaggaaaactcattatatagaaaaaaaaaggaataaaggtagcacggagcaagaaagaagataaagtgacagggaaatagatcattagatgagcacgtaacactttaaaatctgtgaagttatggtgtctgtcatttattattttttttttttgcagacgtgtgcattgctgtgatgtaaatctcttctaatcttttctcgtgaaaatctttaccctgctctaaaatgttttgcaacaaaatttgtacacagattaacattttattttgaaagaatcctgtccaaatggcggcaaatgaatgtttttaaaaagttcttccagattgcattatcactacaacttttataaaaaataatggcaataattatcatgttgataataatagtggctaacacgtctggaaggcttactaagcttcaagcacgaatctatacattacctatttatacctctacttgtagctatctatttatatagagtgtccaccaggtctggaaacacaaacgatatataataaatgattcactgatatatattagattgtaatactttcaaaaagtaatatttgattttctagagttatgatcaccttacaacaatcatgtaaggtaggtactatgcttaacccagcttacctatgagggacctgaagctcagtcagtttattaactttaacatgtgattaaaaattgattaattcaagagttgaatcaggcaggctggttttaaagtttacactcaagatcaaaatgcattattatagactttgatatatattttgattcataattcatcttaaacaaaagtaaaattttatttaccctatattatttaatgagatgaagaaaggggaagctcacatgtccttttgaaaggaggcttggcaaacatcaatgtatccaccatccctgtccccttgtttgtggcctaagagattgttacaccttccaaaaatgctctctagtaagattcagaatgggtgatacaacacttgtgttttttgtgtggggagggagacgtaggtaaaagaggaaaaggaagattgtgaaaagagaagtggaaaaggataactagctggaagcttgtagcttcgaagttttctctggcagatcagttttaggaaggagatcaaatcgagtttgagaatcaggaaattgatttctgtaaaagaagctgtttctgcctatgtggtaagggtatggataactcacttcataggtccttggtctagggaaaagtgtaacacaaagtaaatgatgaaactcagttctatcaaaaatgaaaatgttgttgcatttgagaaccattatggtgggcaatgtagtaaaaaggataagacattcatcctactttaatgtaaaacaaatttgaaaagaaaaaatgataagtaaagaatttcatgaaggtattatcgtcactgcatataatatgctttctactaaatttcaatggcagtttatgtttacctaccatattaaataattgctattacattggtatcataattcctcttatgagaggaactgttctttctgataaaagaaattaaaaatccacttagagtagagcagactcttggtcataaatgttatcaggtgctcaaatatcaggggaagaattctcctctccatgaatcaaattagaaaatgcattacttttactcatgcaacagaagctggaaaatgagtgacaaaaagaaagaatggggtaaagacacaatgaagtcaaaaagagagaggccaaaatagattattgggagaaataagtgacatctaaaaatggtcatttctactatttgatttgaagttgtttgcattggtagtatgtgaacctctcccatatctgctatcatgtaaatctttaatgaagtctactgtctgtgtgagtgaaattttttacagagatcaacaccagggctgtttcagggatcaatgcaaagcagaacaactatatacactaaagaagagtctgattaagggcaaattaacaaggacattgcagggaagcatattcatgagggattccaccattttacagaaataataataatatgaaaatcttttagtgatgaagaagtactggtagactttcatggcacttaagatgagaccctcaaggcacatgatcaaggatgattaccagtacttacttatttaagccagtgtcatatttaagtcccagctttattttgctgtggaacatgtaagttaacataaatgacaagtcacactgacctcatttggttgaattttaattactttaattggagacactgctcattatacagcaaaatgagaataagtatttgtaaacattctattaacaaaaatgaatcttttgaatctttaattatgacctacaagtcattaattgtgtctctcatacacatgggagtatacctaatttgaactctgagaaataggacagtgtgctataaaattttaaagagatgataagatgatcattcataaaattgattcattaagcaacacttcaaaatactataagcagccaggtacagtggctcacgcctgtaatcccagcattttgggaggccaaggcgggtggatcacgaggtcgggagattgagaccatcctggctaacacggagaaaccccatctctactaaaaatacaaacaattagctgggcgtggtggtgggtgcctgtagtcccagctactcgggaggctgaggcaggagaatggcgtgaacacgggaggtggagcttgcagtgagccaaggtcgcgccactgcactccagcctgggcgacagagcaagactccgcctcaaaaaaaaaaaaaaaaattactgtaagcataacttttctggagtattttcatataatttacaaatatatttttagtttatataatataaatattgcttcaattttagctggattaaaatttaaatgcaaaaattgatctattaaatgattagaaatttataagttaatatctttactattttggagtctgaaagaactttccacaagattactaaactttactgataactagaaatagatgcttctgttgccaaaattcaaactagccagagacatttccctttatattttttttatttcccacttcttacccatctgtcaagttttggtcagctgtatgattacataaataaaaccatacaaaaaaaaaacccttgtagttagaggaattgaactattataaatcacatagttggttacaaagaacttcagatggtattttatttctagctattatctttaggtcagagagttacaggcagctatttcagaacttcagagctgggatggacctgagaaatctcacagaaaaatcttctcagtttagagacagaaattaggagttcaggagggttttgtgatgtgctttatattccacggcagtggtagatgagctaagactgggagccccctctcctaagtgtctgttctgtactccttttattatgttaaaatggaaacatacataattcaaactaatatgatggcaaactgcaatcatagttctcatttacatttttaatctccataaagataattttttctacctctttcttgctagaattgaagtgaatttacaccttaaactgcactattagaacaaaaacaactcaaaaggcagccattaacttctcacagaaaatctttgcaatgctctacaagttctgtgagaccaggctaatgaagagaatgcacctttaaacttggacctttcattatcagctacttccaatttatcttcttcaaactctcaaacatgttataagttgaaaaacacacttggaaaaaatatagtgtattcctctcagtgttcacatgaagacatgactgatacacacagatagtggaggccaaatccagttcttccctagtaagtgaattttctcccattgtgctctctttcctatatacctttattaagcaaactttgggccttttgaaagttgatctgatattacttcacataaaaaccatcaggaagaaaaatccatctgtcagatataagtaggcattttgagcattcaaaccttgctctaaggaacagtgagtcatgtgaaatgaaatgtgcaaaggaagctgacacatgaaaggacagaacaacaatgatgagttcccaaagacatgctgtgggagaaagaacaattatagaggatctatttttgggtccagcagtatgaactgggaatttaaaaatcacagcttaagtacagaaggaggaatgatgtcacccagctttaaatttaggagaaaataatttagtagcctttagttttaatttaggttattgccatttattacgatgatacattattgaattgtcaaacgtttgcagtctaaaaacaagttaatgcaggacatttaattttgtaggaaaggcagctatgaggtgtaacattaattgcataattaatattttatttgccatggtactataatgccaaacataaataacaagacaaacacatctggaacagcagtctttctggaagcaccaatgccccaaaagcctgtagttaatgcccaggattgaaaatgagactctcagagtggccagggagttctaaaaataatatttagagtcatttaaagttttttcttcgcttataaataaggttatcatcttatgttccaattatgaaaaagttttacatccattcataggaatataacagtgacaatgtgaatagaaaataaggaactctatagagaaaaggaacttagttcaaatgagcaaattagccctattttataatgttaaacataattttttgtatatatccatataattatggttatatgttttatacagtatatatacatataatatatgatgtctgtggctaattttacaaaataactaatattaataaatctaataggacacattcaaattaatttaacactcccggtagtctggccaagagaacagcaatatggagactaagtccactgccaaggtgccaaggaaataattttgtaagtttgacagatgtccataattccatctttattaatattttgttagattgcctttcaaggttctcttttattctaaagttaactatatgcctttccgtgaaatatttcttactattgttaacatggtcttatcctcagctttactggaaatgcaacatgttacttttattaggtcatgaatgttgttttgtaatatatgcaatacctgaaagtagggccatccaaagttttgacagatggtagcacaagtggttggtgtatcatcgtaggaccctagatgacaagagaacattcctgtgaatttggtaatattatgagtggatggtgggatttctcagaatttaacctcaagttaaatactagtgtgtttctttgttaaaaccataaacatatatatttcaaatgatacttttcaatggaaagttgggaggagacataccaggtatattgaggttgtcaccatgctaacctgaaagtaatcagtaactttgttcttggcatcatatgtcctaagaataggaactccaacaggcacaaacatggaggcagatagtgcctgttctttaaggtcttggccctaggaagatgtgtaatctatgtatgaatggctctggtctacaggctggggatatggtagtccctgctctcatggagcttatattataaggagaaaaaaaaagaaacaaataaatattaaaatggccagttttgataagtggtatgaaggatagtaaagcaagctaagggagaatagggagaaatgagaaatgtatgatggtggtacactagatagaatagtcacaaaaagcatctctgaagaggtggtatatgagcagtggacctgaagtaagagagcataccaaggaatgttcaggagaatggtcatttttagaagaaaggatgactgagtcaatggttctaaggcaggaatgacttggctagttcaaagtacagaaagagagtcaatatggtcatagtggagtgaatgagggcaaagagcattcaagaactgggtcaaagagggaaccagaggccaaatcttgtcagtaatgagttttaaatctccataaacaggatgttactaacaagttaaattcattccctgtcaaacaaatatggaagttacataaatgtagtttacatacatcctttcaggctcaaactaatgttgaaagcaagacatagctagtttaccttgctttgcatttacacactgtttgaattttaagaacttgaaaaatgtcagaattgcattttgtgaattatttatcttaattaagtcataatgacatttgaaaggcttttaatgaccttttgcttatggagcatcaattttctactatacccaacaataatcagatctattgccaataatttctttaaagtcaacagagatgttgaccctcaaaatgtaaaccctcaaaaatattcagaaagcttattattaaaagtaatctctgcaactgaatcttttgtaaatcaaaaatcacttccaattattttgaaaaattaccttgtaaatgtttactccttcatgtgtttttaaaacatattatatatcactaaaaattaactaacacattttataattagaatcatgtggtcatattaattagatgtgtatttgtacattggcaaaaagtctgcatatacagtcaacacactgcattaggatgttgcagtcaaagatggtccacatatataactgtggtaccataagattttcatactgtatttttactgtactttctatgttttggtgtgtttaaatacacaaagacttacgagtgtgttacagttgcctaaaatatttagtacagtgatacagattcgcattctaggagcaataagcttcaccatacagcctagatgtgtagtaggctatcctatctaggtttctgtaagtaccctctgtaatgttcgcacaatgacaaacttgcctaatgacacatttctcaggacatatcccaatccttaagtgacacctgactgtatttagaatctggatttctaaaagctatttcagaaaaaataaaagttcctattagtctcagcctttattggcatacatatgaaatttaccaggttcaaagttgaagtttattttgagtattttcccaacttgctagaaaataccactagaagtagaaatactcagaagcattattttttttctgcatggttcttttttcatcccagccaaaaatgctatgaaagaatctttccagctttttggtgtttgggacatgtaaatggtcacttctggctatcagaaaatgtattgatgagttaattttggttaataaacatgttgcatatattaataaaattacaatgtatgtgtgaacatgtatttactacctcttctgaaaaatatcggttatctgtggtattaaattatgtactaaaatggattaataggcaagaagaaaggacaaaaagaaaacattattaagccccaatgtgaaagataaaaatacctagagaaaactcaaaagaaagagctaattttgttcaagtagcaaaactggctgaaatggttggacaataaaatcctaatcaactaaatctggaaaacacagaaaagaaatacagcaaatagggataacacctatactttcttgatataatgttgccatggtgaaatataacaacttatctgaagaaaaaatatataaacctaagtatatttatgaagagaaaatcagaaccttgaagaaatatactggttaaattcagctgatgcctataaaggcaatcaagtgaattaaaaaatgaggaattatgtgaaaaacacaaacttcaatgctttctatgatgttttgacgcctaagaaataattttttacaataggtagagagacacaatcactctcaggagatatgtaagcttcataaattattgtaaatgtgcaaccaatttttaaaaaagaagacatacacaccctgaatagaattattcattttcttcctctctttatttttcaaaggagattttgatagatattagataaagtttttgaataaagagaaatagaaagttagagctaagattcaagacattttctatctgtgttcttgttcatgagaaatgttattcatacatatccaattttaaaagcaataaaacatatttttgctttccctggaccacctaaccaaagagagatacttaatccttctcttaaatagttacaagcaaaaagtgacttaattataaccctgcaacattaagtcactgccattcaattagaaacaaatgtttcagaggaaaattttaattcatttagcttacaaattcattgtgactcataataaggaaaatgcagattaaaaccacaatgagatgctatgttacactcagcagactagcaacaattaaaaagtttgacaataatacacagcattagaaaagatatgacgcaatggaaacctcatacactgttggtgggagtataaattggcataagcattttgaactgctaggatcctgaaatctcactgaaaaatatatcctcaaaaaatcatggacatatgtgtaccaggagatatgttaacaaaatgttcatagcctcattgtttgtaatatcaaaactgtggaagcaatccagatgttcctcagcaggaaaaaggataaatacattgtgttacattcatacaatggaacactgtaatagtgaaaggaaagaaccacagctatacccattaacaatgatttatctcaagaacataatgctgaatggaagaagcaagtcttcaaagaatgtattcaagataactccactttcattaaagtaaaaataaaagcagaaaaataaagtaatagtttgcccagaaaccatatgtggtaaagtcataaagtaaaacaaggaaatgattagtacaagcttaggataaaggtttacttctgagaatgtccatgtgagtcaatcagggaagaacatgatggacaatcttgggtctaggcatacaggagtttatttatttaaacagtatatgtgtatgtgttaatgtccttgttttgctataaagaaatacctgaggctgggtaatttataaagaaaataggttgaattggctcacggttctgcaggctgtataagcatggctccagcatctgtttctggcagagcctcaggaagtctacaatcatgacaaaaggggagctgacatatcctcatatctcctatctcgtggcaacagagggagcaagagagggagcagaaaggtcctatactctttcaaacaaccagactttgtgtgaactaactaagcgagaactcacttatcaccaaggggatggtgctaggtcattcatgagggagccatccccatgattcagtctcctttccaccaggtcccacctccaacactggggaatcacatttcaatattcaaccttcatatgagatttggagaggacaaacatccaaactatatcagtatggtatacataatattctacatacaagaaatgttcttaattataaaggtttttgtagaaaagtatgcagagtataattccctcctaaggaatgatgtatttgttatgaatctatgtatcaaaatatatgaaatgcaatttattagggaaaggtcaagggatctggatcggagatggagctgccttatacagtactgatcctatttgaaagtttattatgtgatttaaatgtataaattatatatgatttcaagtttattattatatacacaaaggaattttggaacagcaataatgactaatccttgaatcaaggtgtgtgtgtttgtgcgtgcgtgtgtgtgtgtgtgtgtgtgtgtgtatttacccctgaatctgatggtgaaaagcgtctacaaatttgtaatttggattattaccaagttcctaagatttttaagttagaatgattcagacaggaaaaatgtgccaccaactcacagaactaatcattctcagcccagaattaaaatgggaagtattacatacttcttgttatttattggtagttcaatatatatttatagttattatttagttatttgtaaagacaatcacttgatttaaacatgcgtcctacttactgacttattttgttattgttagtttgactctattgtgttattatgccctattcatacaacatccaaaatacagaaaagagaacactatgtcagggcacacatgcatcatttaagcatcatctccatctgtccattgagccatcccagactcatttggtaggttcagaataagtagagagattttcactttaccaaacagcactgctgctttaaatgtggtatgatcagtgtagcccaacctgtagaggtcctgagagactgagacagattttatgacccctccacttaaaagcagagtaattatctcgaccaattgggttcaatcctgaaacacaagtcagttattaccacccaggaggtggtatttacttttcacaattttttaaataaatacttttcagctctgatcagaagtaataaccctgagacttaacacttaccattgtcccagtcgaaaaggcagataaggctttaccatccaaaagtttacaccaagcacctggaagatatttgcatgtcaactgaaaatggtacccactgacatgcccattgtccatggccatgtaggccaaagcatctcaatttatgtgattcagcactggatttttataatctaacaaattatataaatctagcaaatcaaatgtcttattggactaatttgtcttcttttacagcctctccttttatcttctctttcttttcttgtctttattctatgtgctccccttttcttttaaggtttctcttactttcaaatttcaagcctccctctgatcttttaacttggtgagcaataattactaagttaattttgttcttaaagtcatatctttctattctttagttgagaattttgtttggatatactttgttctggttggcttttcactctttaatcttgttccttccatttcaaatttcattaatttttgggtcaatctcccaagccttcacattgcatttgtaaaagccactgtcaccagacctgaaacaaaatgcattgctctggatttactcaaaaagagcaaagtttaggatgtgcaacattttaaaatgttaaattcaattttaaaaacatatttaaaactcagatacatataggccgggcactgtggctcacgcctgtaatcgcagcactttgggaggccgaggcaggctgatcacgagatcaggaaatcaagaccatcctggctaatacagtgaaacccagtctctattaaaaatacaaaaaattagccgggcgtgatggcggcatatagtagagacggggtttctttcaaggcttttatttatgtaaagtttatcttaagtgccttttacattatttcatcaagcctattcagattagaaatttccactctcttgtctttgtaaagacagccctatttttttttctattttaagctccttagaataaagaaaatgtgttgtagaatactgagttatcttgccatatataaacttatcagaacaaattgactaattttaaaaacaaaatatagtttatgttttgtaataataactttatcaaaaatatgttgtttgataatgactgtatcaaataaagtcagaaagtttagggataagagttaagaaacaggaaaggatagtggtaggaagaagccatttgacaatttttaaaaatgttttgagtaatagttcatctaagacagagagttatttaatccaaaccagtgtgctgcttatgatttaaaatccagtcagtagtgtgataagagaatatgtagaaaaacagtaaaattacaactttgacacattttatatacatattttatctgaatactatggatgtatgttgacaatcagtatttttctcaaagtaaagttattgttttactgaatgacatacatatttgaactcagaagaaagaaaaccttaatagtgacatttctggtaaatgaataattagaattctgttttaaaagaaaacaataaagttaacactgaatctcaaacaaatggggaatctaaatgggaaaataaaagatgtattattataatatgagttgggtccattcataatataacttgtgtaaagatccataatgaggctttcaaacaaattatgatttatttaatcacaaatatgtatttcaatttataaaagagtcctttggctgtaagtttagaaaacttccataacaatacaatgaggtaaggtcattgacagttggcattgtttttagagttatctgtatttatacatcaacactgaaaagcttaataaattacagactgacaaacatgtctgtttaccaaacagacgtaaaactttttggcaattaaacagaatttgtattctgctatagatgtttttagaaaagattaattttctttccctcaatttcattgctaagttgttttttttttcctccttgtataggctctttagtgctattgtccagaaaggcaataagtaacggaataaggcttttgttgggaggcaagagttggcaagtcagccagtttcaacaagaattctgccagttttagccattgtgtggccacttggggaaaggcttcaacattttatgttaaaatactgagcaatcttctcatttaccctaatgtgaaaggtcattccttggaatttagtaaaatctgaacactaagtatattacaggaagcatctttactaacttttttcctttcaaagtcagtgaagaaatacatattaggttgaagtaagaataaaaaaatgaaaactaatttttgaatattttctttttggaaatatacagtgattctaacaccttcagtaattttactctggcatctcttgaataatatataaactcacatgaagccaatatccagttttctgtgatttagactctagtataaagaaacattcattcatttattcatttaaatatttagtaaacagttttggggcacctaatatacaggcacttatctaggtgcttcatatatattagtgaaatgaaaatcaggcagaaatccttgcactggagcttacgtgttagtgggtggctggaaaataaaaaataatagcaaggttgggtgcagtggctcacacctgtaatcccagcattttgggaggccagactgggcggatcacttgaggccaggagtttgagaccagcctggccaacatggcgaaatcccatctctactaaaaatacaaaaattagctgggtgtggtcacgctgaggtaggagaattgctcacacccaggagacagagattgcagtgagccaagatcatgcccctgcactccagcctgggcaacagagcaagactgtgtttcaaataactaactaactaaatactaaacaaaacaaaacaaacaaacaaacaaaaaaccaacaaaaaaacagtaaatatgtaaattatagtagattggtgcaagatgattagtattacaggaaaaaaggacaaactaaaatagataaaaaagaaaagaggtctgtggtagtatagacgtaggttgattttaaataatcatcgatgtaagctctttagaagagttcacattggagcaagatggcagggtggtgagggacttaggtatatggatatctggaataagaacattttatgctagttgaaagaaacccacaggtaattcttaattctcctttagaaaatgtgcgtctctttctttaaattggtggcaaatgaaatcagaagtactggcagtaagtaaacttgtctagaggtgaaggacttgataaatggaagaagagacatttaaagctggaatacaagatctataggtccataagtaaggaagattagcattcttttcatactcagatgataatgtgatgcttatgtaatgtagagaaaaagacaaataataaacttagaaattattcaaataaatactccctcatactattattatattactattataatcttatatcaataaaattatatgatgcacaatgatctttgttccttacccaaaatttaatttcattgcaaatagtttttaaactggaatggatatactgtagtaactgatgtccatatgcatattaggttgaactaaaatgtccagacgaaaaaaaaaagcatgtctgttataaagactgtttcccttccatgttgataacatcacgcaactatttctgtaaggaaaaatgtagaccagaatgtaggacaagccttgaagtctaaactattttgagtaattaggggtagaatgttgtcagagtgtaaacatctaacatcttttatttcttttaaaaaagcacatgccatttcaagacctacatcatagttagatttaatgaaacattgagatggagtctcccttttctaagttaggaatccattaactaaatttatttaacttattcagacctctagcttaggaagccacaagttatatttaaggttttgaacatatgcagtcttttatggtactggagtcaggaaagttgagaacttgctcaacgaacttagctttcaggattagtatggaaaattacacatttaatggatgtttttgaagaatgcttgtgttatatctaaactcaaatataaagtctttgttaattttggtgtgtatttactttgaaggaagtagactggaatttggttcattaaatataaacatatattaattttatgatcaaaacgactttcacactgataacatggaacatagaacaggaaatccttttggaaagtgcataattaaggaagttagctattgttagaaattcaattaattaaaaaattaaacaatatttaggaaaatcattatatgaatttcactcctgccaggttgttccagaccttaatatttgctcatatctcatttgaaggccttcctatccaaattaatgaagacaaatattcatcaaagctttattcttaggaatatcactttctttaaccttggtatttgcaatggaattagacacaaaaaaatattttttgtcaaagtaagaaaggtaaaaaattatattagaagcaattgaaagggagatatttcagaatatcttaaccaaggaaaacataaaattgcgaacacagtgaatctggttgttgtttatttcaggttttttgatgtttcatcaataactgaaggtttgctacgataataaatatatacatatttattatatgtatttgatttatctaatttttcagacattaagagatctgatttaccaggttttgtcattttagaaaacactctagttaagatattgagtcttgatcttgtgacaagatgaaaaatagagtggcagccagtatggattaagactatacactttgattggaattgtctttacataacatggaagtggtggtgttgttgtccagagcaggagacctgtcttgttggccttcgacacctagcatagggccaggcacctcataagtacctcttatgaggtacttctatggaccatattgtttaatcctagtatcccctaaaggaaataaatgtatagtcatatgagttaaaatataaatattctttgacagaaataaactctgggatgaaaaatcagtctgcttccttcccccaaatgaaatatactgcaatattaccagattttaatttgtttagaaaaagagcaattttagcatacaggaaaatatgctactcttgaccacttgaggccagaatgcagctattgggcctatggtttggaaaaaagtgaacgttagacaggctaagtgagaaaacttagtggaaggagagggataccaaaagacagatggaaaattaccaactgcagattgtacttactgtatagtttttcctaacgccctgcaactcatgctgtctgtctgctgggaaaactcttggccatttgtttctgatgtccatgtctgtcttttgaattctgttccttactccttgatctataaaagtatctgaggtggcttaaaaacattatatatatatatatatatatatatatatatatatacatacacacacatatacatatacatacatacacacacacatacatacacacacatatatacgcacacatatatgtgtgtatatatgtatacatatacgtatatatatattttaccttattttataagagtaactgtcacgtgaattacctgcaacatgggtgtttaaactgagagttgaagaactcttaacatagctaacaaaaaggagatcctatgaaactcatgcaactgtaagcaaaatgagaatccctttgaatgtatttttttttaatttatggaaaaaaaggttttggtttcattacattctcaatgtgggtcttaatttataaaatattcaatgataaattcttaaaatgaattatgttaagccaaaacctaaattttttttgccatcctattgcacaggcactctttctttgtatttttgaaatataataaataagaaaatataagtgtcttccattaggtggcagtaataagttcctataataagaactttaaaaaaaatggtcaaaaacaacttggaatcctaaaagctgaatttattggatccttcttaatgttctcattttgagattgtggagctgctatagtaatcaaaactaaaattttccgacagatgtctacatttatctctactgtagtatagtcacacaagtagcaaacaaatttgtgtaaataaatttacttttattatcttgtgttagaagagattcagtttggatttggtgaatcatatcactattcaactttgcacaacttcagtaatgagaggtctaataatagataatacacaatagtataatgaaatatttaggatgtagattcataatatatgtaggataaaaccagagttttgtcaacgaggattgtgcaactttgggtttcactgagtttcacatgtaaagaaacgcaataatttttgtttaatatacctttttaaattgttaatatgcaggtattttaaagtgctcaagttctatggagatagtaattatcaatatcaattttattaggttctggcatgtattgtataatggcaaaaggatggtcactgtaacaactgtaattataaatcacacttgttcactcttcctgtcttacagatagattgcattctgtttatccgtatgggtgttgattgtttggaataaaattttgcatagaaacaaattatgtcctcagtctcattcacaacagacttaaggtgaacatgaaaatttattgaatatgtactaaatgccaagtgctaaaaaatttccacgtgttaattcatggattacttacaaaaccttataaagcaatatgattatcacttccactttatggatgagaaaggggaactaataagtggtaaattttgggttcttatgtggatgatctaaatccaaagcgcatcacagtgtacttctataaataccatatacctaaatttctaaaataaatgcatattttttcttaatttataaagtacattggtatatttgtagaaaagacagaaacaaatacatcattaaaagtaaaattttaaagacatatgcacattgactaataaaacaataaacatgttactctaatattgtttccattactaagtacaaaataaaaatcacagttttgtattgatgacattcttttcccatggttttaactctctttgtctattataatgttatttattgctctctgatacttaccaaagtttctatttttccttcaaattatccttggaagaaaggcaaaattgaggtgcatatgcaaaatatctgtgtaatcattggtctcagtttaattagtgaatgcgggttcaaattaacactcatttgtaaaatttatgaatttggtagttggatacaagaaaaatttatcttcattttggttaataaaaccaaacctgtgtgctcacgaatatgctattgatcctccatgtgactgcactgtaaggagatgggcacttataaaccatctagttgctatgtaagtaaatcattgcaatttaacataccaaatgatatgctcaaaattcaccataatttcatgagaaacataaatgagcttaggttagcctaagcctgaatagagaaataactacagttttatacaaaagtttatgtcatattaacactttttaattcaaaaagatatgttccatgttaagggaaataagatttgtctgaaaattgggctccatccagcagtgttaataaaatataaaactatagccccaataccataggggttatttatgtattcattttggcttatgctagattgaactgggttgggatttttgtctttttaatttttagtaatggaaaaggtgtataacacatttaatttaaaccatgaaaacattaaaaaataaaacttgcttaacatttcaaaagtaaatacactatttgggccatttttgcaaacaataatattttggtgtattagttttgaataatactgtctcttaagtaaacaaactaattgaagaaaaaaatggaagaaatgtgttttaggaaaatatttgcaacttattacctgataataattctagtaacctaggaaacatagaccctaactcagttcacaggcagtgatactattttatatttttgtaagaagaagtaagaccttattatgtccttaaaaattgaatacatttcttctcttttttgtaatatagcttattataattaaattaatttgattttaagattattcaaataaggaaaaatgcagagattaattgacctaatctaatttacatggtccatgtgaatatatgggaaaaggatagatccatctggttagaatgtagacttgtatttctggtaagtttttattttccacctatttgcatcataatatttttgtatattaaacgagaagatgtcttgaaataatttgtaatccagtatggtacatgtactttgtcagaaaaatagaacatacctgagaaattatgaatgtttatagtttacccatggatttgaaaaccagatacagataaatgttttaaatagctgtgtaccatttgtctatcttaagcgtattctccaatattctgattaagtcaaaactaagatacgttacacacttgactctcataagagcgtctttcattaacacccttgcaatgatagcgcttgtgtttatggtttaatagcttctctgaatgccaagcataagatacgcaataaagcaaaagattttaaatactatttcttgaacatatttgtattgtgaaaagtcgatactgtaatcattatatctccaaaaccagaattatttgataaagctgtattaaaagtcatatatagagtatgaaataaattttgtttagtgaataagtttttgatcctttaaagattattatattttttctataaagatctagaacaatcttttaaaattaagttactatcaaacttttgccatgtagataaaattggtagcaaaatatttttacaatgtttccaaatatgatctagttagaaatatataatgatgctattaactgaaattcagttagtgtttatgtgtttatcaaatactttgtccacattaatctgtaaagcaaacaaggtaatcattttacctttatattattttcaattttttatgaaattttatttctgttatgcatgaaaaaatagtataatatgtgcaggtgaacataaatattcttacaaatatgctaagtattgtcttcatttaaaattcattacatgttcggagtcaccagtgagaaaaccatatgaatcttgcccattcatttaaaataatttttaaaattacagacccagtattattttaaacaatgtttttgttattccaatttttcaaagtgaatgaacagtttcatatattataaaaatctacatattttaacttttagtataatgctttggtatgtaagatagaaaaaaaatcttgtaacaataatcaaaaacattatctctttaagaaatagaatatttcaggtaaaacatatttcagctcacattattcacatactatttcaattctatgtttcattttacatatttagcattgactgtaggctcaatgcattgattttatgatgctacaaggaaacatcttctagcaaagtaaattcatttctttatggctaaaagcatgcattgatattctgatattttcttatcattaaagaaagcacattttgaatacaataatatgaatttttatttcaaacttccagttatgtcctcaaatatttcctttggctaatgaccttcaatgttcatcgcctagtgtttttcaaaagtatttttggaaaacaaagattataaaccatactgttagtaaactcataaaaatttaatcaaattatacaagaaaattatgggtttgggactagcaattaaacaaaaattaaggaagtttggagagtttctcattataaaatatgatcataatataatacctcctaagaaaataatctgaattaaaaataatgttgttttaatttttgttactaacccacgtcattgggttagtaaatgtgttgtttccactttctcccccatttatataatggctaaagtcacattctaaaaacacttttcccatttctacacatgtgtcagggaactcagtacaactgaagattgaaaagagagagaaatcagccatgatactcttaaagaatcacaaatctaagaattaatttaaattttcattatattgaggaatttgtggaaaaattgagttgtaaattactgaggagttactcaggatgtttgtagtctattattaatgtgccagatataagtgattaagtacaggatgcttccaatgcaggacatcttggaaagtataattgcatttaggtaagaaaatatataacttaaaaatcatatctatcaacatcatttaaaatttgacatcaaactttctccagcaacaaatttgtgatatatctacacaaacaatttattaagcagacattagtttcttaaattgttcaggacagtctgtactatcggaatgagcattaacagatgttttatccaacatttcagtaagttccatcctggaaattcttttttaataaatactttaatttctttgtttaatcgtctaatatacttctttgggaaagctgtcacgtttctttatccacagatatcgtggtatcacacccccctccaaaagcttgcagaggggaaccagtcaagttgaagtattctcttaaagatttcaaaattaagaattgttttaaaaatctacatttcctaaactctaggtttttttttttctttgtagccgacaccatgatccaaataaagagcaaacagttcagggttagcagaagagagatttaaacacatctggcaacaatgaacacaaaaattagttcagtagttacagatatatgtgtaaataaaggtgaaaggcaaataaaagcaaatgtaataaatacaaagtgattacttttcaaaactctgcattatgatcaaccacagagtaagtgagactccgagacccattaagtagttattctttcacctctttcttacagctgataacatggaaagtttaaagacccttccggggggagaaatgttttccagttgtcaagattcaagcttagctaatattagagctaattttaaaagacattgttctgtgattaaggtatttgttcagaaatatgtcttttaatccatttagatttttaatacttgctaaatttattttctagaataccatggtaaacaatattatctagtagtattagattttgtattcatgttggggtagtaggctgtattttctctagcatgtgaaataagtgagactatgtttcaacattatttcagtgctatctactaaattctataatagaaacattgccaaactatatgagaatactacttagaataaatatatttattttgaatgtgcacttacccagtccagctcttaaggaaattctttgtgaaatattctcaggatggaactttactttctgagattccgcagaagagatttacccacaagcaaggtgggaaagagtgaaagctttgcaatgtgatcctgcaattaggatgagattcagttagcagagcttgatggtcctaaagcaggaggtgacactctctgctggagagagagaggttgttctgagtagattgtaagtgttgtcagattgtaagtgatcagcagc

SEQ ID NO: 255 - DNA, 106332 bp, Homo sapiens; identical to SEQ ID NO: 254

SEQ ID NO: 256 - DNA, 96321 bp, Homo sapiens
ggaattcgggtgactttgctccaagatacacgcgtgtgtcccgactctcactcaatttataggggagagggactcgccaaatccctgttttctggggtaagcccccctccccccactcttggacccaagctgcccggaaggaagaaggaagcattgtttgtcaccggagaaaaccacctgtggtttgcaaagggcctcagtcgagtcaggggcaggcggggcagatccgagcccggcgggaggggcgaggcgcgggggcgggcaggggcgagggtaggggcgctcagctggcaggtcctgctctgcaggcctcaccgcccagctcccgggagggggccgagggcgccctgagtgctgcgcgccttcccatgacgcagttcctgtgcctttaaatcccactcccggagggggcgggggcgccccggctggaccccggtttccagtccggcgggggccccggggaagcccagggcggggagcgcggggctgggggcgcggagggcggggcgcccggggtccccgcccgcgcgccgcgccctagcctgctgggccgcgcccctcttgggaccgccgcgctccgggggcgggggcgggggcgggggcggggggcggggggcggggggcgggcgggggcgcgcgggcgggcggggtgcgggcgcgcgccgcgcggcccgagcgcgcgagccgggcccggagcgcacgccgccgccgccaccgccgccgccgccgcccgagccgccgcattgctgctgctgctgccgccgccgccccgcgcccggcccgcggcccccaatatggtgcagccgccagcgccgccgcccgtgccgccgccgccgcccgcgggccccgccgccgccctcgggcgcccgcagcgcggcagccgcaggtggggggccgcggcccgggcctgagctgccccccgcccggcctcggcgcggcgccctccccgcggggctgccggcgaggggccctctcgccgctgaggtggagccgcgggccccgccgccgccgctcctgccccctccctccctcctcccctccccctcccctccggtcctgtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaagccacggcggctcctggctacaggttgccccgctgcctggtggggacagtgcccctgtgccagctgaagggtgttgggggctttccaggggcagagccaggcggggcccagcagagcctccgtgcgtcggacacagcaggccggagacctgcgggaagggccaggctgggcccgcggccctggggaacccagcaagggcagagggggctgggagaagggcccctccccttgttggctttgccccccaccctggaggccgcccttcgatcaggccccagcttcgcttctggtgttcctgcggcgcccgagggccttcctcagccccgaatctgcccaagccgagagaaagggagtgatggggagcgctaggggcgggggatgccaacccgaaccaaaacagccaggcagtacacttctaggtggttggacgcggactagcgctgtcgaagcaggctgctggagggaggagggaggcccatctgctcagtgagagcccaggaatctcgtctttcagtggctgcatcgttttcaccattagttgagggaatcgatctgtgccttcattctaagatgccaccgcattcggggcagagccggggccggaagccagggagctgcctgctgctgctgctgctgctgctgctgctgctgctgctgctgtaagatggtttctgtgcagggaaccttggccggctctgcagctgcccgcctgcctggactctccgatatccactcctcagtgcacctgacacgcatggagccggtcctttcctggaagccagaccccaaacaaactggcttccccgaccagtccactcccatgtgggagcttatcctcagaggcactgggtcctctgcctccctcgggcggctcgcctgtttcaggcatggatgcctgggaagggagtgagacgcagcaatgacttgtgcttctgccgagaataaaaatcctgagcgtacgtgtgctctagtcctccccgcccgctcgctgcctccgagtctcatgaagaaagctcggaacacctgctccacggccacatccaggagtggcagggggctggagagtaattattattttggcttatgcaactgaaaagcagggttcgttattacccgaagaggaggaggagtctggggcagttaattatataatgctcctgcctgtcaaagccgtgcccagccccggtctcaggcggccttttctgtgccgttgttgttttcatggagcaggttggagagcttccctgaccctggggcgctgagggccgggcgggagcagacggtgctcccttggttccaggctgtgggcctgtgtgtgtgtgtgcgcgcgcgtgcaggcacagggaggcccgggcagcagatgtgggtggctgagacaggcaggcagcctggcgcttccagctgggctgtttggagcccaggggctgctatcacccccaggctctggccaggaggctctgcagacctgtcctccagaggtgctcctggctgagcctgctccaggaggactgtgcaggccgggctcacgcagggcatggggacgagaggagccagggctttcgttgtctctgaaactcctcagaatatctgggggtgaggctgagcaccccactctgcccacgctcctcagacatctccagagtcctgaggaatcatttctttcattcaacaaatactgatggaatgtttgctatgagccaggtgtgccaggctctgggaaaaccacactgagcaaagcagacagccaggtgtcctaggctttggaaaaaccacactgagcaaagcagacacagatctttgccctcacggagcttacatttgagggagaaggagcggcgattatgttgtgactttttagggaagaaaggatctgattctgtggctggccgtgtagtttaggatctgacgggttaaggggagagatgtttttctctataggtccacttccctgggctctccactccagccagacagctccctcagcatcctgctcccctaagcccttcccctccttgtggtcctgcctgatcatgtccattctacagatgaggccagtaaggcccgggctttgtgattcaggagtcccagcctttggctgcagggatccccgatctgtctgggaccaaacccccctcgttcttgcatcacattgccggaagaagcccagattgtcaacatcctctcaaggggtatgcggttcttagctctcccataagcaaagccaggcagggatgcagatggggagcttcatggccggctctcccttttggttggcaacatggcatgacaggaaatagaattgacccttctggtcttgaggactcgggcctggacatctgggccacttttctggagggctcccagcttcctgttgggaagggggtgattatggcactgagtgtccccaggcagcccatggaaggagcctgcagggtgtggggatcgccagaatggggcagagacctccatgcctccttcccagtcaactggtgggtggtgacagccatgtcgcagtgaggaaggagttaatggccccagctccactctgacttttcctttgcacaagaagtgggggaatattgggcagccatcagcgaagctctggaacctcagcccagctctgggcgctgacttggggaaatggcgattttcatgaatgatgcaccagcggccagcgtattccacatgtagctggaattggtgtggaatttcagctggggacacctgtgccaactcctcctcctccaggtgtgtcctccccttagggtactccctgattgagctgagtagctcctaccgtctgcatggtgaggcctgggggtgtggggtacaggcacacttgcttccagtcacaaccccagcttgcatcctgggcttgaatccctgccctacatgccctgttttgtgaccctggttggattacttaacctctctgagcttgtttcttcatctttacaaaaggttgataacaatacctgtaaggtgggtgaggattaattgagaatggtgtgcgtggctatgccaggaatatagtaagcatacattattatttaccgttagttttttcattacagtttccaggcaatgcatgtcacttacaatgatcattattagaaccaacatctggacaggagactggtgatcatgtaaatgatgttaaatagcaacattagatacttactgtctgccaagcatgtggcaagtgttaaatgaattacagcccttaattcttacacctctagagggtgattttcttgttattctcattttccacactgggaagtggaggctcccagtgggtgtgggttgggaggaaccagcaggcgtcacactcaggacagccatcccagagcctgggcctttgctaggtacgtcgctctctaaatgcccctgtgcaaaaacacctcctgttctttcctctcgtttatatctctcgttctcttgtgcgtacagtggcccagaattgcaggtgaatgcccatgcacagacgggcaaacccatacactgcccaggacccctggccccctgaggcccaccatgcatgccggtgctgcaccgcacaggtatagatctttccttcgggtgctgtgtacacagaacccctcgaatcgaaagttaccccctccaataagccctcctacaccctgaaagatatgagtcatctcacgcccaagcctctccccctcatactcaggtcccgttcaccggcccagattcctcaacccacacaaatcacacacacccacagtcggaattcagatccccccaggcgcctgcgcacacacacgcgcacaaaacacctgccacccggagacattttccaccccgtcccccagaacgcagccactgcgcccttgcggccttgcttgctctccactggccaaggactctgaatctccaccaggcctgtaaacggggagctcagatgacagaggcagtggtgtgcttcgtttccattttaaacacacgtttatgctgttagtgcccttttagggagaaaaatccctcatctcaacaaaataaactaccatggggcgtatgctttgtgcttggctatgactatgactatgcaacaagtaatttctttttcaaatgagtgcccaggttagaaggaatcaggttcattggtgcggagattatgccaacagaaactcatttcagaaacaagaagcaagccctgagcagttggagacgaaagcgttttctccgagattctctttccgctacttcggggggcgggtggtgaaaggctccgtaaggtgaaaagagaaaggaagaagcaaacagctatttttttgttgccagttatagctgagaaacaaatgtggctgaagggcacccctacccacgttggccgtgaggccgtttgatgggctttgtgtgaggaatcctgagatgagctggccggggagtgaggaccggcacccgcctacagcagcgatctggagtagtgagtgagcagccccagctgacacagagaaggagagagagaactctgaccccttctcttctgaggacacccagccggagagagcaagaaggggtggagtgtgggggtgggggcaggagcctctgctgttcctttccaagactttttcttcctgttttccccaagcctccacaactctaaatatgacgagctctcaactgtgagctaataatgttgaatgtaacgccctttgtgtccttagatgacaaaaagacttgtgagtactagaggagagggtgatgttggtgtgaattttccacattggtccgtgtctccgtggactggccgcttcccccgctggtagcttcatggctgtgagaggccatgcggtggatggagccaccgctgcactggggtcctggctcgaacttgagtaaggtgctgtcttccaagtctggagaggagaggaggagagaagagaggcagtcccttcagcaccttggagagcgctcccggctgcctgcctgggttgggtggacggctggactcactttcgctctaggcatcctcttcaagccaaaccatctctccttgccagtgaccgcctggtcccggaccctccagcacactcaaccaccagaagtgtgcctatgcctgtgccagatgtgggggccacgcctgcgatcccaacactttgggaggccgagatgggaggttcacttgagcccaggagtttgagaccagcctgggcaacattgtgagacccccgtctctacaaaaaatacaaaaattagccaggtgtggtgctgcacgcctgtggtcccaccactcaggaggctgaggtgagaggatcgcttgagccccggaggtcaaggctgcagtgagccaagatggtgccactgcactccagcctgctgacagagccagaccccatctcaaaagaaaaagaagaagtgtgcctggtcctactcagtcggtgcatggattccatgctccaggaagggctgccacttggcatgcctgcctatgttttcacccctaccctgtcagtccttcctgaagaagtgagtgtcttctgaggtaacatcctctgctggtcaactgggagagcagctcccagcttgtggaggtgggtttgggggtgagactttatttttttgtttttatttatttatttatctgttttgagatggagtctcaccctgtagcccaaggtggagtgcagtggagtgatcttggctcattgcaacctctgcctcctgggctcaagtcattctcatgcctcagcctcccgagtagctgggattacaggcatacaccaccacacctggctaatgttttgggttttagtagagacagtgttttgccatgttggccaggctggtcttgaactgaactcaggcgatctgcgtgcctcggcctcccaaagtgttgggattacaggtgtgagccactgtgcccggcctagggtgagactttagtaagatgtatagaagttgctctgaagtctaaggtgtattcctgccataggatatgtgtgttcacttctcttggagcataacaggggtcataggtgcacagccgaaggcaggcagaggaatgatttgtctgtaccagtcagtgaaactgtttcaccaccattctctttacatctgcctcaatgggtgagtcctctagaccaatggtccccaacctttttggcaccagggacctgtttcatggaagacaatttttctaccgcccagggttgagggatggttttgggatgattcaggcgcattctatttattgtgtgctttatttctattattattacattgtaatatatagtgaagtaataatacaactcaccatcatgtagaatcagtgggagccctgagtttgttttcctacaactagacggtctcatctgggggtgatgggagatagtgacagatcatcggacattagattatcataaggagtgtgcaaactaggtccctggcatgagcagtttccagtaggctctgcattcctatgagaatctaatgctgctgctgatctcacaggaggcagagctcaggcagtaatgcaagcgttggagagcggctgtaaatacagacgaagcttcacttgcttgcttactcactcgccactcacctcctgctgtgtggctgggttcctaacaggcaacgaaccagtaccagccacatttcacgggctcaacagccacctgggactagtcgccaccatattggacaatgtaaatccagaacattccatcagtgcagaaagctttattgggcaggcagcactggtctggagtgtaagttccatatgggaagcggtttgtgtccatgctggtcactgccatgtgcccagtgactaaaatggtgctggcacgtggtggtcaataaatatttgtggaatgaatgacctgtgcaagtaaatgcggtagtatttggtaattttgtttaccgtcattatttcgtatgcctgtttcattgcaagaccttagaattggacgtagttaaaggaaagtttttccgtgagaccctcatgtccacaggtcagtctccctttacaattagcattaaaacatgcctgttctaattccttgatcagttttgttttgtggttggctttgtcattgctccttaagagactgccagtgtttcatatgagaaagatgatggtgttgaatgcagtgaataatggagcgataccagcagtcatgactgggaggcatttttggaccacgatttaatgagtagcattcattgcaaagtgcaaagaaaggcccatggaaagatgagtaccctccagtctgcttaattcctcactatctttttactgctcccttttccttggcttgattcgttcagtcattggagaagcatttgccaagttcagaccgtgttcaaggcacaaagacagaaaagctcaggtccaacctcagtgaatcagccttaagtatttgctgagcattgagtatgtacgcagtacagagtttgtggtaacgtggaagattggaaaaaaagaaacaaacacataaaaatgaaaatgcaagaaataggatgtcctatgttctaccaggaagaataaggagtctgaacagggatgcaaaaccgagatatatggaataattcagggtttctcatgccacagtgggggtcctgaatgggagcaccacagggcagggacctgaggaggggcagggcaggtgtgtgtgtccctgaaggagcggcagaggcttctgggggtaggcagtgcctgagttgagtctggaagggcagtagggtgagagttgttatcccaagcctgaggctgcagatttgttcgaggccatgtctccctcagcctcagcttccccatctctatgatttagtcatgacatttttttccttctcaacatgtgccatctccctcctacctatgaatgtcacgggtattgttctggacccagggaaggctcgctggtgcaaatgctttccaaaaacaccgagagtcgctctctctgctgctggtggagtctgagttgggcaggacatgggcccgcctctgtctgctgctctatgccagtgcttcccaagcctgagtgttacaagaaccacctggaaggtgtgtcaagacacagatttccagccccacccctgagtctctgggcctgggatgccacccaagaatttatatttcttacaaatttcaggcgatgctgaggctgctgatctggggacctcacattaagaaccacagtcctgggcttgtgcctcctaagcctggctacacattcgagtcactaagaatgtccctgggagacggttagaaatgcagcgtgtcaggcctgcctgacctccagggtcaggatgtgtgtttggagatgctcaggtggctgcagtgcaggagatcctgctttggtgcactcactttaaccctagctgtgcatgagcttcatctaggttgctttagaaaatgcagatgcccgggccccacccacaggtgctgattgaggtcctctgggtacagcctgggcattgggattctttttattttaatttttttcagacgggggctggctccgtctgtcgtcctggcgtgcaatagtgtgtgatcgtggctcactgcaacctctgcctcctggcctcaagccatcttcccacctcagcctcctgagtagctgggactgcaggcatgcacccccatgcccagctaagttttgttatttgttgtagagatggggttttgtcgtgtttcccagactggtctcaaactcctgagctcaagcgatccgcccaccttggcctcctgaagtgcttttacaggtgtgagcaacttttttacaggattacaggtgtgagcaactgcacctggcctgagattattttttaaacattccaggtgattctaacgttcagcgcaggttgaggaccactcatctggagcgtctgtagctggacatcacttgggagctttgatgactgacccatgccggggtccatccaagaccactgacactggaaactttaaggcgggggtctcagcctgagtatctggtcacagcaagcagggcctagagttgcagctgtagataagagtttttcacactctgggtcaagtggttcatgaaattaatatagtacattaaaatagactagaggccgggcgtggtggctcatgcctgtaatcccagcactttgggaggccgaggcgggcggaggccgaggaggtcaggagattgagaccatcctggctaacacagtgaaaccccgtctctactaaaaatacaaaaaaaatattagctgggcttggtggcgggcgggcacctgtagtcccagctactctggaggctgaggcaggagaatggcatgaacctgggaggcggagcttgcagtgagccaagatagcgcccctgcagtccggcctgggtgaaagagtgagactccgtctcaaaaaaaataaagtaaaataaagtagactagaaattttccaagcacaatacctacgtttctttctttctctttttttttttttttttttgagacagagtctcactctgtcgcctaggctggagtgcagtggcgcgatctcggctcactgcaagctccgcctgccggattcacgccattctcctgcctcagcctcccgagtagctgggactacaggtacccaccaccacgtccggctaattttttgtattttgtttagtagagacggggtttcaccgtgttagccaggatggtctcgatctcctgacctcgtgaaccgcccgcctcggcctcccaaagtgctggaattacaggtagcgtgaactcagctcactgcagcctctgcttcccgagttcaagccattctcctgcctctgcctcccgagtagctgggattacaggtgcccacgaccatgcctggctaatttttgtatttttggtagagacggggtttcaccatgttggccagactggtcttgaactcttgacctcaagtgatccgcccacctcagcctctcaaagtgctgggattacaggtgtgagccacctagcccagcctattgtgttgtttttgaatatatttttgatctgcagttggttgaatttgtggacttggaacctgaagctatagagggctgactgtgtatgataacctagaactgcaaagccagggaattcctttgaaagaaaaacactttttctttctaaaacatctattttgttccaagtattgtgctgggcattttatcatagacgttatatcttacattccttaagataatgccttgagataaggcattccgctcccatttaaaagacaggaaaggtgaggctcacagggtcacactcgctgagatcacagcgctgcaaacttgtttctggccgcagaattgtttccggcgctccgagatgcctttcttgatggagccagcattccaggggcccacttgctttacagatgaggaaactgaggcccaccaagggaggggccctgccccaggtctcacagtgaagcaggggcagagaggtttcactcccagcaatttgtaagcttgggggactgccagcgtggtgtggacacagagctgcgtgacccctcccaggataaaagcaggtccctgcagatacgaggagccgcgtgtcccctcccaggataaaggcaggtccctgcacacaggagctacacgtcccctcccaggataaacacaggtccctgtacacaggaggagctgtgcgtcccctccaaggataaaggcaggtccctgtacacaggaggagctgtgcgtcccctccaaggataaaggcaggtccctgtacacaggaggagctgtgcgtcccctccaaggataaaggcaggtccctgttcacaggaggagctgtgcgtcccctcccaggataagtgctggtccctgcacacacgagggtccgcgcgtcccccgcaggataaacgcaggtccatgcacacaggaggagctgcgtgtcctttcccaggataaaggcaggtctctgtacacgtgtggagctgtctgttccctcccaggataaacgctggtccctgcacacaagggggtctgcgcctccccgtcccaggataaaggcaggtccctgcacacgtgaggagccgcgcgtcccctcccgggataaactctggtccctgcacacacgaggagccgcgcgtcccctcccgggataaacgctggtccctgcacacacgaggagccgcgtgtcctctcccaggataaacgctggtccctgcacacgtgaggagctgtgcgtcccttcccgggataaacgctggtccctgcacacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacgtgaggagctgtgcgtcccttcccagaataaaggaaggtccctgcacacatgagggttggtggctctcctgagggttcacaggttcccggggacccatccacagatccccagataagaacctgtccatcctccccggggcctaagcgtgcccagattgatctcagtttgcccagtgagtagaaaaataggccgggatcagcagattcctatagacctggtggaggcctgggctggagtagacccaggcagagttggtctttcacctcgcccccttccggaggccccgtacccttggggtcagcatccaggcaacatgggatacccagaaccttctttcttgtcctgagcccttctctcccagctcggcatggacttgagtgacagctgctgtgtttctttcctgcccagtgagtggggccgggccctggagctttccctgttcatttgtttcgtctccttgtggggaaagcatggctcccccattttccagatgggaagcaggctcagagatgcaacagaagtgggaagtgatggagcagggactccatagctccagtcacgagtctcaaactctgtgcgcatctgggtcgcctgacccggcctccctgacccgggctgcccagaagggagcccaggaatgccggggagggtcacacagccagggccattcaatgcaggtggtgctgggaccacgccttgagaagctccagtcgccttccctcctctgcaatgaggcattgctagggggaggcgagtgggggaagagaccgggtctgttggggtcagccccgggcacagcacccgacagcagaggagacctccggaaatcatggctggatgggtcaatgagtggtcaatcaggcgagctctgagcgacaggaggggccggtggtgtggagagagggaagaagagcctgcaggagggagacggtgcgtgcaggggcaccacggccagagcctgcttggtgttcagagagccctgtggctgccgcagttgggagaagggcacggggtctgagcacagacagcttccaggccccagggttgggggactttgaattttctccagggcccgggaacgacattgtctgatttaagcagaacagcaacgcaatctggttttgtgtgtgtgtgtgtgtgtgtgtgtgtgtgtgtgtgtgtgtgtgtgtatttttttttttttgagacagagtcttgttctattgcccaggcgggagagcagtggcgcgatctcagctcactacaggctccacctcctgggttcacgccgttctcctgcctcagcctcccgagtagctgggactacaggcgcccgccaccacgcctggttaagtttttgtattttttttttttttgtatttttagtaaagacagggtttcaccgtgttagccaggatggtcttgatctcctgacctcgtgatccgcccacctcggccttccaaagtgctgggattacaggtgtgagccactgtgcccagccaggttttgtatttttgtaattacactttttattttgagatcaccgtagattcccaggcagtggtgaggaatagatcagagatccggtgtccccctcatgtggtctctcccgaggtggcatcctgtgcaactgatgacatgtcggaaccggatattgacgtggacacagtcaggatggggagcacccgcgccccggggtcccttgtgttgcccttttgtagccatacccgctgccctggcagcctctgagctgttctccattccttcagtttcgtcgtttccaaaatgctctgtaaacggaaaagtacagttcgtcattttggggctggctttcgtcactcagcctcatttgctggagattcttaggtgttgcctatatcaatagttcgttccaggctgggctccgtggctcacgcctgtaatcccagcactttgagaggcctaggcgggtgggtcacctgaggtcaggagttcgagaccagcctggccaacatggtgaaaccccgtctttactaaaaatgtaaaattagccgggtgcggtggtgcgtacctgtaatcacagctactcggaggctgaggcaggagaatcacttgagcctgggaggcggaggttgcagtgagccgagattgcgccgttgcactccagcctgggtgacagagtgagactctgtctcaaaaaacaaacaaacaacaaaccaaaaaaccaaataaaatagtcctttctttcttattgctgggcggtgtcccacggtgtggatgggccgtttgtttaaccatctgtcccttgaagggcatctggggtgtctccagcgtgggatgtcgtgaatttaaaaagctgctgccaactctcaggtccaggttttcctgtgcacagatgtcttcgctttcccccagtggatgccaggagagctggtgctgggccgtgtggaagttgtatggctgagttcacgtggtcactctggtgctggcagggcagggaaatggggggccagagaggaagctgggggtcatgggagggatgccacctctagggaggggtgcctgtgtccaaggagtggagatagtggctgggtctggtgggggctgtggaggtaggggggctgcatggtagggcagaggccaggagtctgggactgggtggtcctgtctttgagggaatttggagaaggagcaggtgcaggtgcaggagctgagagtcacctgtgaaacatgctcagcagagaagctgtgcgcagccggggcaggggtgcgtccatggtggggatggtgtgtctgggtggaaggggcggggcatctcccactcccggtggcattgaatagtgcgaggggagtggctgggcgcggtggctcatgcctgtaatcccagcactttgggagactgaggtgggcggatcacttgagttcaggagtttgagaccagcctgggcatcataacgaagccccgtctctacagaaaatacaaaaattagctggggcatggcagcctgcgcctgcagtcccagccactccggaggctgaggtgggagaatcacttcagcccgggaggtgcaggttgcagtgagttgagattgggccactgcactctagcctgggcgacataatgagacgctgtctcaaaaaaataaataaataaataataaaacttggaaataaggcaaaaaatattatttaaagaaaacagaaagtgggaggggagaaatgcacaggatggagcctaggggagccccaggactcgagaagtgggcagaggaagaggaggcaggaggagggagggaggccgggcagcagctgggggaggagggcgtggacaggccgggaaaaggagcaaaggcaggatgaggacacaacactggcctgtgcctggccttgtggcaaacacctcatcccttaggccattggccatcgtccctgctgtcctacagccccgagaggccaggtacgtccatgtgtcgtgcccattttacagacggtggagctcaggcctgggagacagactgacagtgttcggcactaactccaccccagcctttttccacctggccacactgtttactcgttcccgccagcagcatgggggctctggtgtttctgcgtcctcatccgcacctgtcatcgcctgtctttttggttgcagccacttctgggatggatttcctggaggctggtgctgagtctctctaggtgcttgtcggcccattggtacatctttggagcaatgcctgttcagatccttgcccatttaaaaattgggttatttcaggccgggcgcagtgctcacacctgtaattccagcactttgggaggccgaggtgggcagatcacctgaggccaggagtttgagaccagcctggccaacatggcaaaactgcatctctactaaaaatgggaaaatgagctgggcgtgatggcaggcgcctgtaatcccagctactcggaagctgaggcaggagaatcactcgaacctgggaggcagaggttgcagtgagccaggattgcaccactgcactctagcctgggcaacagagtaagactctgtctcaaaaaaaaaaaaaagggggggcactgcgcaccagcctgggcaacatggcaaaaccccatttctataaaaaatgcaaaaaattagctgggcatggtggtgcctgtagtcccagctatgaggaaggctgaagcaggagtatcacttgagctcaggaaatcaaggctgccgtgagctatgatcacgccactgcattccagcctgggtgacagagcgagaccctgtcttaagaaaaaaaaaaaaaagaaggattatttgtcttcttactgttgagttgtgacattttcgtaggctgtagacaccactgtgagccaccggctcccctgcaccccagcccacctggctgcaggctgcctgctccgttggaggttggacttctgagataaactgcgctgggtgtctgtctcttggctccagagtaccaggcacagtgccatgcacacagtaggtgctcagtaagcggcgacaggacaaagccaggatctcagtctgcggcttggaggggtctggggtccggctgtcactatctggctctgcttaccagctccggtcctcggacaccacgacggctgcaggcagagggaggagccacggagtctggggggatgttgggccacacaagtatctactgagcgccgactgtgtgctaggcaacaagctggccctggggacagtggtgaacaaagagccctaggacttcttggttgggggaataggacccgtcagtcagccctgcacagcttcctgcggggcacggatggggcgcaaggaaggggctggagatgccttctagggagtgaggctggtgagcgggttggggaggaaccatggggcctcccagacttcaggaggcgcatctgtgagcaccagggacagaaggaacagggccaccctgggacccagtgcgcaaggagcccaagggccctcacacgtcacccttgggtgtgccagagccagtccagttgttaagaaaaacaagagccggaggtaaaccccttgggaaacagaggtcccagcccacagtactgcgtgggagggagaagtgtgggagtcacctgggctctggggtccctcaggccagcaatggggactgggatcccagcgcaggctgagcctgggtggctatgtccacactgcagagacctatcgtgagcaagtttatggtgcattcctgtgtggaagagtacagcagaggccaggggggtggggctgcagcgacagtgaccaggagtcacccataggggcagggtcctggtgtcatgggccagagcgggccagagcggggacggggggcaaagggaaggagcatttgagcctggatgggggtgtggttagcagagaggtgggaggggagggagagagagagagaaggagagagagggagagaaggagagaagagagggagagggggaggggaagaaggagaaaagggagaggggtgggctgtgaggagagggaggggaagggctgcagagggggaacgtcagtcctgccatgggggggacgtgcgttgttcctcgcccctcccttccaggttttgatggtgctgtttcctgcgtttacaccacagctctttttgcgtctttccttggattccacacagcagccctgtgaggcgctgtcctcctgctgcccggaggaggagactgaggccagagatgcggcaaatttcccaaggccacacggttctgctgttggggcggcactgggcctccctgcccgcctgcctcagtctggccctgtgaagaggtctcttggaactgttaggagcattcgaaagaaactgggcccctgggctgggtacggtggctcgcgcctataatcccagcactttgggaggctgaggcctgagcacttgaggtcaggagtttgagaccagcttggccaacatggtggaaccccatctctaccaaaaaatacaaaaatcagccaggcatggtggcgggcgcctgtagtcccagctactcaggaggctgagacaggagaattgcttgagcccgggaggcggaggttgcagtgagccgaaatcgtgccactgcactccagcctgggcaacagagcgagactctgtctcaaaaggaaaaagaaaaagaaactggtcccctggagcgcaggggtcagcagctaacttctcgccctggcagctggacccgacttggcccagagtgccagggccagtgcccccatctgctctgtgtcgggaggggctgctggcaggaggaggtggccactccaaaatcctatagacggagtccgggggagggggttcgggacaggaacagcccagacctgggatccgcggctgcgcaaggggcttcagggtggtctgggcctggttctgagccctgtgaatccaaggccacaggactgggcctgggggcttctgaatccccaccagtgccttcttgctctcaggagcgttggccaaccccccaggccccagggcttcccctcgtgattctcctctgagagaaacacacccacctacagccgccagccaggagcaattgctgtgcaaacacccgggactgtctcagacggtggatgcaggcagccaagcccccggaaggctccggttgaagggccgggtttattcctccctgcaatgagggtggacactcccccaggaaccacggggcaagagggtgttgggaagagccccactagggtttggggtttgggtgggtggtggggaggggacagtctagggacgtagggctcactagaccaagtgctgttggaaagggggcgattctcctgtgggtgcgttggtcactgtcgcctgtagacatgggagacctgcaccaaaataatgcggagatgggtcaagaagcagccgcccctccccttagtcgagaggggggatggttggtgatcgtgggtggcacagtgacctgtttctatctcactctactgtgatctcagagtgaccttgtctggggtcactggggtgttctgggagatggtttatatccaacagaagaacgacgcagcctggcaggagctccaggtgtcaggggggggcccctttggggtggaggggatgcctcagagccagccgcatgccaccccacaagctacctctctgccgccgtctgccccagagctgcctgccttccgaggcctcagctggtcctgtgcgtccctgcgtctccaggactcttgggtgatggctcaggggaagtttccagaaagcccagccatttcctcctctcctcctgggcttgggtctgaggtcagcttcccagggggcacccaagcctccgtgagcaaggacagagagtggctggagtgagaacgggtgctgctgacctttggcggtgggagggtgtctccagctgtgttcccatttctcagtgactaccaggtgctgtggcccttggctgcagaggggcgtgcaggcagcctctccttcctgtgaagcagcagctgtggcagggccgggaagtagagctcccctctgtgaggctgtggctggggtaggaggagagctctcccttctgcgaggctgtggctgggatggaagtctgccagaggcgggctcagaagaagttccatgaggaactgagggctgggacctgcaggaggagctgagggtgcatggggtctgggggagccccagagatggtcagggtctcctcctgataaatcagacccccccccgccccaccctgccgctgagaggcctggtcctgctctaaacctggagtggatggggagcgtgggctggggctggggggctggggaggtggtgtagccagtgccctgccccaactcagcctctggtcacccttccagggctggcaaggcattgggggtatgagagggccctggggtcccagggtctcagaggacttgccttctctgcgatggccgctactacctgggtcccacaggggggtaagttcagagggggacctggtggaggtcggctgtgggcaggggagccacaggagtgtccaggcccctcccaggccagccccacagattctgaggcagcagtgggggcctcaatggaggagtccactctgcccaccccggatactgcccagccagcctgggttccagcgtgggccaagctctcgtcctggtctcctgggagctgtgtggtcctgcaaggacctcagcaccttccttgctttgagcatccctcccccaaggcctggctgacactcggagccagtatccatagagggctgcaggggcaggcgagggtggacactgatgtccttggctcattcctccctggctggctgctctgatgtccagcagggtgggcgtgaggctcatggggggctccccagccagggcaggacctggggtaaccctatcctgggatgtttgctcccgctgtgtgggggacatgccgtttccatgagtgacagagtcaccgatgtggccagtaccactgtgggcttgaggcatcttctagtttaaggaaatgttaaatttcaagtaaagcttagtgaaaataaggatgcaatttcattccccaacaaaacaacctctatttccttctgtgaaccccttgggagctgcagaccccgagttccggaccccctcacctcactctcctccttcggagccaaagtggtgcctgaaatctgaggccccatctctgagtcctgcactggtcctggcccgaacactcccccacaacgcatgggccacaaggaccctctgggcagattttggggtgtctttggaggtttaggggcaaagcttgaaaactgtggggtcctccctggggaccacatgcccagctgtggggtcccccgaggccgcagagcaagctttctggaagatcctcctcctttgagagccaccatggagcccccataatgggaatggagggtgttgccattaaacatggccttggcgttgcccagaagtctaggtgtgtccctgtcagctgggaggggacagggtaactgtgcggccctccccagggctgaggctggggcagcctccagaggccaggttgtcgctgtcactccccaaatggagggtccccctcattccctgattgcagaaaaagggctccagtaagtctggcttttaaaaaatacagctttgctgacatatgtttcacacaccgtacaattcacccatttaaactgtacagtccagtggtttctagaatattcagagttgtgtcactctcaccataatcaattttagaacattttcatcgtctcaagaagaaaccctctagctagctaccccttccccattcccacggctccccacccctggtgaccgagactccattttctgtctttgtgggtttgctgctcctgacgtttcgcatgcgtggagtcatacgctgagaggccttttgtgtgtcgcttctgttgcccagcgttgttttcagggttcacccgcgtgggagctgcatgagtccacttcttcgtatcgctgagtaatattccactgcggggcaccgcgttttgtgtgaatctgccaccactcaggatggctcatgggtggaaacagcctaaagctggcagaggtttgggctgtttgccagccctgggtcacttttgggctgtttccacctgggggctatcctgagtcgtgctgctgtgaccatttgcgtcctttcgtttcctcctgggtggagattgtggggtggcctggctgggtcgctctgggcccaactctctgagaagagctgttgaacacataccccacagctttttttagtttttatttatttcattttattttttgagacagagtttcactcttgttgcccaggctggagtgcagtagcgtgatcttggctcactgcaacctccacctctcgggttcaagggattctcctgcctcagcctccgaagtagctgggattataggcatgcgccaccatgcccggctaattttgtatttttagtagagacagggtatcaacatgttggccaggctggtctcgaactcctgacctcaagtgatccacctgccttggcctcccaaagtgctgggattacaggcgtgagctgcctcacctggccttattttatatactttttaagacggagtctcactctgtgagccagcacacctggcccatggcttcttttaaaaagagacttctggaagctgagaagtcttttccagggctccacctggcgactgaccactgggcatggtgaggtctgcgtttggaggaagtggggtgacagtgacagctgtgactattggagcacacagtcggtgctgggcaggtgggtcattcctgaaccctcagtgtttccctcctcgggggtcctggccagtcactctcctcctccacaccagcccccagcagctcgcaggctgcctgggcccagccccatcatcagccgctgggcacccacctgagaggtctgaaccctgcccttggtgctgcacggtcacttgccattttcgcagaggggccccctgagcaggaggagcagggccagcatgcacactgcagccaaggtcccaagaaggaagtggcgaggaggaggaggaggactggccccacctgttgccctatgtctcacagcgcagactgggggagacgtgaggatctaacaggggttcctggggggccttcatcaagctgtaatgaatgttgtgccaaacccctgtcaacaccagtgggtacagcacagggttcaagggctgaagaagtgacccagggctagcaaaggagacccggggtttactgcgagccgtggggtggggagggaagtgcagggacgggagaaccgcagcggcttgtagacagcgcaaagttcctatggcatgttcaccccataccctcccctgatgacctccacctgccaaccttcattcaacccaaaactcagggcctcaagcccctgcacagcgcacgttccacgggacaggccaggggctcagaagttcctcatagccaaggaggcaatctccagattggccactcctggattccttagctcaggttgttcttggagtatgcgtaagttactgctatcgggggtgtttaccctccaacaggtgtttggtgggggaggagcctccttgggggtgccaagagcaacagcggccggggtctcatgtctgtggggccactcccattgctttgtgcttagtaactgggtcttcaaggcagccctgtggggtgggaatcatttttatcctgtgatatttcattgtgcacacgtgcagactgaggttgcttaactaccccaggccgcacagttatcaccatggagctgggatttgtaccctggtggcttagcacagagcctgagcacacaactcccacccgcctgcctctctccgaccgcgagtcctccaggaggactggggctctcctcccagcaccaccacggccattgagcccagtgcccaggagaccgaggcctgtgaggtttcacctggggcccggagacaggctccaagtggtgtgggggcccctgtgcccaggttttccccgaggtgccggctcatagctacacatgcccatgggcctgcctgagcccggtgctccaagccacaccccgagtgggcggcctccctgccacgcagtcctcggcctgaggccgccacactcagagccactcagcctatggggtggtgcatgtccagaaccctgacccttgggaaggttgggatggttggagatgcagatgttccaaggggaagtggcgggagcgggtgctggctgggaccaagggattctcaagagaagacgtgagcttcactcaggcacagctcttcagcagcaagagtgttggtcctaaaagatcatgtaaatagaggagggcatggtggctcatgcctgtaatcccagcactttggggagggcaaggtggaaggatctcttgaggccaggagttcaagaccagcctggacaacatagtgaagccccatctctatttattaaaaaaaagttttttaaaagataattttaaaaggtggttgattctgaaataagaatcacctgggaagctcttaaaagcctcaagcccgggcctgccccagccccgctgaatcagtgtctctgggccggggggcgaggccagtcattagttgccaaagttctccaggtgattccaactcaagcctctttgccctagagccgtggctcagcttgaggagcattagggcccctggaggttgttaaacccacgttgtggggccccagcccccagttcctgatgcagctgttggggtgagctgaaaatctgctgcagagcctgcatttcagggttcccaggtggcgccaccagcttgagggggtcttggcgctattgtaacgataacagcagcggtctccagaaccttctgtaggcctctgcatgctcacaggttagaccactgagaccacccatggattttatgtagtagacacacagggtgggcctcgtgcccagtgttgtctaacatgctttgtaagtgcagacccgttcctcccagtgcctttggaggtggagattgtggtccttgttttacaggcagggacagtgaagggactgtgaccgctgttggtgccaggcatctggctgcagctcccaggctctcatccctttgctgtgctcctttgcagcttggagggaatgattttttatccccatcttacagtatggggaaggtgaggctcagagaagtcaaggacttctgtctggggtcacgtggctaggaagctaacagccaggatccgagctcagatttgcccgacttccacccatgccggtgggcgggttttctccttggagaggggccagtcctgccccgaggtgccatctctgcacaggtaacagcatcagccaggcaccctgcaggccaccccgcccctcgcaggggtttccactaaccctgctgtctgccaggccagcctgtgggccccaccacctcctgggtgagcgttcccaacatcagagctatgcagcaggcagtgaggggatcatgggtctggcaggggcaggactgggagggacacccttatgtgctgtgtcctgttcctgcctcccctgttcacgccccacagaggagggaggaagctggggttaagggcaagggacagttcctgctctcccaggccccacaaggcatgcaagaggctaaaaatcagaagccagcaggacgcccaggtctcctgagcctgtgcgtctgatctgctcacctgggagacgatggtgctggcatgggcgggtcagaaggagcagcaggacccttccacggcccaggacaagccagccctcaggggccagagcccccatgctgggcacagggctgccaccttgggcggtgccctccctagctgccgcacttcagagtgagcccccatccctggcgtctgccctcctgagtgagtgagggaggggccgggtggggccggatcgtgatcagagccggagctggccttcgtgagtgatggccttgcctgctctgttgcccggtgacagtaaagaatattcctacagagtgtgggttttggaagcagacatgcctgtaggggtcctggctcagacgcttacctgacgttagcacctgggcaagtggcttaacctcatcactcggtgttggcatctgtaaaatgggcacaataacatgctaatgtctccctcgcggggctgtgcgagaatcgattcagtggcccgtggaaacccctagcgtggcccggatgtgtggtgagtggccttggaggcgtcagccttcatgggaggtgggagagctttgccgtcctgggtgaggtcggggtaagagaaagcagagtcggtccccagcaggtgtggctgggaggatgctcagtcactcccaatgttcattgggagtcactgtgctcccagtggacagagtgtcaggtagggtctacagatgagccccacttcttagccttgccctgggtccacaaatcagccagagttactgggtgtggggcttcctcaatgtcagggatgggggtgaacagaagggctgggtccggagtctccaaggctccttccaggctccagggctaacgctgtggggggggcccaggtctccacctcttgttgctgtgtggccttgggcaagtgactcacttctctgagcctctgtgtgtcatggggaagtgactccatgcctgctgctgtctcggtatttcacaagtgctcagcaaatgccagcagaccgtgtccttcagacgcggcagctggggttcctgactgctgggctactgctgcggtggctcatgaaggtttttctgtccccactacaaaacaaaaggcagctgatgcaggagttttagtaaagataatgtatattttagtaaagataacgtatatttgatttaaaagaatgctctttattctgagatttggtccatcccatctttgtgggtttttttttttttaatttggatgtgaaaaagacattccctttatttgtaattgcccaaagtcggaagcagcgaagatgccattaaatagggaagtggataagcaaacagcggtgacgacgcggagcagccttcaatgcctggtgctcagcgggataagcccgtgtgaagaggccacatcccgtggggttccaactagatggcgttctggaagaggtggaactctggagacagtgacaagatcattggttgcccagggttgggggggagggagggacagacaggcggagcccgggggatttgtagggcagtcatactactctgagatactctaatggcgagtatatgtccggatgcctttgtgcacacccatggaaggcgtggaccctgatgaaaaccatggctctggttaataatgtatctgtcttggcccatcaattgcgacagatgtaccacaagatgctaatatcaggggaagtggggggcgaggggatacagtatatgggaactctctgtactttccacttatttttctctaaagctaaaactgctctaaagtattttttaaaaagaaaaagttaaaaaaagaccacatgaacccatgtggagagtggaagaagcaaagtcaaaacattgcccagagtccatgctggaagccagttggggcgtggctgctccactcagttgactgtctgagtcttgtccccacagcacagattggtggaccttcagcccccacactggaggcactggccttccgaatcccttctcacctgagtggggtcaagacgcacctgggtcctatttgctgcccacctctggggccagctgctgttcttggcacctcccaccctagggggatggtgtctgcaaacggtgcttttggcctctggcatgtccaccctgccacaatcatcttcctcaccctcatctgcagaccttctgacaccacctctgctgacccctctccccttgtccttctggggagatcacgaacctgccccttcctggcattccccagccagtcctccctggggagcaggactgtgcatcgaggccaggctcaggtcttcacccacacccacgttgacaacgtacgagtcccctctgagccttagtttctgtggctggaaaaatgaggttaatatcactattgtgagaatcttctcataaacgcatctttccttcccctcctccttaaaatttttaatccttattgagctattatgtgcccatagtttaaggtgacatttggtgctaaaaacaaaatagagcttggagcaaaaatcatgtgtgtcttcagagactgaccaccatgtttttaagtgggtgtgtttgccgcttcctgagctcatggtcacttttagccattatctgttgactcctactgtagtagatggagattttcaatcccttagacccccattctccccactcccagctatctcaatattgctatattgcattttttgttgttaaatccatactcagtgtttttcattatgactatgtaagtattgcttactgctgagccaggcaatggagtctgattctgtacacttctcatgcataacttgagttagtaattgtctcgctttttttcagttgcaattttctttaaatcactggttcttttttcaccttccaactgctcagtgaaacacctctcaaatgcagcttgcacttgagcaaacctgccagattcagtaatacacacaaatgtacaaatacgtttgtttattgattgattgccttcttcccaattcttcccccattttcctgggtatttccttcacttctcctgtgtttgatcttctcatgtcttctttcatggtttcctccctcatttgggtggagcacatcctggagtagcttcctaagaaaggatgcatggaagatatagtttctgtggcttgattatttgataaattggtatgcatagtatgctaggttgaaaatcatttctgctcataatttggggcggtgggggtgcagtttcccactgacttctaggttcagtgttgctcttgagaagcccatgctgttctgattctcagtccttcatttgtgatctgtttttatgtttctctggaagcatttagggtctttgtcatttgagttctgaatttcatgccactgtatcttggttgggtgtctctcccctcattgtgtggtatctgtgagccctccagtctggacgctcacacccttccattccaggagactttcctgtttaaatctttgcccattttccttccctgctttctagaactcctgctgtttagagttcgggtgttctggatgagtcctttaattttcttactgttttgcctacctacctctttttttgatctagtttctgaaagattttcttgatttttatcttccagcttatttaccaaaatatttcttttagctattatacttttaatttccagaagctctttatccctggtctttcctttttaattgcattttattctcattttgtattttatctctgaggatttaaattctggtccctcgatgtcttctcccacctgctgcattttctgattccccctcttttttcccacttatttgtaagttttggtcttttttgtccctgccaaggcttctccttgtgtctgaggaccgttgactgttcatatattaaagtgaggtacgaaaaagctgagtggaaacttgtgtgtgtggcagccttcgcttctggctacagtctgttttttcagaggaattttccacctctctcctggataaagtaatcctccctgtttgggtggggtagcaagcagggtttttggttcagaatgagcactttcccagtgcctgctgaagcattggcgaaaagacgaaaaaaagagcacttccctggcagtcctcccccaccctcctctgcctggtgggcttgtctgattgttggcctagaaacttttcttcctgggttctgcagaaggagagaaaactctcttcctttcattcattatttatatttctcagcaatctggctttttatcctttttcttggtttgtcctaactttaagagatggagtcttgctctgccacccaggctggagtgcagtggcacgatcaccgcagcctcaatctcctgggctccagcccctcctgggctgaagcagctggactacaggtgtgcaccactaaacacactaatttcaacaaaattttggctgggtgcagcgactcacgcctctaatcccagcactttgggaggccaagacgggtggatcacttgaggtcaggaattcgacaccagcctagccaacatggtgaaactttgtctctattaaaaacacaaaaattagccgggcatggaggtgtgcacttgtaatcccagctactccagaggctgaaacagcagaattgcttgaacctgggaggtggaagttgcagtgagctgagatcatgccactgcactccagcctgcacgacagagctggactctgtctcaaaaaaaaaaaaaaaattttggtagagacagggtcttgctgtgttgcccaggctggtctggaactctggggctcaagcagtccttctgcctcagcctcccaaagggctgggattataggtgtgagcctccacgcttctcctgtccttttacttcattatttatatagttaatcacctcgctagagactgagaattctgtgtcctcaggctgccatcacaaaataccacagacagcatggcttaaaccacagtttatttccttgcagttctaaggctggaaggtcagggtcaaggtgctgggagagttgattgttctttgttttcgtgggcttgtccctctgtatgcctctgagtcccttcatagaaagacaccaggcctattggatgaggacccccagtgccttcatttttaactcagccacctctttaaagaccttatctatctccaaacaaggtgacattctaaggtggtagaggatgccgggggtgggggtgggtaggactgcagcatatgcattttggagaaacgcaattaagcccatagtgaattccggcagacataactattcagaactccactaagattaaccaaaaaaaaaaatttatatatatatatattaaatgatgggcggggcgcggtggctcacacctgtaattccagtgctttgggaggccgaggcaggcggagtacctgagggcagtttgagaccagcctggccaacatggtgaaaccctgtctctagtaaaaatacaaagattagctgggtgtggtggcgggcgcctgtagtaccagctactcgggagtctgaggcaggagaatcgcttaaacctgggaggcggaggttgcagggagccaagatcacacactgcactccagcctgggcgacagaatgagactccattgcgaaaaataaaaaaaatctggtgttggtagtaacgatgtaggggacatggtctctcttatagtcttttctgagggtaatttctgaaaaaccataaccccaaacccttgcttttgaccaagcaatttcattctaggaatttatcctaaggataaattttaatgtcatatgaagattagctgtgaaaacggaggagcgacccgaataccttgcggcataggattagcttgtaatttatgtgcttgtgaaacggccgtgcaatgaatggggctccgtgcagccggggacaaagtgggtgcagagaggcaggagggacaggcacggggcatgggggccacccgtggagaaagccctggagctttgtgaatgccgtctgttggccagcgcagggctctcactgtcacgttggacctgtgcccagggtctggtccctgatctgtgagggtcccagagggggcacaacaggcgaagaccccaaagacaggggtctgttccggggcatcctgggcagagagtgggtataggggacagaaacccagccaaagcggctcaagtggaagatgggtgctggtcgatatgggccagcctgaggggtgtcagagccgggaatggggaggccatcggaagcccacaggagccacttctgagttccctcagggtggaggcctggccgccttcccagtggtgcctgtttcttcctttctctgcgggttggcttctctgcgtccctgcctccaggtgggaaggggtccctgcaggcttcgtctcctcccagccgcagagccaccaccttgggctcccctgccccaggcccaggctggtggatctaattgggatttggtaagctgtgacgggaggggggctctggcccgtgcccacccatgggaaacgggccctataggaggcaggtgaggcgggccagagtgaatcagtggtccagtccagaacggaggctgtgacccgccagggtgggagaggacgggctttggggttgggcctcagccccgagtgggcaggcacagcatgggactggctgagagacgctctgtgtgggcttcggatcagctcagcgtaggtttcagtcccgctctagctgggtgacactggggttattttacctgtctctgcctcagtttccttctttaagtggacacagtaagagtgctgagctcccggggtagtgtgtggatgaaaggtgacctccgcctgcatggagccatggaaatgtttccccttttccctccactggactctgggacagtagtgggagcctgggtgggggcttttgcctgccagaactcatgggtcggggccgcacatgagtgagtgtctcctgggcagggctgtggccatgagctcaggtctttagtgggctccttgctcctcccagcaaagcgttcaccttgccccaccctgggacctctcaggtgctctttggaggtgttgacctggggcatctgtccatggccctgaggaggtggagcacctggtgagggctgcgctctctccagctgggaccccgggctccgaaactaaagttttgggaagagtgtcagctgacgggtggggcttcagaggaggaaaagaaacaagggtgtgagatgtgcaggccctggtgagagacaggcagcagcaagagcctgccagccatacttacccacaaggccggctgaggggctgtgctggcccagggctctggctttcggacccagacaatgctgctgaccaagcaggccaggcgctgagtgactgtcccagcggatctccgagcagggtcccttgagcattaggaatgcagcttctcaggccatgccagcctggcagaacaggaagggaggggtacagccctgtggggacgcagctgtggctcgagtgacacctgctggcggcctcatctcatccgctctctgcgagtctgtggtggttctagtcggcgtttcacgggcaaggtttagggggtttgttcctcagctggggtccacccacgtcttccgacttcctctctcagtgtttgggccatcggtgggtgaggtggctgcagcagagccgggggctcctgtgtgcggaggcagcaccgacatccactgcagccacaccctcctgagagggtctggaaggaagcagggcaccctgcgaacccaccttcctctggggtgtcttccggggccccagggccagggcaactggagcagacaggacattatctagctctgggggccgtgctgaccgagccagaccctcgcggcggcccacagagatgggcagcttgcggggcagctttgtccccccgacactgggtcctgtcttcatgcacacaagccgcctgttctgcaggtgaccagttaggttcgatgggacaggctttgggaatcagcggcttgggtttgccccccacagccttggatcttgaccttgggagaggcctccaccacgtgccctggggtggggtgggggcgggggcgtcctgcatctgcgccgttcagctcagttgccctcagccgcggttggccgccaagcactagggtgttgctggcacagccaaggaactgagcccagactttttgtttacttaatcaagcataaatgcaaagggctgggggtggccgagctgatggtgcaggcgtgtgcgctcaatagctccgtcacagtggctgtcgctttattgagcaaccgagggagcgagggagaggagcaactgcggcgagcgtggaggcccagcccgcagagctcccgtctgggggaagccctgtccctcactgcctgttcccggcgctttggtgccctctgctgtggggtgatgaggtcaggctacgcaggcagtcacggcagaactgaaggccgtgtgctttcgtgtagccaaaccccttttcttactgatatcagttataaaatcagagctatgttcccaccaggggcaaaaatccaacaccgtgcagttgcaaacacggggcaggaaagactccggcgaccctcattacactgtgccgggaggcatggccagagctccgtcagttcatgcgtcgcttaaacctagaggtgggtgcgattgtcaccctatcttacaggtgtggaaactaactcagctccgagatgtgactgaccttccccggccatagtacgcgcagcgcagtggggcctggacgcggctgcctggtttcaggtccacacgctccccagcactgccggccaggctccagcatgacgggggtcaggcctccacaaggccctgtcggccacgggagtttgctgcgagatcctgggtccctgactgtgttctcaaagcccctaggatttgaccagccgttcttttatcttaggagtcggaaatcttacatctgtatttttatttcgctgtgcttccgccccctgctctgctaccctcacctcactacgttgttttattggcatagtataaaattcacattttacaatatgcaattcagtggcactagcacattcacggggttctgatcatcagctctatcaggttgcaggccactttcatcaccccaaaaccccagccctgtgagcagccattcctgctcctccccggccatcatccgtctgtctctggatttacctgttcatgttatgggggagagagagagagagagagagtgtgtgtgtttgtgtgtgtgtgtgtgtgtgttttaaatgaaggcttgtggtacggggtctgttctcattttgcgccggtgttgggcctgaagtgtgtcctgtgtgcatgtctctgacccccggagtcatgggacccagtcacgtgctgcgctgacgtggagtccgaagttgtaaagacaaagctgggtgagaccctagtgactcacaggcccttctgctctcctttccagatctgggactttctcggggacaaccctgggataacagccaccactggagtctatgcttgaaggccattccgcctcgtggtgccctgggcgaatgtcgagggaaagcagactccctgtgcccccggggttggcttcttgctcaaggattccagatgctggcctcctgggtggtgttcccatgccgagctccagttgggggtgtgaccagcaccccgtgcgggggctgctggtgttctgtgttgtcagagcagtgctgttttgtgtttttctttaaaaaaaaaatttttttttgagatggggtttcactcttgttgcccagactggagtgcagtggcacaatcttggctcactgcagcagcctctgcctcctgggttcaagcaattctcctgcctctgcctccccagtagctgggactacaggtgcccgccaccatgccctgctaatttttatagttttagtgaagatgaggtttcaccatattggccaggctggtctcgaactcctgacctcaggtgatctacctgcctggcctcccaaagtgctgagattataggcatgagccaccacacccggcctccttttaaaattttaatttttaatgagatggggtctcactatgttgcccaggctggctttgaactcctggcctcaaatgattctcctgtctcagctgtgttttgtgtttgctccagccctttgctggtgaacagacacgttcactggacacctaagtgcctggaccgtggagcacagggtgggggtgctgttcatggccggaacgccagaggctactggggagacacaggagcgaccaccatgatccacagaccaggactgtacagagcacttgaaggggcggcctcaagaattgtgccggaacagtgaacatgagggctcctggctcccctctgaggacaagggttaggtaggaggggacaggggcagggctgaggtgggtcggcttggttcatggcagggcttggggagtgaggagagtgaggagtaccgggacccggggtccctgctctgctcacctgctgagaatgagccagtgttggcctctggtctccatgtctgtagagaggcttctctgcttcccctcctgtagaatgggaacgacaacatccagccatagagtgctgagaattcagggacaggacacagcgaaggtgccccagtcccccttcctgaccccagcctggcgtcaccctctatccaagggaagaagcagggatctgcctacgaatctctcaggatgtgaagtgtggcccccagcctggtgcctttgcagtgggcccaggacggagggtagccttggcacctggggaggacaggtgaacctggatccagactctgcctcaggtgacagccctgggttctaacgctgccgcttccgcttcctggctgtgtgttcctagggcggccacagcccctctccagcctcagttgcctcacctgggaagagaggtgcagggcttttgcgatgatcataatagttaccatcaatcgagcattagcgactttccagcaccttaaggcagttaccctgtgatctgcacagccgccctcccctcgttgcagatgaggagactgagtcagagagaggttaacccagacattcccaaggttgtagattgagaaagtgttgagttgggattcgaactcaagtctgtctgaggcctcctagccccttcctgaccccagagccttccgcacctcatggctccaccagaccctgcatgaagctcctggtgggcaaactgggcaccttcactttaaacgttgagggaaaaatacacataacctacagtgtcccgtctcagtcatcttcacgtgtgccgttctgtggcattaagcacattcacgctgttcaaccgtcaccagaacttttccatctccagaactttctcatcttcccaaaccgaaactctgtcccactaaatgctcactgcctgtcctccctcctgtcctccctcctggcctccctcctggcctcccgcctgtcctcccgcctgtcctccctcctgtcctccctcctggcccctcgcaccctccgttctactttctgtgtctatgagtctgatgactccagggaccccaggagagtagaatcccacaggatttgtcccttccagcctggcttattccactgcatgacggcctcaaggctcatccaggaagcagcaggtgcccggctttccttcctttttaaggctgaggaatattccactgcatggggggaccacgtcattttatccccgatgccttcacttttcagctcttgttcccatctgtatctgtaagctggagcatcccttgatggaggagggatctcagggagtgggtgagcctctcctctttccagggtcatcctccactttgcgggggcagcccaccttcctggagttccagctgagggggggcccaatttaacaagcactttgggaggttgaggtgggcggatcatgaggtccagagattgagaccatcctggccaacatggtgaaaccctgtctctactaaaaacagaaaaaaattagctgggtgtggtggtgcatgcctgtagtcccagctactcaggaggctgaggcaggagaatcgattgaacctgggaggcaaaggttacagtgagctgagatcgcgctactgcactctagcctggcgacagagcaagactccatctcaaaaaaaaaagggttgtccggttacctgtgcatgccaggtaatcgacaaatgctttttatttttatttatgtatttgtttagagacagagtcttgctctgtcgcccaggctggagtgcagtggcatgatctgtgctcactgtaacctccacctcccaggttcaagtgatcctcctgcctcagcctcttgagtacctgggattacaggcacccatcaccatgcctagctagtttttttgtatttttagtagagacaggatttcactatgttggccagcgtggtctctaactcctgacttcaggtgatctgctcgcctcggcctcccaaagtgctgggattacaagcatgagccaccccacccagccaacaaacgctttttaaatataagtatgtcccatgcagcgtgtcccctaaagaacgatgtgttgttcatctgaaactcagatgttaccaggcgtcctgtgtttgatgtgacaaccctgtccacagccctggcacggaaggggcagtcgctgagggtgcagtcttggggtgagggtccctgtgatggcagcctgtgtccagcttggactggccatgggaaggccactgtgtgggcgggtctggccttggtaaagggccaccccctgagacccaccgagcctagttccagtttcctcctcacaaccccagcctggaagggcgttcgggtgtggagcaagccacagggtttccccccagtgtggttcgcattggggtgccgggtggttccgagtcagctgccccctctgcctcctccccgtgcccatcacaactgcccccagtgctgggacctctgggcaagaggctgaggctgacactctggaaaggtgtgcagtggtgttgtggggtccctggggtccggtccacatacatccctgcttgcccggctcttggcatcctgtaggagaaggtgccacagcctagtgggtgggagggcaggagccccatcactggagtcggaggttgcttttgatgttgatggcagtgaggttgcttctgatgttgatggcagtgaggttgtttccgacgttgatggcagtggacttgcctccaggttagctgcctccccaagcagctttgggggtacagaatgaccgaccagtgtgggatcccaaacatcctatccccttgcctgaaagtgggacgaggctgaagctgacctctcgctgagaccacctcattcggccccgtcctctgctgccacgtccttcttcctggtaccccccttctccagccccaaataagtcacgttcacaggatccccagctcaggctctgctcctggagaagctgccctcagaggctgcgttgccgattcctttttcaacggagaggctgcagcgtgtggcaggtgccaccatctcttggagtgaggcagcctcaggggctctgtccggggctgcagcctgattggtgatctttgcacgccccttctctgccctggctgggccatatgccacatggggcgtgaggggcctgcaacacaagtccctctgggggctcgtgatgtggttgagctggaagatacattctggaacatctaagaccccagccactgtcctgagtctggatgccgcgggtgccgggcatgggggctctgggcccgggccctggggtgcttggaggtgctgtggaggaggggtggggctggcttggagcccatgggattcgattggagggtgggagtgtgagagaggagagagcgtgaacagagccttggacagaaaagcctggaaggatcaggaccctttggggggtggcgggtgaaggtggcggggtgtggggataccctggggacggacaggtcacttgaggctacaggactttgaattccacacttagtttggatcccaccctctggtgtggggcgtgtgagtggagggggcctggctagggaaagggggggggcagtggggagtggagggctgcttcgctccgagagatggcggcacctgccacccgctgcagcctctccgtttaaaaagtgactggcagaacaggagcagctgctgccagctcctgtccattttgtcctctgaaaagagaggtcggggtggccaggtcctcatttttcaggagacagaagagagctgaatttttatgtcaaatctcttggttttgagttgttagcaggtaattccaatgttttatgaaaacagcggtgggacgaataaaacctacgtatcagtaagtctcggcctccaggcctctggtctgcagcctgtgccaccgtgagttggaagagtggtggacggactctgttctccccgcaaaagccctttccagggtggcacatccacgccgttagtgcccggctgcagggagaagctcaaatgacaaatgaggcttgaggtttgccgcgttgggcgtcgtgctgaggcccagccgtcctcacggtgacctttggcatgaggagtcctggttccactctacagacgaggacactgagggccagcggggcccagaaacttccctgagtcacagctcacagagcaagacatgggcccaggtctgctgaccgggtttcctttttattttattgtggtaagagaaatacagaatgtaccacgttagctacttttaagtatacaattcagtggtattaattaccttcacggtgttaggtagctgtcatcactgtttacctccaaggctttcccatcatcctactgcaaaactctgtccctattcaacactgaccccacaaccctccccagcccctgcacccaccgcgctttctgcatctctgagcgtgactactctaaggaccccgtgtacatggaatcatccgatatgtggccttttgtgcccagctcagttcactctgtgtaatgtcttcagcgttcatccacattgcagcctgtgtgagaatgttctaccttttcaaggctgaatgatgttccatcgtatggacggaccgcatggcgtctgtccatttaccaggtgatggacttgtgggttgcctttccctttccagccatggaaacagtgctgctgagaacccaggtgcacaggcagctgctgcagtccccaccctcccttcttctggggatatcaggtctgctgattttatgtctgaaggtcatgggccactgtcccttccctatgcccttgaatctcttccatggtgtgtccactgtgtggtcttcctggatacctccagcaatggggagctcactgtctcccagagcagcccattcagggcttagtgtgtagcccacacctgtgtccctgtagctgccactcattagcctcctaacccaggacgcgtttccttgtgcccttggcaggggctccgtattcactctgggttctgtggtcctcactctgcaccacagactctgatgcctcccttctccctccccgatttccaagagagaacaagatctagccatgagaagcaggatggaggtgtcttcaaaaacagccactggtgatagaagttgtaggaaggtaccatggtctgtctgcctccacgcaaacctcaccaggtttcatcaagatagcacaccaggagtggtgtggctcatgactgtaatcacagcacttctggaggctgaggcaggatcacttgagcccatgagttagaaaccagcctggccaacataatgagactgccatctctacaaataatttacaaagtagtggagcatggtggtgcacgcctgtagtcccagctgcgcaggaggctgaggcaggaggatcgcctgagcccaggggttcctggctgtcgtgagctgtgatggtctcactgcactccagcctgggcaacacagcgagaacctgtctcaaaaaacacaaaacaacaggaagctcagacaggactgtggctgcttcaaccctgtccgtggccaggctgtgccccctcctctgtcgctgggcactcacccctctctcattttctccccagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggtaggagggcgagggggcggggggcccttcttggtgcccagaaggtgtttgtgagcccagtctgttcagtcctgctgtcgctcaaggccttgggctaggcccagtttgaggcctacactggtgtttctcaaactatgcccccatggaaccctagggttccctggaggttctcagaggtgactgtggtcaggattggtgcagaggaatggttgatttgtgggggtgtagaggcctacagcctccttaaactgagcagtgtctctttgttctatatgctgatgtttagtgtaaaatattggtgaataaagaaggtggtctgttccgttagtacaatgcattggagtgctgctgtgctagctagtaggggtgacaccaccaggtgggggtggcaggtccagcactgcagggctgtgggaggtggctaggagctgcctcagctacccagacctgcgatctagattcttccgggaccctgggagatggcagcagttgggaggccaattccgagtgcctggcaaggggctcatgcaggcctggtgctttgggggcagccgctgttctgaatcggctgcatgacttacggaatttggggtccagtggggcctctaggccctaaggaatgggtccagaggtgactgtgggtgggatcgacgtggcttttgggtacctttaggggtgggtgcaggatggggcctttagggctggaggaaggtgcccagggtctggctcctgtggaggtgagtgtgtgagccaggggctggtccccgccaagctgtggctggcaggagccacctgctgcaggttggaggaagttcccctgtggaaagccacgggccccacaggtaggcatttgggttctaaagtaactgaggttactaaagggctttgtcaagacttgggaaggcatttcagaaaacccagagcctttgctttccaccggcatttgctttcctgggccagacgagggcccttggggtagcccggagagtcttggggcagggatctgggagctgcgggggagtccatgggctgcccaggcaggaggcttcccagggcacgttcccctgcgtctttctggatggctttgtgttctcagccaggggcagacctggagttcctccaggaaagctcccagcctgggtgcggctcagcccttcccgacctgtcgctaattaaagttcagcccatttggttctgattttcagtgacctttgatctatagtgaaaaacaaaaatggtggctgcggtttgttggcagaatatgttgctcgcgacttctattgttttagagggaatcaagatcgattccaagaagctgaaagaaacatggaattactacctgacaccgaggtccaaactcgctgtttgcccctccctgctccctcagaaatgttcaggcagggaaataaacagcagcccacgtgtgactactcatctggggttttaagaacaaattagaatcagtagttattttttccatcataaatgtaatacttgttccacaggaaaataaataacactgagaagggagaaagcagcattagctctggtctgatggatcggccgagcgctctccttggcattttggtgaatttctttcctctgtgttttgtttttcgaccctttctattttgtatagttgcttttttgaccctagtggacaagaagcagttttgggggctgggggacagcggcgtcacggaattgaggaagctcgtggcagcttccgtgtgacctgcagattggttcatgagttcattggttcatgagttctcagcagctcgaggacttagtggacagtgccctgcaggactgagcttatttcacagccttggcactgggtggatgtctgtaggactggggggacctgcgacctgagatagttttcagacgaattcccctagacattaagagaagcgggttcccattaaggagcccaggtggcatggacagggctgggggcagcacaggtgaggagctgctccaaggcaggttgtcagcctctctggacctcaacttctaatctctgaaggcctgtgaagcttaggtggtaacagctcccttcctggggcatccaacctcttcctggggttttggggggcccaggggctctgtggagcattgctgggggagatgcctacgtataagtgggcatcatgctggggtgaaagcccaggggctgggccgggagggcgagacctgagacccatgcaaaggagccggggccagggtggggtgggcacggctcctactgagtccccagcccttgggacgctggccagccagccttggcatggccagcatccctgtgtctcctggggaggcattttacttaatggacagaaggacagacagacgggtggagggagtgagagggaaaggatgggtttgcaggctggtgcagctgtgaaactgacggagcccaccccctgccaaccccccgacagcctttgaggcccagcagcccatgctccctggcaggttgcggcttgccttctgcactggcggagtccgagctgactccgtcccttcgcccgagcgggcgtcgcggggagggaggtggttcctgcttccgcatgcgcacaactggggtcttggatcgtagctcctttgtgagaaagggactggctcacccgccatgtcctgctgtccacacacacggctctgcacaccactcacggcctcctcaccgctgtgcacagccagcacgtccatgcgcacctgtggagccagggtgtacggctgcacaggtgcgcctaggtggaggtctccaggtcactggaacttaaagtgtccaagagaggaggtgtcaggcctcaaaggggcactaggaactggcgtctcacccttgcctctgagacccgcagacccacatccagcctgggctgtcgtggctgagtgccccaggccggtcgcctcccctctctgggctgggttccctgctgaaggggggcggggctccctgctccctgtagtggcctcggcgtggggccgggcctgtggttgcaccatctccattggtgtcatcctcccccagccctgctgtgacaggcatgggaggcaggtgtgtttgtgagctcactggtgcgacccttggaggtgggaggctacacagtatttttggtcatcagaggatggaggatgagcctgcattctgggctgcagggcctggagctgtgctttctcaatggacttagaatttggggaaaaaaaaaaggaaaaaaaggagggaagagagtctgccgccctggagagtgaagctgatgaatggctggctcaggcgcccacagccccagggccaaccctccactggagcatgagagcggccgcaccacgtgggctgaggagtgactggccccgggcgggctcctgccactatcacagtcgagagatgcgagggagttgtagggcagctggcactgtcctcacccgccccggccggcagggcttgtcaggccgcgtgaagtgagaaacggtttgcggtgtcctccgcggagtgccgggcccttccccggagagcagctctgcagggaagggaagtgggttttcctggaaaacggggcgggaggtgtggagctcggagagactgaggtcctgcactgctaaggggactggccccggccctgggctgggagagggggagctgggactcagcccagggtggagtcaccatgggttctaaggcacaggatggataccctcctcggccatgtgacatcattgtttgggatgcgcccagtgttcggagccttcgaggctctccaggtgcctggagggcttgtagaaatggtggtcaggccccacgccccagactttgtctcatcatgtctaggtgggggccccagcacctgcatgctgacctggtccccaggacgcagatgctgctggcctgagcgtccccggctgtctcctgtctggtgtgggtgctgccgccgggaggccttggccccacggggagatgaggcatcacacacgcagccacaacacgggtcggaggcagagtccagcccagcaagggtgtggcagtggagacgagggaggggtgaagctggtggttccaggaggttccgtctgggtgagaccctctgctgcagagaggggcgggagccagtggccccgcggagctgaggtcatgtgagaaggggctgcagtctcttctgtgtcattctcctgtggggtcagcctcaccccagtgggaactcccactagtgaaagtctgagatggccccatcctgccgtgtcgcctagcagtgcaccacagggcattcggcccctcctgccttcacacactcaagacgttttcatgactcatctcctgccaggagggcacacacagggcacctttgcacggcgctgcctgtcctgaatgcctcgctgtccccgggtggacataggaattcatcacagtcctcctcgaagcccgggttgctctagaagatgaaactcaattgctgtccttgatctgctgctcactagaggccctgggttgggaatcggaatgtaaatgtgtcacccatcctagagaagaaagtcctgcagtgtgacatggcttcattttcaacagctgagaccctctgccacaacaactctcacagccccctcatccccacccgccgtggaaaccaaataaaagcagaaagctctggtggaagccgagctgggggcgatggggcagattgtagcccgtttctccttcccgtccccctccccactttggcccctgggacctgctcagaaccccagggtgaaggagacatctcaagtgtgacccattggctgcttctgctgcgggagagggagagacggggtggcccatgtgaaagctatgcctcctgcagccccgcaaagcctgcaaaagctcagccaggatttgatgggattgtttctgctgggaccccctctctgctgcgtctcgtgcaaacgttgctgtgaagggatgccaaggggttttgcaaagcagaaacccaagctgagaggaggagaagggattgttctgggggcaggcccaccttgattcagggggtttcgcttcattgtgctttgcagacgctgtgtttttacacattggaggtttgtggcacccgtgcatggggcaagcctcttggtgccgttttcccaacagcacgtgctcacatcgtgtgtccgtgccacactttggtaattctcacggtatttcaagctttttcatgattatatctgttcatggtgatctgtgatcagtggtctttgaggttactagtgtggttattttgggatgccacacatcgcacccatataagacagtgaacttaataaatgctctgtgttctgaccaatcctccaaccagccgctcccccatccctctctctcctctggtctccctattccctgagacacaacagtattaaaattaggccagttaataacactccaatggtctctaagtgttcatgtgaaagaagagtctcacatctctcactttaaatcaaaagctggaaatgataaagcgtagagaggaaggtgtgtcaaaagccgagacaggcctcatgcaccaggcagcctagttttgaatgtaaaggaaaagtaattgaagaaaattaaagtgttactccagtgaatacatgaatgataagggagtgaaacaatgttattgctgatatggagaaaattttagggtctgaagagaagatcaaactaaccacaagcctgatccagagcaaggctcaactctaatgctgtgaaggctgagagaggtgaggaagctgcagaagagctggaaacgagcagaggctggttcatcaggtttaaggaaagaagccgcttccagaacataaagtgcaaggtgagggagcaggttacccagaagatctggctaagattgttgatgaaggtggctacactaaacagattttcagtgtcgatggaacagctttctattggaaggagattccatctaggactttcatgctaggaagaagctaatggctggatttgaaggacaggctgactctcttgttaggggccagcacagctggaaatgttaacttgaagccagtgttcattgaacattccaaaaatcctagggcccataagaattgtgtaaaatccactctgtgctctagaaatggaacaacaaagacctggatggctgcacggcttacagcatggtttccagaatagttttaagcccagtgttgtgatctactgctcagaaaaagattccttttaaaatattactactcaccccggagcgcccatggagatgtacaggaagatgaatgttgtttgcgtgcctgctaacataacatccagcatgcagctgtggatcaaggactaattttgactttgaggtcttattatttaagaaatacatttagtaaggctgccatagatagtgatttctctgatggatctgggcaaagtccattgaaaaccttctggaaaggattcaccattctagatcccattaagaacattcgtgattcaaggttggaggtcaaaacatccacattaacaagaatttagaagaagttgattccagccctcatggacggctttaggggctcaagacttcagtggaggaaggactgcagatgtggtggaaatagcaagagaactggaattagaagcggagcctgccgatgggactgcattgctgcaagctcacgaccacactcgaaagactgaggagttgctgcttaggggtgaaacgagaaaatggtttcttgcgatggaatctactcctggcgaagatgctgcagacattgttgaagtgacagcaaagatttagaatgttccttcaatttagttgataaaacagcagcagagtttgaggggattgactccagtttccaatgaagctctaccgtgagtcaaatgctatcaaatagcatcacatgctacagagaaatcttttgtgaaaggaagagttcattgatgcagccaacattgttgtcgttttttttttgttttgttttgagatggagtctcgctctgttgcccaggctggagtgcagtggcacgatcttggctcactgcaagctccgcctcccaggttcacgccattctcctgcctcagcctcccaagtagctgggactacaggcgcccaccaccgtgcccagctaatttttttgtatttttagtagagatggggtttcaccgtattagctaggatggtctcgatctcctgacctcgagatccgcccacctcggcctcccaaaatgctgggattacaggcgtgagccaccgcgcccagcctgttagaagttgccgcctcagccttcggcactcaccacgctgatcacccacagccaagccaagatcctccattgaaggctcagattattgttcacattttttagcaacaaagtattttaaaattaagatttgcaattttttaagatataatgctatagcacgcttaatagactacaatatagtagaaacataacttttttctttttcgtgacagggtcttactctgccgtccaggccggagcgcagtggtgccatcacgactcactgcaaccttcacgtcccgggctcaagtgatcctcctgcttccgccttccgagtagcgtgtggggagggtgcacgcagctgggctaggatggcctggctggggtcagcccccgtctgtcctggaggccaggcaggtgcggagcttacggaggtggccacctagatgatggtgcctactctcgtgagttgaggcccttggatctctggcagtcagcaggactgtggtggcagccggtgtgctggttgtcagctgatgtccctgtctgtgatttttccgtgtgaatgcagccttgactgggcatgtagatcagaggtgacaagtcctgggcacctctgccactcttcttcctgccctgcacccactacagacacagctaattggtggctgcgttgagaatcttgtcaccaggcaggctcttctgtcggctcaggactgtcctgcgggcatagcaggaagtgaactgcagggggaagttggggcctggttgctgaggagggcagtgcgtggtctccaagccagtcagtgcctgcgggggggactagaattctcacccaggcctctgctctcagtcctgttcctcctctcacattcttcacacccaggctgggctcagggatccttgttgatgatggccttgaaatgtcctctgaacagtgtggctctgggggtgtgtaaaacccagggtgatgcctgctctgaaaggggcttccagatccctttgtgtctccagcacctgccgtgtgcctgccccaagctggggtctgtgagctgtgccttggggcccctgcctgtccccgctctgctctctgctgtggcttgctggctgcagggttctccagtgagtgagggatccctgctggccatgcctggagctgagggtggagggaggcccagcaggaagccccacaggtaggccccagtgagggtgcattatctacaggaaagttgcctgggacactctagtgggccgtctaggaaatgcagcctttaaggacctgaaatggagggggatatttttagtttttaaaatttatttctcattaaaattataacacagcctcgtaaaaatattaaaacagcgagacagatgtgtcaggggttatgtatatgaaggaggtagcacagttctcatcacgggtgtgcttagtgtccccctaaagttcatgccagttaatgtgatcgtgactgtaattggaaatagggtcgttgcagatataattaagatgaggtccttctggagtcgagtgggactggtgtccttagaggagaagagacacggacacacagaatgccacgtgggacagaggcctgctgtctacacctgtgcagaggagacaacaaggagagtggggcatgacccctgcccacgacactcgcctccaggaaggcagccagctgcccatctttggtgcggtcatctctgcaggcaacagaatggcagagtggcagtctgatcactctactccattgtgtgagagtctccaggatgaagaccaggctccccagcaggacgtgcggccctcatggagttctggccttgttttcggctgttgcctggctgatattctgcacatctgcccaccgtcctctgggcggtccacgaatacattgtgccttcctctttgcatatgctggtccctctgctggcaatgcccttccttcttggtgagctccaatgcatccctcaagactcagttcagatgcgcctctctggactcatccccaactcccagacggggttggctgctcccttttttcagatcctgaaacacttacttgtccccctttatgtgggcatttatctgatagtagagtttttctgtactgttggaatggtgagttccctgaagctaggtcagcttccttctcagcattcagcaggcggtgggggaggagggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaaggagccctgggatgctcaggtcatccctgccaccagaatgtccccagagtcatgaccatcagcacctcagcctcgctgctttttccttggggtctgcaggggcaggacgcaaaccccacacgctcgctgcgcagtaagctgcaggggcttctccagcagcacctctgaggcctgcctaccacgtggagatgctgctcccgtgggctctgaccaccgctctgccctcttctcacaggaaccagcgaccactcggcccggcgtaaccacgcatgtccactggtcacctggtggccttcgacaagaacgtgtgataaatccctgccggagtgcggctccgggaaaacgctgtcaccgcaaaccagctcctctttgttgcagtcccccgggggcatggcccggcaagtttccttagccaggggccagtttgcctggggtcagtgggcagcgcctgggagtcgagtgtctcgagtggggctctgcttggtttctccttgaaggtctggcagggtcagaccctgcatcggcagtaaccgcggagatgggagagccgagtctgccgctgtgggcttcctgggccttcccgccacccccgccagggcccttgggctgcatattcgaggcgcgcagcctgccaggccctccggcctccctgcgtggccaccagggaaaatggcttcactttgctgagcctctgtctccctggttacaaaacaaataattttattttttgtgacagggtgttattttttgtgacagggtgttgttctgctctgtcccccgggctggagtgcagtggtacgatcatagcccactgcagcctcgatctcctgagctcaaacgatcctcccacctcagcctcctgagtagctgggaccgcagccgtgcaccaccacgcccagctaacatttttatgtcttgtagagatggggtctcactgtgttgaccaggctggtctccaactcctggcctcaaaaattctcctgcctcagcctcccaaagtgctgggattacaggcgtgagccactatgcctggccaataatgttctattttaatttcctgtattccctaaatagtcataaccgtttccaagggcgatattcagaacacgtaatgagtgcagtgcaggcaccagcccacgtctcggccccccgtgtggggaaccagtctggccatctcatggtccctgcgtctgctctgcccacctcgtaggaggctctggattgaatgaggttcgacagtgctgactgtgagcctggccctgagtccgctcaggggtctcacttgccactctgctgctgtcactgcgccgttccctttgcccacatgccctcctggtctctgcatagatgtcctgagtgggactgctgggagtggggcactgctgcgtggcagtggagcctcgatagtgggtctcttgggggattattggcaagctgcaccccttgaaagttaaccgatcggggtgcatggcgtgaacttcccttcctgagctggtcagcccagtgtatgctgtgagccaggagccctgagggcgtctctgcccgcctatctcagagcacactctgtgttgcaggtgccgtgacacctattttacagcccaggaaacagagtctttcatgctgttccttccagccgaaccctcagctggagtcactccagaagccgcaggcaggagagttcccacaaaggactggatgcacaccttcctgagacggggggtgggttaggattccagcaaaggaagctctaaacaccagagtggccagtccatggcatttgttgggggacttacagagggggcttcagcttcctgtgggaatggggagatgagccacgttctgccccggtatgtctgcaacgacgggatcagattacggagttcatatgagggtgaaggaactcggctcagggccgggcccagtttccaggcttgatcttgcagtgtttgggggcaacaccctgaataaatgaatcagtcagtgcctgggaacattcgaggccctggcttgggttcaagcctgcaggaaaaacgtgcagctggcgggtcaggggcagttaggacagaggacgaggaggaacgggggcccctacgtgccatgggcatgtgctcgtctctctcctggtgtccgcctttctcctctgccttgtggctcagcttggactgccataacaaaatacgatagagtgggtggcagaaatgcattttctccccgttctgaaaactggacagtccaaatgcatggtgcctgtggtgttccgacaggggatcactcctcgggctccttctcgctctgttcacggggctttccttggtgcatggagaggatctccctctcctcctcttcttataaggtcaccagtcccatcagattagggccccacccatatggcctcatttaaccttaattacctccttaaaggccctatctccacatataggcccttgtcatagcggaggcttcacataggaacctgagggggactcagcctggagcacctggtgtgttaggaggaggccaggccagcgctgagcaccctgcctgtgggtgagccctgcttctcaagcaacagtaataaataaaaaggaggaggccaaactgaccagacctaaaaaaacagtatcttaaggtctgacacctgccacggcatgaatgagccagagaaagtgatgctgagtgaaggaagcctgtcacaaaaggacaaatgtggcatgtgaaatctctagaacagggagattcatggggacagggagtggactgggttaccaggggctggggtgggaacaacggggagtggcttcttcatgggtgtagggtttctgttgagggcgacgacagtaccctgcaagtggaccggtgaccgatgcacagcgttgaatgtactgaatgccactgaactgtgaactttaaaactgttaaagtggcaagttttatgttatattaaaaaaatcatatatagaaaggatgttgtattaaacgagaaaaactcatttctctcaagtaccagtcactcattgtggagactgctcttgaggtcactgtgcccaggcctcttctgtcttgagccagtccatctctggggtgtgaccctagcttacccccatgaccacaggaagaccatgagctggtcctttaaggatgcaacctgggagttgccccgaggactgtgctcacattctgttggccaaaactcggttacgtgaccacacctagctgcaagggaggctgggaaatgtagtccttagtctgggggcatgtgcctggctgacaatggggcttcagtgctgtgggagaggaggagctggtggctgccaggggatggacagctgtctctaccaacctggcctcacagtggtcacgctccaggacataaatgtcccctctgcagcaaagacttcctgggtgtggaggggactgggggcccacaccctggtcttcacaagatggtctcctaccccggaaggcaccatgcggcccacgcttcagtgtgaagacaccacctgtgtgttaatgggcccaacaccaacctgggtgcagggcaggtattcagcaaacagtgaatggacaccagggagctggctactatagcgacctcctgaggtcgcagggctaccaaacagtgcacggcatttgcaccccagctcaggcgtcccggcagggattctgcattgtctgcctttgaaaaaagggtgggagagttaggacaggaattttctctgtttccctctctctctccttctccccgcttctccccctctctttttccctttctcttttcctccctctctgtccctccctctcttttcctctctatctccctatctgctttgctctctgtctctctgtcctatttttctccatcactctttgtccttgtctctttttctcgttctctgtcactccgtttctgcttttgttcccccttctctctctctccccaacccccctgtttctctatctcttcacctgtgaattcctgaaacagacccagggcatgatgtcgtggagggcaggccccagaggcgtccaggtgacaccgtgtgggcatttgtaaagcaggaggccccagcaggtggagcaggaggactcacccccctgcagtgggtggtcaagaagagctgcctttcctaagcccctctctcctccagccacccctcacctggggcctgctgagagggacaaggtggattggggcttgctgtggggctggtgctgaggcaggggtgggtggccccccagcccctatttcctcctctccaaacccagccatcccagttaattatttgcccagcagggcagcttgactggctggtgtcttgctgagcaataagcagctgaataagggtgcaattgctggaggcggggtcgcagctgcagacctgggcggtcacttagtctgggacagctgcggcggccacagcgaaagccatgcagcctgccccatgcctggctttgtcgcgacggctgctggaacagacgggtgtggtggctcatgcttgtaatctcagccctttgggaggccaaagcaggcggatcacttgaggtcaggagttagagaccagcctggccaacatggcaagatcccctctctactgaaaatacaaaaaaattcagccgggtatggtggcaggcacctgtaatcccagctactcaggaagctgaggcatgagaatcacttgaacccaggaggcggaggttgcactgagccaagatcaagccactgcactccagcctgggtgacagagtaagactgtctcaaaaaaaaaaaagaaaaaaaaaaagaaaactacacacacatacacacaacataaaatgtatgattttggccaggcacagtggctcacgcctataatcccagcactgggaggttgaggtgggtgaatcacttgaggtcaggagttctggaccagtctgggccaacatggtgaaattccatctctactaaaaatacaaaaattagtagtgtattagtgggtgtggtgacaggtgcctgtaatcccagttactcaggaggttgaggcaggagaattgcttgaacgcaggagacgaaggttgcagtaagccgagatagcaccactgcactccagcctgggcaacaaagcaagactccatttcaaaaaaaaaaaggatgatttttaaccatttttaagtgtaccgtaagtggcattaagcatgtggtgcaaccatgaccaccatctatctccagaactcctttcaccttgcagaaatgacaccctggacccttgaaacactaactccccctcccaggttccctcccccagcctggggattaggcatctagcagctgctgtctggagagggatagcatggccctgctccgtcccttctgggcccgttgagctctgctgtgaaggggattcctttccttgtccctgtcactcctagtgtggaggtcgggggtaccaagccccagccctgccacctggaaaccctgggaaagcagcgtcacctccctgtgcctcagtttcctcatctgtaaaggggagctgaggacaggacctgcctccgagcctggggagagacggcagtgcacagggactagctgtgcgtctcagtaatacggagagaactttgcaggccaatggcgtccctctgagaaagactctccctggattctgtttcagagagttgagcttttccccagagcagatgctttgaaactgtctcaggtggacagagggggctgcagggagggcacagaggacttcctgggagtgaggtttcctgggattgagtcccagccctgctgtagggctggagtgaaaggggcctccccagagagcctctcccagggctctgtccccaagtggccaagctaattcggttccgtgctccccttttgcccacccccaccagaggccacaggctggactgggcgccactgctcatgcttctgtcctgggatagcacagaccagtacaccagggtctggcacatgtccgttgtagtcactgcagccctcccagtctccccgttttgtagaggaagccacagctcggggcaaagccgcacctcgcagtggacaggtgagtctctgcctccccaccagctgcctcttccacagatggacccccaatcacactgtcatatcgcctgtctgagcctcactgtgctagtctgtaggagggggcacctcctcttgggccatccatataaggctggagacaaacagctccacccagttatgggagtcccatgccatccaggacacatccaagtggatctctcatagcctatcatggttcctccaagactcagttttctcatctgtccagtggaatgacaatggtacaggctgtgagaatcccttatctgaaatgactgggatcagaagtgtttcggatcttggctttaagttgtagaatatttgtatgcacataatgagatatcgtgaggatgggacccaagtctaaacacgaaatttataatacataagtttctggaggctccagggagaatgtgttccttgcctttcccagcttccagaggccgcctgcgttccttggctcgaggtccctcctccaccttcagagccagcggggcagcctctcctctcctctccgacctcctgcctccctcttacaaggacccttgtggttcggggtcatctgattatccacccagataatccagggtcatctctctctttcctgatccttaactcagtcatatctgcaaagtcccttttgccacataaggggacacattcacagacgggttctggggatcaaaacagggacatctttgagggctgtgtttctgctgaccacgctctcctctgggcctgccctttgcatctgcagatagcagtggactctctttagggggagcaaagcctcccgctctgagcatgggctggactttgggggtccaggactggggaggggtcgacattgtaggtcaccaccatgtgtgactgtccagggaggctgggggatgaaacagccgagggtctgactgggggagagccgagaacacaccccactttatccggaaggccagccatgtctgctcagagacgaagagtcacgggacagccctgtccaagagcaaagacccgtccaagagcagggtcagcacctcggagagttccccgcaggccgccacggggcggggagagaattcatggggcttcgacttagaaggggaacatacaatgctgtggttttcactgcctctgggtgcaactcagcatttccccaattacgaagccagggccttggcccccagcaggaagcctggggtatttcattgcctcacactcacgtcccatctgctgaggggcacgtacgccaccactactcctgagtggcagttgattttacgctcacagattcgtcctgttatttagtatgttaattcaggcggctatgcatggttgtctcacaaatttgatttttaaggaatttaacatttcaaaatacttggtttcccttgtaacccctcaccttttattttctgtacctacggtcatccctcaagagggatccgtaggcctcccctgcctgccctgggcacagggacatcccgaagcgccggtcccagagcctgggctctgctgctgtttctctgtgacttgaggcaagatatcctacgctgccgagatagcagcccctctgcctggggaggtgagtgtgaggaacccggtgtactctgtcgatgtttaagggtcagtgggcgccgaatgaatggtttctgtcagcagcacattctgcatctcccaaaaccaaaaccaaaaggacagccggattttcccctctgcctgacttcactaggctcgcgtctgattttttttttttagcaccgtcagcataagggcctgggtttattttgtggttgtttatagtggaattgggtgtagtgtcctgatttgttttccaggatgttcgttttggggtcaagggtctttggggtggatgaggcgggagaaccaggcttgagtgaggctctgccctcctttcctggccccctggtggcccctccagagtctgtcccggccatggaccccagtccccgctgagccatgcggagagtttgggagaagtgcatacctgccttgggggcttgactggcaggctgctttcctctggctcatcttgaagttaaaatgtagctcagaccctcctcagcccccacgcagggttgcaacctcttccgtctgtctccctgtgaaatccaccttccagggggcagcctgggacctgggatggccctccctacctgaaacctttcaggccttccactgcctgcagggaaaagcaccggctcctttcacggacttccagcaccccttcggggctgctgctgcctggttggtaagccctgagctcactaatctcagccgtcacatgctgttgggcaccagcctgtctctttggaccataaaaacgccatgttgggttggcaggataagtcggcaagttttgatccagggctacagatttcctggttgtattgtttcaaggttaatttctttctttttttttttgagatggagtcgcgccctgtcacccaggctggagtgcagtggcacaatctcggctcactgcaacttccgcctcccaggttcaagcaattctcctgcctcagcctcccaagtagttgggactacaggcctgtgccacgtgtccagctaatttttgtatctttagtagagacaaggcttcaccacgttggtcaggctggtctcaaactcctgacctcaagtgctccacctgccttggcctcccaaactactgggattataggcatgtgccactgtgcctggccaaggttaatttcttgatagagttggacagtcggttttgctacaaagcttgttttgaaaatgagagttggttccagcatgattgatatatcagggaacagtttcaagataacacaagtttcccgttttcctttgtgagatttcacccaccagaagcactgggtgaacacagccactgcccccagctggcctgatgcacctgtgttcacataggaacacataggatgcatacgcacctcacacagccccagccgccccagggaccccatcctcgtcagggcacaacttccccgtctccactgccccgtctctgccactctgcaccagctctccagcccacctccctcggtaaacttacagcgttttcaagcccaagtgccgtgttaatgtgtctctgaaccccttgacatgtgaagctgtgctgccgtttttattagggtttctgtctgttttgagtgccctttccctaaccccattccccaacaagccctgtggttttgactgtgcggttttgcatgcagtgatttctaggaatgcagacgtcgagttgtggtggaatcgactcttctgtgctcatgtgagggaatggccttgttttgaggaaatatgcgctgaagtactcaggggttaaaaatcatatggccagctgggcgcggtggctcacgcctgtaatcccagcactttgggaggccgaggcgggtggatcacgaggtcagcagattgatagcatcctggctaacacggtgaaacctcgtctctactaaaaatataaaaaattagctgggcgtggtggaaggcgcctgtagtcccagctacatgggaggctgaggcaggagaatggcgtgaacccgggaggcggagcttgcagtgagccgagattgcgccactgcacctccagcctgggcgacagaatgagactctgtctgaaaaaaaaaaaaaatcatatggcccgtcaggcgcggtggctcacgcagtttgggaggctgaggtgggtggatcacttgaggtcaggagttcgagaccagcctggccaacatggtgaaaccctgtctctactaaagatacaaaaattagccgggcgtggtggcatgcgcctgtaatcccagctactgaggagactgaggcaggagaattgcttgaacctgggaggcggaggttgcagtgagccgagatcgcgccattgcactccagcctgggcaacaagagtgaaactccgtcgcaaaaaatagtaataattcgtccgtctcctcggcgagtggaggctggggccagggtggaacaggagctccacggtgagccaccccggagtgaaggccactggccctccttatccttgctgcggtgtgggggtgtgggtgtatgacccacagctcacatgtggaaacatggaggccccggggcctgtgtgacttgcccagggtcccagctagcaggtggcagagcaagacctgtatgcagaggcccaaggaagcgtcatgaggacccaggtcaccagtgcatctccagggtgaacctggcccctgcccagcgcatttgcctgtcccctgaaaccgccaccacacaaaaccatgtgcatcttcagagcaggaggcgtctccaccatctgtttgctcccgtttgacaaatggtcggtgctccttgaacggataaacaggaaccatccggccctcttccttgccggagctcatccctttgactccagggagggaggtcatgagcaccacagtctttatgggggagatcactggcctgcccctgggcggagaagccaaactagaaccttctccccagggtgagctcacaggcttttcccatccgggacccctgagccgattggctgcccgggacctgctgttatatcgggggctcccattgcaaagcccctgcgtgggctggcttccccgggtttggtttctccccattgtgcagggtcttggggtagggtctgagccaggtcaccctggagaaccgacagcaccggcccagccccgctgtgacctgctgaccccggaccccgcactttgcttagtgctttaggtctgtaggagtaatctttggagaatcgtgattctgggacccgagctctgagggaacaacctcctctgagcctcccaaggccccccaacattgtggggtgagccccacctcacagatgctgagacaggcctagaggcgtggcgctcccagccccatgccccacatagctctaaggcctggcctcacttgcaggtgagggtcctaggaagctgggggtgggagcaggcctaggagaggcactcaacaaccacggctcagcatggtctagaactgccccctcttcctcccggctgccccgagtctggcttccgtcagacccagcctccttccccagcccatccctctccctctttgatgaggccgatggggcaaagacctttgcttcccagaatgttctgtccctggttggaacactggtccctgggacacagccctgtcctcagctttgaagtcagttcccatcgctgccccccaggtagctggctggcttctgccaacctcagcctggtcgcagctggcacctcctcaccaggtactaaaccagggtgtgcagaggcccgctcgatccatggggcagatcagcaaatggtagtgcaggatgccccatcatatgtgaatatcaggtaaataacaggtacttctttttttctcttttttttttttttgagacagagtttcgctcattgcccaggctggagtgcagcggcatggtcttggttcactgtagcctctgcctccctgatttaagcagttctcctgcctcaggctcccaagtatctgggattacaggcacctgccaccatgcccagctaatttttatatttttagtagagacagggtttcatcatgttggtcaggctggtctagaactcctgacctcaggtgatccgctcccctcgacctctcaaagtgcttatattacaggcatgagccaccgcgcctggcctatttttttttttttcccttggcaacagggtcttgctcttttgcccaggctggagtacagtggcgcagtcatggctcacttcagcctcaaattcctgggctcaagtgagcctctcaccttagcctcctaagcagctgcaactacaggtgtgcaccaccatgccttactaattttctttaaaatttttttgtagagataggggtctccctatgttggtcaggctggtctcaaactcctgggctcaagccagagaggggctggcctggtgctctgggttctccagaccccctcctgccttggtctcccacagtgctgggattacaggatgagccacggtgcatggccacctgatggataatgtctaatataagagaacccctaatttagctgtccctgtacccttgtgaggtgagcagtattgttgcctacattctatagatggggaaacagaggccacagaggcctagcagcctgcctcgtcaccgagtgggagcttggcagggctgggatctgaacccaggccgtcggctcctgggcctgtgtgccccctccatgaccatatcagcttcctacagcttccatgacaaagcaccacaaaaccggaggcttaaacacagaaacgcagtcccccagctccgggcagaagctcgagacgagggtgtggcagggccgtgccccctctgcagcctctggggagggtcccttccggcttctgggggctgccggcctccctggagtggccacgtcacttgttgctgctgtctccctcgtcacgtggcctctccttctctgtctcttagctccctctgccccgtcctgagcacagctgtgattgcattagggcccacctgtataaccgaggatgccctcttctcaagagccgtaccttgatctcatctgcagagatgcttttcccgacgtgaatggaatattctgaggattaggacgtggacctaccttgttaggggccaccattcagctgactgtctttgccaagcacaggcagtggagactgtgtcatgctctgatccgaacaatcgtccttctgtctgccgcccgacttccccagccctgttcagaaagacagaaggaactcctgccccaccctaagctgaagtcgggagcgtgaggaccctttatctggtctttgggggccaggtgggttcacgggcacaggacagcatgacaggcagggcctggcattgggacacctgggtcttagtcctcacctgtgacagcggggggtcttgggcaacgtcccacccctctctgggccttgaagatgaaggggttagatcctggcctcccggagcttcccctggtgtaggatcaacacactttttctgtcaaggactagagagtattttaggctttgctggccctgtagtctaagtcacatactcttctctgtctgtttttgtttgttttgttttgttttgttttgtttttgtttttcctacaacccctttaaaatgcaaaacccgttcctagctccaggccatggctgccattgggctgtgttgagcctgtggcgcgtgcacaggcccctgcccttggtggacactctgattccacctgcaaatcctgagcgcacaccggctctgaacaggctctgtggcttcagaaacttatcttctggcttcgtcgatctggctggtttgccctggggatcccgcatcctctgactaccgtgatgagcagagcgcagcgcccggctccgtgggccaacttttggtgtcttgccctgcctgagcctgttcctccttcctctccctgcccctccagccgctccgggtcctctgggaagctctggcctcttcaccagccctgcgcggctgctggatctggaggccggagccggcacatgcgtctgacagcagcgctgctgtctcttgtttttcgtggtccatgtttgggggttacatctgggcctgtcccttctctgtgtagcctgaaggcagttcccaggcttgtgtccctcacctctccgcagacgccctttccagatcctgttcaaatcctggccctactcacgggaacttgggtgagtcagttcccttcactgagccttcatgcctccctgttaaggagaagcttcactcggcatggcgtggcccgtcacactcatcctgcatctgttacaccaaatgcagtttcctcttctataaatgggagaaaatcacctgtccttgccaagggtccggtgggaattaaatgagctgagccagggcacgggtggagcttgctgagtgttaggtcgtgtgcctgctcttcttggcggagtctggccagatacctcatctggttccattgctgtcagtctctaaatggggcctttcctgcccagctcccagccctggtgctcacaccatcacaggccaaagaactggattccagacactgcctcctccactgtccccacagtgaaaatggggagggatgtccctgtggagccctaactgggacccagacagccctacccccagctcccaccccctccggctgtcccggaggccgtgctccgtggatctcctctccctcgcctccacgtgggctccaggtagctgcacacgcattacaaacatctcgttaatcttctcggaggtcctgcgaggcgaggcctgtggtagccctgcccttggagcactgagaattagtaaggaaatcgccgctgcatctcccggtggcacaggggcgtggaggcgtggcgggccttccctcttgcaccactttggatcctgggtcctcacagcagtgttctctgcaggggaggtgcaggcattggtctgctctagggccaggtggtctaaaaagtccctggtcagccccgagtcctgcaggaatctgcatgttagtgggatttggggttcaggatgcttgcctgctgggtaggatggggttgctgagtgaggctgaaatcccagatgggatgtctgggctcctccatgcctgacttgggaggggtgagaaaaggaaggagacttggccatctttaggctaaaagcctagtgctgtctcacaggagggaagagcaggtctctgcaacacacgcctggggttccgtcccctctggccacttgtctgtcaccttggacacgttgcctggcagcctctgagcctcagtgtgcttctgtgaattggggtgaccctagcacggtgctcacgacagaaagcatgggagtgcagacgtgggtcagtggcccgcggtgagagctccctgtctgccccatggtgagtttccacagcagtgagagaggcctggcgtgtggggtggaggccgggacagtgtgagggccgcctggtcagagcgggaggcaggaccccgtagggagatgaaagccaagctggacccaggcagaaaaagaggaacgaaggacaggaagtccaagagcagtcactgctgacgtgagtgcggcctgcaggcagccagtgtggatggactctcaggccctccgttgtgtgttaggggaccggaggagcagagaggttgcagcagccggccggcctctctcggtgagggccggactgcacatggggctcagaggccgtgggtgtgcctgcccgcctgtgtcagctccagccgtgggggcgggggtaatccgaggctgcgtcccgaggctgtgggagctctgccttcatccttccattcacaggtagggacacaggcgtggggattccacggtgcccttgaggcagctgtttcctagacccccaaggccctgacggagactcccccacccctcaggagcagagggtgaggcggggtctgcaccggccgatgtgggcaactgttgcaccctcggagcccagcagcgagggtgggggtctgtggggagtcagccgcagccaccagcattgctggaatgtgtcagaatggtggtgcctcctgcaaacaaccttagcctctgttcatcctgtcaccagggtcctgggagaagcaaacccacgtgtggcctctgcagggtgggtggggaggttctcccggccaggcctgactgacgcccctgctgctccctgtggtccagcctggacttgccaccgattattctatcaatggcactgcactgggcaccaggatccaagcagtggactgcgggacaggacctgtccctgtgagcggcctgtccctctccccaggcccagcctcctgttggttatccttccaagcccatgcctgggctgtgcgatccacctttcctccaggcactcttcaggcaaatctctggagcacccactgggtgccacacactgcggatgggacgcagggtaccgcacagccccggtcctcagggacccggcggggacagcactggtgaaaaaccacggaagtacattgatgtgtcacttcaacaggggcctacgcaggggcctgccctgtgccaggccctgtcgttggtttgtggggtgaagaccctgttcctatggtgtggacgtggtagagatccaggggctctggcagcttgtatgggggaatggggacgggaggggggtcaggaatgggcttctcgagagaagtgacatttggtcagaggcccaagagcgggaattgatcctggccctccctgaatcagtgtggtgtgacccctcccgccaaggtgagggtagcaaggtgcctggggctggaatcctggggctgtggcccgtacagtcgcccgggacccatgcccagcagggccctgcacccggagtttaacactgaggtccccaccttgaaattcctaatcattgagtctttgtaacttgtgttagggagtccagcgagacaatggggtatgtgcggggtctttggagcttcagcccatgcacagacacgtctctctgttcctcgactcctagcatgctctcacctgcctgccccagagaccaagccccacctggccccttcgtcaccccgaggtggcgactgggttgtgctgaaggagggaggcccacacgccaccactgccctctgacccgtcaggggccccgagggcctggttggtcagggctgggcactccacccaccccggatgacagcaccaggctcatgtgccaggtgactcagccagggccactcaccagcgccacctggtatgtcctgggtggcggccgctgtgcctgctcctatccaccatggttgggcactggctgggaagagaggtgaccaccaggccctaatagcaggagtcacccacacaacccttgtacccagccctggggtccaggccgcctgcaccggctcagttctgcgcctgagctcccagctctggggtccaggccacctgcaccggctcagccctgcacccgggctcccagtgctggggtcccccaccccttggtgttgccgcatcctccctgggcccaagattcctggagctggagaacccccttcctccctgaggcatggagactgggctggtcctgagcccactccaggcacaggggacacacctgcttccttcttaactgagtagagcagagttattttgaagatcggttttcagcaggacagtaaaaaggcgaactgggagattgttcatgcagcagcttctaaaaccagtttttagataaatgcaccttcgtctgtggggggtggccgcacccagcctcgcttcaggtgcctgacggggtacgtgctgcgttcagtcccaggcaggtgtagggctgggcaggtggagatgcggtgccctcgctcaaccggggtctaggctcctcgccgggcggggttcacctgctatccccagtgtgtgggggcgggggtgtggggtgagggagaagagtggggcactgagtctaaacataggctgtggcctgtaggtgaggggaggcggcagcaaggagggggagatcaactcctgaagagactccgtttctaacacgccgggagccctgcgctttgtcatggaaactggcaagagtccctctccatccctccctactcccagaaacaagatggtcccaggctaacgggcttctctctggcctggccctgctcccagacccccgctgagggtggtaaacaccccagccgcgcccttggcaggggttccgtcccaggggcctccctgttctcactgtgagggtgggcatgatgggcagctttgcggagcctcctcagcacagagccgcacatgacgggggtggacagactgtggccccacagccgtccatcactttcatcctgtattgggggagaacggggcttgcttgaggtctgtcctggatattcgtaatgctggcattgacggggccagtgaaggctctgattggtgcgggtgacgaggacacagtcgcagcaggcgtagaccaccagagcagggtgtccacgtggctggccacgtttagttgataaaagtggcatctataaatgggtggtggtgcggaatgggtggttgattaaatggtattgggccgctcaggtggccattggggaaaggtaaagctggatccctacctcataccaaaattattctaggtggataaaaagtttaaatgtaggccaggcagtggcttgtgcctataatctcagcactttgggaggccgacatgggcacatcacctaaggtcaggagttcaagaccagcttggccaacatggtgaaatgccatctctactaaaaatacaaaaaattacctttgcgtggtagcacgtgcacgtaatcccggctacttgggaggttgaggcaggagaatcgcttaaacccaggaggcggaggttgcagtgggccgagatcgcaccgttgcactccagactgggcgacacagtgcgactctgtcattaaaaaaaaaaaaagtttaaatgtaaaacataataaaagctggtttccttactgcataaaacacttctacaaatcgacaagaaaaaaaaatcaaccgcactcttaataacagaaatgtaaattaaaactacaaggagataatgctgggtttcacttgtcttgggagagatttaaaaaaaaaaactgatctactgaattacagaagatgcgaggaaacagaccccctcgtgctttgctcgtgggggtgtaaatgtcctccctggagagaaaattgtgaatctctagcaaagttcagaccccaggaacatttaaactgcagctttaattcaacagcggcacttctggaagtatcttctgaagatggatttgtgtgtgaaatatcaaatatacaaggttgttattagactgtgaattctaataggagaacatggaagacagccttcatgtccatcagcatgggcggacttcatgtgttctggaacggtcattaaaacaagaggctgggcacggtggctcacacctgtaatcccagtactttgggaggctgaggcgagaggatcacctgaggtcaggagttcgagaccagcctgaccaacatggcgaaaccctgtctctactaaaaatataaaaatgagctgggtgtgatggcgggcacctgtaatcccagctacttgggaggctgaggcagaagaatcgcttgaacctgggaggcagaggttgcagtgagctgagattgtgccactgtactccagtctgggtgacacagcgagactctgtctcaaaaaaataaaatataaataaataatttaaaaattatttaataaataaatagaataagaaagctgtgtttgctgatatggaacaatctccaagatacagtgttaagttaaaaaaaaaaacaaaaacaggccaggcgcagtggctcacgcctgtaatcccaacactttcggaggccgaggcaggtggatcacgaggtcaggagatcgagaccatcctggctaacacggtgaaaccccgtctctactaaaaatacaaaaaattagccaggcgtggtggcgggcgcctgtagtcccagctactcgggagtgtgaggcaggagaatggcgtgaacccgggaggtggagcttgcagtgagccgagatcgcgccactgactccagcctggacgacagagcgagactccgtctcaaaaaaaaacaaaaacaaaaaaaagcaggggcagaactgtgtgtggtgggccaacacttgtgtccaggtttctagcatgtgagagtgtttgaaaactggagcctgtcctgtgacggagtcttgtgcagacatgaaaaacaagagatatcctagtgagctcccaaacagggacacccatgacagagtaaaagcagaaacaagtcacaggaaaaaatatgtagagcataaccccatttgtgcggcaaaaataaggtgtgtatgtcgatcactgcatgggagaggaagcgaaagagaaccactcagaatgaagagtcattttctgtgggaagctggacacatgtggaagggtttgaaggaggagttttactttcattctgtacattgtaaaattttttctaaagaacttgtgttttacttttgtatatttttatttatttatttattttgagatggagtcttgctctgtcgcccaggctggaatgcagtggcgcgatcttgtctcgctgcaacctctgcctcttgggttcaagccattctcctgcctcagcctcctgagtagctgggactacaggcgcctgccaccatgcccggctaatttttgtatttttagtagagatgggggtttcaccatgttggccaggctggtcttgaactcctgacctcaggtgatccaccagcctcggcctcccaaagtgctgggattacacgtgtgagccacagcgcctggccaacttttgtatattttaaaaataaaatatccagccacaatccctgagaatagctaggcagtggaaggatgatttctaccaccccatgccccaccccccagctggcagaagctttcaccccccgcccctcccccgccgtttccccgactcgctgacccctcctctgcccctgggccttttgcatcctggagctctcttccccttgccaactcctcctgcctcccaggcctcagccacgcctgcttcctttgggctgatgctgagcaccaacccagagtgtcggtgctgctcattgctccagtgaccccgtccagaccagcctccccgtccagccttcctcttgctcctgggcaggacctgccctgtgctttgaggccctggggcctgcacatatccagcatgtgggtgtgccctgtctgtgtgtaccaggtaagcgggcagatgagcccagcagacactgctgcagccggaggctgccggcagcccgcagtggcacagccgtgctgtgggagggcctttctgtgtctggggctgtgttttccacactccccctctggcttttactgttttgctccgggagtgtggctttctagagttttgtctgattttatagcagagtttctgttaactcaaaaagggactccacagtgaaggtttaaaggtggtcccagctgcagcaggaagcaggtgtggggtgcctgctgcccaggccctgttccccagcactgcttctgacccaggaggggctggggagaggaccactattcctcacctttcatacacccactcccatcctatttcgcaccccttcctccaggctgcctgcacctctgccctgctggcctttcgctctgtaattcctttctgaaagaaatgttttccatgaaacaacaacagcaagaagaaagcagatcagctgttggcaggagctgggaggagggatggggagggcagctgatggatatggggtttctgtcgcaggcgacgaaagtgctgtaaagttagatcacgatggtggtgacccgcctcagtaaatgtgctaaaaaccagtgaattatactctcaacaggagtgtaattgctgtcttcttagaacgtgtggccatggaaatgtgctctttttatgtgtttacctttgtatcagccgtcttctcaatgagaccagaatccctatcagagcaaggaccttgtttgtgtctcccttttcctctatgtcctaatatacaacagtgtgtttagcttgtagcagacactcaatttaacaacatctttttgaacgagtggatccataaatgcattaagtggctctgtgacttcagactcttcttcaggtttacggtatataaatatatcatttacggtaccttcatttatggtatataggtgatattttagccggggtgcagtggttcacacctgtaatctcagcaccttgggaggcagacgcaggtggatcacgaggtcaagagatcgagatcatcttggccaacgtggtgaaaccccgtctctcctaaaaatacaaaaattagtcaggcatggtggtgcgcgcctgtaatcccagctacatgggtgcctgaggcagcagaatcccttgaacctgggaggcggagctcgcagtgagctgagatcacaccactgtactccagcttgggtgacagagcaagactccatctcaaaaaaaaaattgttatctcagccaggcacagtggctcacacctgtaatctcagcactttgggaggctgaggcaagtggatcacatgaggtcaggagttcaagtccagcctgaccaacatggcgaaaccccgtctctactaaaaatacaaaaattaggccaggcgcggtggcgcacgcctgtaatcccagcacttggggaggctgaagtgggcggatcacgaggtcaggagatcgaaaccatggtgaaaccccgtctctactaagaatacaaaaaattagccgggcgtggtggcgggcgcctgtagtcccagctactcgggaggctgaggcaggagaatggcgtgaacccgggaggtggagcttacagtgagctgagatcgtgccactgcaatccagcctaggcgacagagtgggactccattatacacacacacacgcactatatatatatacacacacacacacacacacacacacacacacacacacacaaaaaaaaaaattagccgggtgtggtgggcgcctgtaatcccagccacgtgggaggctgaggcagaagaattgcctgaacctgggaggcagagtttgcagtgagccgtgatcatgccactgtactgcagcctgggtgacagagcaaaattctgtctcaaaaaacaaacaaaataaatgatatctcaataaagctgctaaaaaaaactcgcccaccaggtacccatcaggtatcttatccagcataagaacagctgggctgtgtgctgtctgcacctcatcccatgaatctttgcaggggttctacaagggtcctccttactaaaccccctgcacaggtgaggaaactgaggcccagagattatgcagcctgcccaggtaaagcagctggtgaacgtggacagcgtggcccccgtcataccttctcgccagctgacggtgctgtccagggagtctggaaagcagagatccaaaggaattggctgggctggaaggctccttacagaagagctcgcttgcccattcactcattcatttgttcagctgaacacccacctacgagtgtgtaccaggcagacccgctcctgtctccacgaaccacaatcacagaattgtgtaaacgaggtaaagccggaggcctgagattgtggggatggggattgaggtcaggactgtcttaccaaggagtgacatttggcctgggattgaaaagtcacgaaggaactgaacattaagaccctgtatgtaaggctgggtgtggtggctcccactgtaatcccagcactttgggaggccaaggtggaggaatgcttgaggccatgagttcggaatcagcctgggcaacatagtgagaccccatctctacaaaaataaacaaaattagccaggcgtagtgtcttcctgcccacttgggtggctgaagtggaaggactgcttgagcccaggagttcaagactgtggtgagcagtgattgtgccactgcactccagcctgggtgacaaagggagaccctgtctctaaaaaataagattataaaccagccaggcgtggtggctcacatctgtaatcccagcactttgggaggctgaggcggttggatcacctgagggttttgagaccagcctggccaacatgacaaaaccctgtctctactaaaagtagaaaaattagccgggcttggtggcacatacctgtagtcccagctacttgggaggctgaggaaggagaatttcttgaacctgtgagaaagaggttgcagtgagccgagatcatgccactgcactccagtgtggacagcagagccagactccatcacacacacacacacaatatatatatatgtgtgtgtctgtgtatacacactcacatactcacactctctgtagtgggctgaatggtgtccccaaaagctaggtctgcctggcaactcacttccaacttcttggaataagggtctctgcaaatggaattagttaaggatctgcagatgagattctcctggatcaggctgggccccaatccaacgaagagtgccctcgtgaggcagaagaggagagagacacgtgccggagaaggccacatgagggcagaggccgagaggcgggagtaaggccaccacgagcctgggaacgccgagggcgccagcagccgccagcagctggagagaggatggatgggaggattttctaaagccttccgataggggtgtgacttcttgattttggactccgggactgcaggaccgtgagaaaaggagtgagtgttaagtccacctagttagtggtcattcattaccgtagcccgggacacttacgtgaacttcagacctcaaatcctccccatcttgcagccccaggcgcagacctgggcagtggggcccccgtgtgcccatcccccagctggccaggctcagctgagagctcctcgacctcctgcctgtccctgccacccttaggagtccgagaaactggacctgcccgtggcctggacaccacttcctttattgcttagggtttctctctttctttctttaaaaattttttaaatgaaaaatggggctgagggaagactcggtctaaagataagagaggggtcacctggatctggaatgttctctggctttccaggctgctctgatcgcagacctcctgtctttaacaacccagcctgggtcaggtctgatgaaatgcactttccagggaatggggctggtttgggctctgcagaagcttccctcttccatcctggcaccggcagaaaagcccattaaaataattgcagggagagactgttacctaagtttcctccccttgagctgttggagctcttctttgacctttatggtttttaaaaccctgccaatccttgccttgtcccccggacgcattcatccagtgggttgggaagctggtgttcgctgtccgggctgggtcgtgccggctctccgtgtgtgcacgtgtgggtctgggctgggtgttgacctgctcctgggccagggcccaccagagccttagtccgggtggccaccatctgggaggcccggccgtgtcctctcttaccccagttctccaggcactggccaggggccccctcagcacacatgtcatagttggtccctccctgcccatggcccttcagaggcccccagctggtcttgggaggagggtgcctgtgtgggccagctttcagcacagcccccgccctctgctccagccttgggtgcaccccaaccccacccagctgaccagcctgttggggggcctgtggaccccgcctctaagcctgggtcttcctctgggcacccgttggggacagggcagccacacacccagcccagggtgtggtctccccacccagctgcctcccttgcaaaggcagggttgccttggcaatgacacctgaggaggagacgcttgccctgggtgcgctgtttccctgtcttcagtaagggaggaggctggcttcctctggcggagggaggcagcagctctcctttgccttggaacccgctttgctccagtgatccctgagccaccacattggtaagactggctggagctgaaggtccgagtgtggcttcaggactggtgacgatggccagggatgaagggctgcggcgtgtggaggggctgcgcccggaaggaagcggtgtggacccagaaggaagcggagccctggtgggcagcctggctgtgctctggcccaggaaccgggccttttcttgcctcttgcctctgactcagagcggcttgtgggagcctcgcatgcagggccaggcagggcaagaacgatcgcgaccttttcctccagggaaggttgcaagaaaggcgggatctgtaacgtgactaggtggaggcactacggagccatggtgcaggggtggggggccccaggtgagctcagatgccctccctgcctgtgccaccgtggcctgaccctccacaggtgggagccataggcgtcaggagccattaccccttggagaactgggtgccaggccgagacctggtgtctcatttatgacaaaccgctgcagtgcgtttgggagtctcctcctccatgacgtgcttgtctggattggttttattttagtgcaggcaccacgtcgtctttttatatacgtgtgaacgtatatatgtaaacacacgtatgatgttggtgagttcatgttggtggtatttttactaagcaaagatgtgggaaccaaatgggcccatccggggagtttcccatttggtccctcgtgctgtgtgtggtggggggcattgtggtcgaggtctgaacagccggggaagtgaaagaccccgtcctctccgggagcttacgggagtgggagagacattgacgaaatattacccatcgcaggagtcaggtgcacacagtgatgatagttccgggaggtcaggtgcgcgcggtgatgacagttccggaaggtcaggtgcacgcggtgatgacagttccgggaggtcaggtgcacgcggtgatgacagttccgggaggtcaggtgcgcgcggtgatgacagttccagaaggtcacgtgcgcgcggtcgtgacagttccagaaggtcaggtgcgcacggtgatgacagttccgggaggtcaggtgcgcgcggtcgtgacagttccgggaggtcaggtgcgcgcggtggtgacagttccgggaggtcaggtgcgcgcggtcgtgacagtgccgggaggtcaggtgcgcgcggtggtgacagtgccgggaggtcaggtgcgcgcggtggtgacagtgccgggaggtcaggtgcgcgcggtggtgacagtgccgggaggtcaggtgcgcgcggtcgtgacagtgccgggaggtcaggtgcgcctggtgatgacagttccgggaggtcaggtgcgcgcggtgatgacagtgccgggaggtcaggtgcgcgcggtcgtgacagtgccgggaggtcaggtgcgcgcggtggtgacagttccgggaggtcaggtgcatgcggtgattgttccggaaggtcaagtgcatgtggtcatagttccagaaggtgtccccggggcaggatatgttttcctattttccttggcttccggggagcttggagcctgctttcctttgggtcctgggctgattttcgggcaggtgctgggatgcagtgtcctgggtgctgcagcatggctgagcctcggattctctgtccagggctagctgtgttcaggccgcgcatctttagttttggggcatcgcaaatcctcctggaatctgatgaaagctgtggaccctctgcttgtggcggggggtcatgcagaaaactttgagtacagtttcaggagatgcacggaccacccaagggcctggaatcggagcccccacaagacagggggtgtgctctctgggccagcgtttggagcactctctggctcttggagccctggtggggcattcccagcagcttgcttcatttcctggacacgtgttcttggctgtggtttatattactctctgtatgtaaatgtcataggttttttttcttctagtaaaattgttcctagttagcacagtggaatcttgaaacaagaaagccatctttcatgaacagtgtgtggtttccaggcttagcccatggagttggagtgacaggtatggcagagatggggggtcaggctgcgtagaaggtgtttgcgccccctaggtgcaggtgttaatcctcaccaccagggcgatggtgctaggatgtggggcctttgggaggtgatggggctgaggactgagcctcatagtggggattagtgccctgatgaaagaggcctcagagagcaccctcgcttcttctaccatgtgagcacccagcaggaaggtgctgtccaggacccagaaagtgggtcctctgcagacaccaaatctgctggcaccttgatcttggacttccagcctccggaactgggggaaagcaatgtctgctattgatgagccgcccaagctgcggtgctttgttgcagccccaacaggctaagtcaggaaccgtgaacaggagacctcccagggagtctgctcggaggggggatttgtcgtgggggaattggtcattgtgcctcagtttccccattgttggggaagtggtgcccatggccactggcaggcccccccgggggccagcacaccaggtaggaagaaatgcaagccccaggctgctgagatgcacagagccccacattctgccttcgggacgtctgtctagtcccttgtcttacaaagggtgggcaggtcccctgcaggactcagcagagggagagacacagtcagggagcggccagaggggtgacgtgcccggctgcccacaggtacaatggctccttcgtgtcacacatgggtgtcggcgtcatctttcggctgggtgagggaactgcccagctgcccaagccctgggttcccaagtcagagttgctgggattactgggcagggaggtggtcccgcaacccacaccggggcagtggcaggaagcacagacacacacagcacagcgggccggcaccgccggggtgggttgtctgggcttggactctttctgtgcacatgctgatgtttgttgataataagaacagaaacattttctttttttttttttgagatggagtcttgctctgtcacccaggctggagtgcaatggcgtgatctccgctcactgcaacttccgcctcccaggttcaagcaattctccttcctcagcctcctgagtagctgggattacaggcacgtgccacaacacccggctaatttttgtaatttttagtagagacggagtttcaccatgttgtgcaggctggtcttgaactcctgacctcatgatctgcccgcctcagcctcccaaagtgctgggattacaggcgtgagccactgtgcccagcccctccccttttttttttccttgagacagagtcttgctctattacccaagctggagtgcagtgacgcgatctcagctcactgcaacctccacctcccagattcaagcaatcctcctgcctcagtgtcccgagtagctgggaccacagatgcgtgccatcacacccagctaattttgtatttttggcagagacaggcttttgccatgttgcccaggctggtcgtgaacgcctgagctcaagcgatcttcctgccttggcctcccaaagtgctgggattacaggcgtgagccaccatgccctgcccagaggtgttttcaagcatgtcctgtgcactgggcctggttggttgatgctcagtgatgtttattgaatgaatgaatgaatgaacgaacaagatccagaagtctgagggtaaacatggggtgccagcatcttgtcttagcccagcccgttgttggggggttggcagagtacctcaacccagacccctgtcacctgtgccccctgccccccctcacgctcctccctgtctcccccaggacctcccactctcgggcaaaggccgaggcagccctcacagcagctcagaaagcccaggaggaggcgcggatcgccaggatcactgccaaagagttctccccttccttccagcaccgggaaaacggtgagtctcgccgggcctgatactggcatcgtggggagggggtgcgtggatggctgggcagtcctggcagcagatgtgtcctccagagcgggtaggcttagatgggctcagccccagctgctcccctgcccggtgtcttcctctcccgccgaaggtgcttgtttgtgccaaggcctggcctggctccccgggacacaggacatgtgtcttggcaggtctctcccattcccacagtccttggggcaccgcgtgttgcttgccggctgtccctgacggtgaattcccacctgcccagcctgtgctgtctgctgcccgccctcccccagtgttgttctagaaccttctgggatgatggaactatctgctgggtccagcgtggcagccattagctgggtgtgtctgcggtcctggctcttgacctgcctctgatgtgaactaacttaccattaaacacacccagtggctgctgggttggacagcgtcacaaatggcagctcccgctgtgcccctcggaaagagctggaagctgctgcctgatttaggaacctcgtcctcccttcgagggggggatcatgggtgatacggcccagtgacagtggcgggggcgtggagggtgtggggtgggtggcggagaggccgtggccagctgcctcccatctcctacctcatcttggaggaagcttcctctgcaccaggaggccccagagaatggggttaggagcgcgccccctcaacccgagctctgaccggtgagcggtattcggatgaggctctgcgcgctggaggtccgcacctgacaccacagccctgaacttgctcgcaacgcctgccactctggccaccaggacaggatgaggagcccagcctgggggctgcggggctgggcgctcccctgactggaacgcgagaccacatcatctctagaggtgaccgtccgccaccactccaagaccttgccttcactgggcgagtgccgggccctgcagagcctgcagctgcagcctggaggtcaggaggacgagcccccgcacccccaccgccttgggcagcttctattccactgcgtcccctccactctcctggcccctccagacacacgcaccccaaagtgtccaagtgggagggcaatgggccacgtgcccctgtggccattggcatcctccatggtctcgccctcaggccctgagtttccttctccctggggcccctccttgcctcgcccacgaccagctgcctgggctgggaggcggtggggcgcacacttgggggcacacgtgtagcgtgcacgtgcatgtggggagtgggtgcagtgctgcgggatggacgaacggaacagggatgctggagaggaagccagtgccgtcgggggcacctgccagaaccctggctgggccactccacgcagaatgcacgtaggacggcatgggattccacgtaccaaccctggcccatggtcgcctcagctccagccctgcctgcgactcacattccactgcctgcggcctgttttgtttcctctcagagcctcagttccatgtgtgaaaggaaggggaccagacagggaacattgaagcctccatcctgtgccaaatcccccaagagacgcatccaccggaagctcccaacgtgacttatttgggaggagggtctgtgcaggtgtcattatggaacagactttgagacaagatcagcctggattggggtgagtcctagatccacgcggcgtccttagaagagacagaagaggaggagacaggggcggatggagtgatgtcagagatcactggagactccgtggctggagggtggctggagcggagaccctggaaggaagcagcactcccgacacctggatcacggcttctaacttccagaaacacgagtttgccttttgggtgtttctacccccacccccgcgtggtgctttactgctccagtcccaagaaatgggtgcaggctcccccaccctgagaattccagttaagactctggagtcggagatgcttcctggagggctcagtcctggagtcagaggagatgcttcctggagggctcagtcctggagtcagagatacttcctggagggctcagttctggattcagaggagatgcttcccagagggctcagtcctggagtcagagatgcttcctggagggctcagttctggattcagaggagatgcttcccagagggctcagtcctggagtcagagatgcttcctggagggctcaatcctggagtcagagatgtttcccggagggctcagtcctggagtcagagatgcttcctcgagggctcagtcctggagtcagagatgcttcctggagggctcagtcctggacttggagatacttcctggagggctcagtcctggattcagaggagatgcttcccagagggctcagtcctggagtcagagatgcttcctggagggctcagtcctggattcagaggagatgcttcctggagggctcaggtccctgcaggaggggccttgggctgaccttttaagtcctgaagctgcctcctccgacagttcttgtcttcatgatacagatgcgggcccctgtgggggccgctgtgatggagagacggggccgctgctgcctcactggtgggagtccagtcctcgagggtctggccaagttggcctcacctcctgctgctgcaccttggagcctggctcactctgagcacctcggtccgatctgccacctctttgggtggcgccccggagccttctctgagcagcatcttccctggagggggcgttgggaccgtgtgttttttacaagcgctgggactggcatgagatttgatccaagcatttcttgtttccgccttggatgcattcaggatcagtgttcccagaccaggcaccccggggccttctcggctgctggggaggggtggggctgggggaagctgtccaggtccttcctcagtcgtcctcacagccaggagctgaggtcaccaatgacagatgacagaacagagcctccaagaggggaacagggttgccagagcgctcaggcaggatgtggtggaatcaggatttaaaacgaggctctgaagcctgggccatgccggcttctagagaagcaaaccatccagcgcttcggctgcagagagtggctggcgccagcctcttgctgcctgtctgggaggtccctggcagcctcccagcccgagaactctgaccgtcagggttctgcccaaggccacgtgaaggcaggaccatgaaggagcctggccatgcggtgtccagtgcccaggccacttccggtgccatccgcccccgccccagaggcaggaggactgagcgtcggaggctgcaggacgcaggtggcttgaaggcacaggaagaagctgcaggggcttcacgaggacccgccctgcatcctcaccacgaggcttctaggaacgttacctgctcagcagctcattctagctgagggtgccctcctgctggtggtgctgggagtcggggcccctctagcgtggggtctcctgggccagccaggcctgatctcggcagcagtgggtggacgacctggtgggaaaggccggggcgccatcgggggatggggggggccttgatcccagcctgctaggtccatagcgtctaaggcacaggaatgccagccccttggaagtcccatcctggccaaggaggaggtacgatgtgggtgatccgtgggcatgattgggggcctctgatggggccagggctgccctccacacaggaccctcacggggagagaggtggtggggctgggcgtcaggtgggtacgtggatgtcagcacagttctacacagaccttctctggcccattccctgctctgctcgggggacacccaaccagcccagccctgtttctggggagtgaccacagagaagcagtcattgagacctcagagtggcccacccacacccccgtgtgacaggaactcagacttgggagggctggccacccacccagagctacccagctgtgccccaagccccaggccagggccatggcctcgctctgctcagcactgcctcttagaccagcaaggaggaggacacagcagcccagcctggtggcgtcgcagcgtgccccgaatctgcttgctaacgtctctttacaaacggagggactatctggtgccacaccgagggtagccatgtctcccagaccttctcctgccaaaaggtcagactggggtacaggcgtctcccagaccttctcctgccaaaaggtcagactggggtacaggccaggagaatgtccgagcgtgagagactctaagatgggcagtggctcttggtgtccgagctggtctcatgaggtggccgccccgggtagagctctgagacctccgtcctcagagggaagactccccaaattcccacagagctctgcaccattttggctcgggcaggacggggatgctgggggcgggggtcccactgttctgtgctgagcctaggacgctacttgagatgaacgtgtaactgttccccggagggtaagaagcgccgcgttcttgggtttctcctaatggaataaagtcgggcatggctcccgtgtccctgcgttggcaggaaatgagatcccagtcaatgttcttggttctcacctcctgctgggggctcacggagctccggagaagtctcggggctagtcctacaatgctgcccctccctatccaggcctccgggtgggggctgatggggactgagccaccggcagacgacagggactctgctggctgcagagctggcccctgggtcctgtggtgacctccccttccggggagccccgccctaggacttgaagccccagcagcctcgaaaggtggggagggaagtcggctcctgggctctcacgctggccccggcactggctgtttctcagcaagactgtcccagcaccctgagacacagtcccaggcgggtaggggtgttggcggccttgctgtgacagctcggcctccccagacaggtggtcagctagggtgaggggcttcctcttaccctcaggacaggcgagtcagggttggtgggacctgagtccacaccccagcgtcctcacgcactttccgagccttgggtctcccttgtagcctgggagctgctgtccgcccttcctgtggtgcctgggcctagccagtctccctccaagtgtctgtggggtggggaccacgggggtcccacagagggctttgggagccacggtccccactcccctcccttgcctgcagcctttcggtgagtgggaagcgcctctgctgccctgaggttccctctggcgccctggcccggggaccgcggcctcgctgtggaatgtgctgggtaacgccgtctggcgtcgtcttgtgtccccatacagggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacggtgagtgggcggccaccaggctggtcccagtggaggcaacatccacctctctgctgacctggtgtttcctgagggtttccagcaaggtcactgctcccctgttcctctccaggggtggagtagggtgggggtacagccgggagtggtggccctcaggtcgctgggaccctcccctaggaagccaggtggggcaggtgtcatacctctttccgtgagaggctgcccccaggttgtccagaaagcacacgaaactcctggtttccaggcagcatgggatccctgcgctccccgcaacgtgctcaaccccagctgctccaagagtctgtgcccctggtcagtagccttgggccgtgagatgaccgcttgagtgtcctgtgtcctggataggaacccagaggcgaaacagctgggggcaaggctggccctggggctgggagtcaggtctggggttggggggagctgccagtccaggtttctctcacccatggggggtgttggggttggagccggctcccacgtgaggcccgctgtgtgcaactcaccgtcagcctcacccagcaccccccccccaaattcgttcctccagggcaggcagcttggagggaagaacagcgtccccctgggctagactcggcgcgaggctgggggtcccaggctagactcggtgtgcgaggctgggggtcctggtgcctcacacagggctggcctccccttgaagggaccttcactctgcaaatcccaccctgctcccttgaccagtgctgcaggaatgaagggctttgggaatgaagggctgtgggacggtggctacataggatctgcgcacggccaggccctcaccccagcagggctctgctcgctcgtggctgccaggcagtgcgtggtgctgaacagaagtgctgcaagccagtctgcccctcgggtgtgaggacgcaggggggtgtccgcagggggcgctcagggcgtgtgggccgggcaggggggaccattggtaggtttattgtcgacgctgcggcaggggtcggtgtctgtccctgcccctgacctaggggagctgtggttttctcctcctgccagccccacccccagaggggtcaccgcgtgacacccctttgaaggggcacgtcctgccgggcggcaatgcctgtttctgcctctccttggaaccactgcggacgtctgtctgtcctgttgggttcctaagatgcctccccgttccccaaagcccacagagaacagcccctatgctcctgctgggaccaaaataccagctcacacttacaacttgattttccccatcgcagccggagatgtgtgcgtggctgtgcgcgcgcggttattttaggaacagccaagcagtgggcagggtgggaggtgtagggacgggttctatttttagcctgcttaatgcactgacacttttgggtgcttttaaatgaacctccctgggggtcaatgcacaagctggggacaagtgccaagctggcctctgggatgagttagcgacacgcagggtgctacatgctgccctggtcctgcccggtctccagctggggctaatctggaggtcccgtcagctgcagcatcatgtcccacccaccctggaggatgccagctgagctccttggaagtggccaccctggggtacctggtgctggtgcaaacaaggtttccctccctgtctccctccccgtctccctccccacagctttggagctgtgttttctgccaggtctgtgaggggagatggtgtgtagaggcgcggtcaatcctaagcactgttccaggccctgttggtgggaagcaggaggggcccgtgccagccggcatccatgtcaggggacaggtgtcagggcagtcgggtgccaggctgggctgagtgccttcagtgccaccccctcacaggggtacagctctctgcagtgtctcccctgggccaccagcagggtctggggtgctgtcttctggccatccccctccaccattcccaacatgctgcagagctcacacgccagaggccctgggtcccactggccacagatgggcctgggattctagcccacatagggtcccactggccacagatgggcctgggattctggcccgtgtagggccctggcaattcagggtaaagtcccttaggatggaagcacaggttctccctaccgctctactggtgaaggaactctggccctggctgtttccctcttggtgaaatgatggatatgacctgatggtggggtccagggttggaggatggctggggagacagaagcttccctcctgcgggcagccacgccctcgcccacagcgtccgtacctgcttcccggcccagagcacgggctggactgtggcagaagaggtgccactgaccaccccactctgtcctgctaccccactacaggctgactagcatccggcccttcctcctcgctggggtgggggaactttgcaccaggggtggcatcagtgggcagggctgggcccttggctgttctctgccccctgcaggctggcccggcccaaccaagttgtcatggggcccaagactcacaatacacctgcctgaggccacgatgccacggaaagctgggctcagggcagcttgctttctctctggctgagtggaggcccttgctgtgtccacaactccacttccatctgcgcctcaggtccctgataggctgggaggttgcggagggtgtgggcctggtgctgctgtggctgcaggtgccccctaggcagcacctcaccctctgaggaccctcctctctgagctgcatcccaaggacagtttacaaagccctttgctgactggggttcagcttatctgttgagcaaactttttctttaaaaagtttcttggccaggcacggtggctcacacctataatcccagcactttgagaggccgaggcaggtggatcacctgaggttatcagttcgagaccagcctggccaccagggtgaaatcctgtctccacttaaaaatacaaaaattagccgggcatggtggcacacgcctgtaattccagctactcaggaggctgaggcacaagaatttccagaacccgcaggaggcagaggctgctgtgaactgagatcatgccactgcactccagcctgggcaacagagcgagactccatctcaaaagtttctcaagccagtgtctctagggcctgagggctccaatccccagtgtgaggtgaggcgctcgggcctgggagctgatgcccagcatacagtcgggggtgcccctgccaggtgtggtgcagagcacggcgggggtgtgtgagacctgaggatagcgtctggatgtttctctcacgttaacgggaatgagataggctcattggctgctcatccccaaatccaaatggaaaaccgccattcgggccaggcagaggcaagtactcccacccgttgccgctgccgtgttgagcccaccgtgccgagtggtgttggcaggagcctcccgaggaagctgtgccaacgcaggagtggtcagagcctgtccaggccacagacggggctacgatgagcactgctgcccagggcatgttgggggcagctcctggagaccacagggaggggaggtgggcacccaggtgtgggcagaactggaccaggaggaggaggggcagcagcttgctcaaggcacagggcctcagccacagggtggcgggctgggaaggggcgagggtgtggtgggttctgagtgccccatgcaacggctgttttgggccacgtgctcaagcaggcacccagggaagaccagcctaggtgctggcgtgaggcccttcaacatcagctacgatgctgcttcatcaggagcacagcctggggaaagaatgaaactgacccaggagacaaaagggtccccgggccagacggtcaagcaggaggctgcttcgctgccgcgggatgtggcatccaggctaggcaaggggacggcaggctgccatccccagagggagttctccgggcaaggccgtgaccccactggggctctgagtttgcatccttcctgtgtgtcaagagcagagccggccactgccagcccatagctcccatggtgcggccctggagagctgacttcatgcgggatgtctgctgttctttgcgtagctttactgagacagaaagcgtgtactgttcacttcaggtggccacagtgtacaagtcagggattttagtgtattcccagttatacagccatcacccccaattctatctagatcagctccatcaccttaaacctcagggccattgagcaggcacttgctgtcccctcctcccccagctcccggactctgctttctgcctggtgcccagcttctcacgcagcatgcactgctcctgcgctttctctgtggcagccgcggttgcacggcccatgtcttccccgctgtgtgttcatcctccactggacagctggctctgcttccactccgtggctgttgtgaatcctgctgccgggagtgtgtgcacacacaaggttttgagtggaggcttgactttgccctcttagatttaggcctgggagtggaactgctgggtccccggtgttctcatcaattctcttccagtctctgggagaggagccagcagcagctgcttcgttgtgggtggggggaagggggaggcccgttgttcgggctcccctccttaatgcaggcctgagcagccctcacctggtgccacatgagctactcagtcttaacagaccaccccatcatgtctttgaaatttgaccagaggccagacttgggggcttaaaggagtccatggaaaaccagtctgttaacagggagggggaggagagtagccatccctgaggaatgtgcatcctgggaccttcaggacaagccctggtccatctgtgtcgcacagcagcaggatgtctgcgtggtaggaagtggagggctccgggggctctgaacagctccttaccacagtggggtctacatctccttccaggtggctgcgagatgcagggcgtggtgggggtggggagaggcaggggcaagtgtcctctggaagcagactgtgggcaagactggagtgggtgtcccagccattcctgggctggggccaccgtccaggaggcgtccattccctgtgcagcaggtactgtatctgtagggcagcacccacccctgccgtcctgggagcttcccagaggggccacgctccctctccccctgcctggtgtgagcagaacacagcagagtgcaggactgcaagaatcactgcagaagggcgcccccggaaaaggctctgttgtgagacgtgtcctacctggccccggcaagcacagggaaggtggcagcttggtccgagtgcccaggctgtgcggctgaagggggagtctggcacttggggctccggcggaggctgaggacttgtgagccacttcagggaggtggtggcagcagcattcaggaccataacctaaatccaaggcagctcgcaattggacacagtcctccagagccagttggcgtgaggggtttgttgaggaaggtgtggtgagggggggttttgttgaggacactgtgctcacggactttgggagtcctctgagttccagggcctctctgctgggctgcatctgacactggccatggcagccatgcgggcccttctgagattctgaggtcccagttccacagggcaggagaagcctgctgactggcacaaaggccacacgcaccgagacgtttgcttgcagggaggcctgggtggttctctccaaggggaccctgggagagctggtactcagggtgtcggggccacaagggaattccaagggaattccaggaccagcaacctcagacgtacaggcagctggggcttctctcccgcgtctggacttcacggagctcaggttctggtgggcctttggtgtccaagcgtttctaacatcctcccgtacgcttccacccccgagggtctgctagcttggtgaaaagacgtgggtgggaggcgtggtggcccaggcagagccccccgcagctgtcgctcacctcttcccctcgctctcttccagggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattgggtatcactcacagtttgcctttttttctgggtaatgttttttggattttagccaaaattctttgcttgtataacactctgctgtgtggcatggcagaaggaggccagcacgcagcccctccagctccacgtggagacagaagggatcccggcacatcagtggtaacagcggacgttgtcctcgtggtcacacgtcccgtcttgggtgtggatggagggcagcccggggcagagcctcagccccgcggcccctgagtggcagggctgactcccgtcgacacgagcttagaaagtggattcactgctttctctgtctagaacagacgggtgacaagtatgggcaggaggcatggggcagggtggcccaccccagtgggcagtagcctggcctttttctgtgtgagatctgtgctgcacacctgagggagggggagggatcggccacctcctccctgtgagacggatgcaggtccttccctcttctcggcactgcccccggccttccatgagaagccgactccccacaccgagttttaaagcaaagcccttttcttctgctgcccactcactgtgggtcccattcggctgtttcccccaccagaccccagggaagccggggcccactccgatccgcctgggctcagctaagcacggaagccaagggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagcatgttccagttaa

SEQ ID NO: 257 - DNA, 95269 bp, Homo sapiens
ggtcctgtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaagccacggcggctcctggctacaggttgccccgctgcctggtggggacagtgcccctgtgccagctgaagggtgttgggggctttccaggggcagagccaggcggggcccagcagagcctccgtgcgtcggacacagcaggccggagacctgcgggaagggccaggctgggcccgcggccctggggaacccagcaagggcagagggggctgggagaagggcccctccccttgttggctttgccccccaccctggaggccgcccttcgatcaggccccagcttcgcttctggtgttcctgcggcgcccgagggccttcctcagccccgaatctgcccaagccgagagaaagggagtgatggggagcgctaggggcgggggatgccaacccgaaccaaaacagccaggcagtacacttctaggtggttggacgcggactagcgctgtcgaagcaggctgctggagggaggagggaggcccatctgctcagtgagagcccaggaatctcgtctttcagtggctgcatcgttttcaccattagttgagggaatcgatctgtgccttcattctaagatgccaccgcattcggggcagagccggggccggaagccagggagctgcctgctgctgctgctgctgctgctgctgctgctgctgctgctgtaagatggtttctgtgcagggaaccttggccggctctgcagctgcccgcctgcctggactctccgatatccactcctcagtgcacctgacacgcatggagccggtcctttcctggaagccagaccccaaacaaactggcttccccgaccagtccactcccatgtgggagcttatcctcagaggcactgggtcctctgcctccctcgggcggctcgcctgtttcaggcatggatgcctgggaagggagtgagacgcagcaatgacttgtgcttctgccgagaataaaaatcctgagcgtacgtgtgctctagtcctccccgcccgctcgctgcctccgagtctcatgaagaaagctcggaacacctgctccacggccacatccaggagtggcagggggctggagagtaattattattttggcttatgcaactgaaaagcagggttcgttattacccgaagaggaggaggagtctggggcagttaattatataatgctcctgcctgtcaaagccgtgcccagccccggtctcaggcggccttttctgtgccgttgttgttttcatggagcaggttggagagcttccctgaccctggggcgctgagggccgggcgggagcagacggtgctcccttggttccaggctgtgggcctgtgtgtgtgtgtgcgcgcgcgtgcaggcacagggaggcccgggcagcagatgtgggtggctgagacaggcaggcagcctggcgcttccagctgggctgtttggagcccaggggctgctatcacccccaggctctggccaggaggctctgcagacctgtcctccagaggtgctcctggctgagcctgctccaggaggactgtgcaggccgggctcacgcagggcatggggacgagaggagccagggctttcgttgtctctgaaactcctcagaatatctgggggtgaggctgagcaccccactctgcccacgctcctcagacatctccagagtcctgaggaatcatttctttcattcaacaaatactgatggaatgtttgctatgagccaggtgtgccaggctctgggaaaaccacactgagcaaagcagacagccaggtgtcctaggctttggaaaaaccacactgagcaaagcagacacagatctttgccctcacggagcttacatttgagggagaaggagcggcgattatgttgtgactttttagggaagaaaggatctgattctgtggctggccgtgtagtttaggatctgacgggttaaggggagagatgtttttctctataggtccacttccctgggctctccactccagccagacagctccctcagcatcctgctcccctaagcccttcccctccttgtggtcctgcctgatcatgtccattctacagatgaggccagtaaggcccgggctttgtgattcaggagtcccagcctttggctgcagggatccccgatctgtctgggaccaaacccccctcgttcttgcatcacattgccggaagaagcccagattgtcaacatcctctcaaggggtatgcggttcttagctctcccataagcaaagccaggcagggatgcagatggggagcttcatggccggctctcccttttggttggcaacatggcatgacaggaaatagaattgacccttctggtcttgaggactcgggcctggacatctgggccacttttctggagggctcccagcttcctgttgggaagggggtgattatggcactgagtgtccccaggcagcccatggaaggagcctgcagggtgtggggatcgccagaatggggcagagacctccatgcctccttcccagtcaactggtgggtggtgacagccatgtcgcagtgaggaaggagttaatggccccagctccactctgacttttcctttgcacaagaagtgggggaatattgggcagccatcagcgaagctctggaacctcagcccagctctgggcgctgacttggggaaatggcgattttcatgaatgatgcaccagcggccagcgtattccacatgtagctggaattggtgtggaatttcagctggggacacctgtgccaactcctcctcctccaggtgtgtcctccccttagggtactccctgattgagctgagtagctcctaccgtctgcatggtgaggcctgggggtgtggggtacaggcacacttgcttccagtcacaaccccagcttgcatcctgggcttgaatccctgccctacatgccctgttttgtgaccctggttggattacttaacctctctgagcttgtttcttcatctttacaaaaggttgataacaatacctgtaaggtgggtgaggattaattgagaatggtgtgcgtggctatgccaggaatatagtaagcatacattattatttaccgttagttttttcattacagtttccaggcaatgcatgtcacttacaatgatcattattagaaccaacatctggacaggagactggtgatcatgtaaatgatgttaaatagcaacattagatacttactgtctgccaagcatgtggcaagtgttaaatgaattacagcccttaattcttacacctctagagggtgattttcttgttattctcattttccacactgggaagtggaggctcccagtgggtgtgggttgggaggaaccagcaggcgtcacactcaggacagccatcccagagcctgggcctttgctaggtacgtcgctctctaaatgcccctgtgcaaaaacacctcctgttctttcctctcgtttatatctctcgttctcttgtgcgtacagtggcccagaattgcaggtgaatgcccatgcacagacgggcaaacccatacactgcccaggacccctggccccctgaggcccaccatgcatgccggtgctgcaccgcacaggtatagatctttccttcgggtgctgtgtacacagaacccctcgaatcgaaagttaccccctccaataagccctcctacaccctgaaagatatgagtcatctcacgcccaagcctctccccctcatactcaggtcccgttcaccggcccagattcctcaacccacacaaatcacacacacccacagtcggaattcagatccccccaggcgcctgcgcacacacacgcgcacaaaacacctgccacccggagacattttccaccccgtcccccagaacgcagccactgcgcccttgcggccttgcttgctctccactggccaaggactctgaatctccaccaggcctgtaaacggggagctcagatgacagaggcagtggtgtgcttcgtttccattttaaacacacgtttatgctgttagtgcccttttagggagaaaaatccctcatctcaacaaaataaactaccatggggcgtatgctttgtgcttggctatgactatgactatgcaacaagtaatttctttttcaaatgagtgcccaggttagaaggaatcaggttcattggtgcggagattatgccaacagaaactcatttcagaaacaagaagcaagccctgagcagttggagacgaaagcgttttctccgagattctctttccgctacttcggggggcgggtggtgaaaggctccgtaaggtgaaaagagaaaggaagaagcaaacagctatttttttgttgccagttatagctgagaaacaaatgtggctgaagggcacccctacccacgttggccgtgaggccgtttgatgggctttgtgtgaggaatcctgagatgagctggccggggagtgaggaccggcacccgcctacagcagcgatctggagtagtgagtgagcagccccagctgacacagagaaggagagagagaactctgaccccttctcttctgaggacacccagccggagagagcaagaaggggtggagtgtgggggtgggggcaggagcctctgctgttcctttccaagactttttcttcctgttttccccaagcctccacaactctaaatatgacgagctctcaactgtgagctaataatgttgaatgtaacgccctttgtgtccttagatgacaaaaagacttgtgagtactagaggagagggtgatgttggtgtgaattttccacattggtccgtgtctccgtggactggccgcttcccccgctggtagcttcatggctgtgagaggccatgcggtggatggagccaccgctgcactggggtcctggctcgaacttgagtaaggtgctgtcttccaagtctggagaggagaggaggagagaagagaggcagtcccttcagcaccttggagagcgctcccggctgcctgcctgggttgggtggacggctggactcactttcgctctaggcatcctcttcaagccaaaccatctctccttgccagtgaccgcctggtcccggaccctccagcacactcaaccaccagaagtgtgcctatgcctgtgccagatgtgggggccacgcctgcgatcccaacactttgggaggccgagatgggaggttcacttgagcccaggagtttgagaccagcctgggcaacattgtgagacccccgtctctacaaaaaatacaaaaattagccaggtgtggtgctgcacgcctgtggtcccaccactcaggaggctgaggtgagaggatcgcttgagccccggaggtcaaggctgcagtgagccaagatggtgccactgcactccagcctgctgacagagccagaccccatctcaaaagaaaaagaagaagtgtgcctggtcctactcagtcggtgcatggattccatgctccaggaagggctgccacttggcatgcctgcctatgttttcacccctaccctgtcagtccttcctgaagaagtgagtgtcttctgaggtaacatcctctgctggtcaactgggagagcagctcccagcttgtggaggtgggtttgggggtgagactttatttttttgtttttatttatttatttatctgttttgagatggagtctcaccctgtagcccaaggtggagtgcagtggagtgatcttggctcattgcaacctctgcctcctgggctcaagtcattctcatgcctcagcctcccgagtagctgggattacaggcatacaccaccacacctggctaatgttttgggttttagtagagacagtgttttgccatgttggccaggctggtcttgaactgaactcaggcgatctgcgtgcctcggcctcccaaagtgttgggattacaggtgtgagccactgtgcccggcctagggtgagactttagtaagatgtatagaagttgctctgaagtctaaggtgtattcctgccataggatatgtgtgttcacttctcttggagcataacaggggtcataggtgcacagccgaaggcaggcagaggaatgatttgtctgtaccagtcagtgaaactgtttcaccaccattctctttacatctgcctcaatgggtgagtcctctagaccaatggtccccaacctttttggcaccagggacctgtttcatggaagacaatttttctaccgcccagggttgagggatggttttgggatgattcaggcgcattctatttattgtgtgctttatttctattattattacattgtaatatatagtgaagtaataatacaactcaccatcatgtagaatcagtgggagccctgagtttgttttcctacaactagacggtctcatctgggggtgatgggagatagtgacagatcatcggacattagattatcataaggagtgtgcaaactaggtccctggcatgagcagtttccagtaggctctgcattcctatgagaatctaatgctgctgctgatctcacaggaggcagagctcaggcagtaatgcaagcgttggagagcggctgtaaatacagacgaagcttcacttgcttgcttactcactcgccactcacctcctgctgtgtggctgggttcctaacaggcaacgaaccagtaccagccacatttcacgggctcaacagccacctgggactagtcgccaccatattggacaatgtaaatccagaacattccatcagtgcagaaagctttattgggcaggcagcactggtctggagtgtaagttccatatgggaagcggtttgtgtccatgctggtcactgccatgtgcccagtgactaaaatggtgctggcacgtggtggtcaataaatatttgtggaatgaatgacctgtgcaagtaaatgcggtagtatttggtaattttgtttaccgtcattatttcgtatgcctgtttcattgcaagaccttagaattggacgtagttaaaggaaagtttttccgtgagaccctcatgtccacaggtcagtctccctttacaattagcattaaaacatgcctgttctaattccttgatcagttttgttttgtggttggctttgtcattgctccttaagagactgccagtgtttcatatgagaaagatgatggtgttgaatgcagtgaataatggagcgataccagcagtcatgactgggaggcatttttggaccacgatttaatgagtagcattcattgcaaagtgcaaagaaaggcccatggaaagatgagtaccctccagtctgcttaattcctcactatctttttactgctcccttttccttggcttgattcgttcagtcattggagaagcatttgccaagttcagaccgtgttcaaggcacaaagacagaaaagctcaggtccaacctcagtgaatcagccttaagtatttgctgagcattgagtatgtacgcagtacagagtttgtggtaacgtggaagattggaaaaaaagaaacaaacacataaaaatgaaaatgcaagaaataggatgtcctatgttctaccaggaagaataaggagtctgaacagggatgcaaaaccgagatatatggaataattcagggtttctcatgccacagtgggggtcctgaatgggagcaccacagggcagggacctgaggaggggcagggcaggtgtgtgtgtccctgaaggagcggcagaggcttctgggggtaggcagtgcctgagttgagtctggaagggcagtagggtgagagttgttatcccaagcctgaggctgcagatttgttcgaggccatgtctccctcagcctcagcttccccatctctatgatttagtcatgacatttttttccttctcaacatgtgccatctccctcctacctatgaatgtcacgggtattgttctggacccagggaaggctcgctggtgcaaatgctttccaaaaacaccgagagtcgctctctctgctgctggtggagtctgagttgggcaggacatgggcccgcctctgtctgctgctctatgccagtgcttcccaagcctgagtgttacaagaaccacctggaaggtgtgtcaagacacagatttccagccccacccctgagtctctgggcctgggatgccacccaagaatttatatttcttacaaatttcaggcgatgctgaggctgctgatctggggacctcacattaagaaccacagtcctgggcttgtgcctcctaagcctggctacacattcgagtcactaagaatgtccctgggagacggttagaaatgcagcgtgtcaggcctgcctgacctccagggtcaggatgtgtgtttggagatgctcaggtggctgcagtgcaggagatcctgctttggtgcactcactttaaccctagctgtgcatgagcttcatctaggttgctttagaaaatgcagatgcccgggccccacccacaggtgctgattgaggtcctctgggtacagcctgggcattgggattctttttattttaatttttttcagacgggggctggctccgtctgtcgtcctggcgtgcaatagtgtgtgatcgtggctcactgcaacctctgcctcctggcctcaagccatcttcccacctcagcctcctgagtagctgggactgcaggcatgcacccccatgcccagctaagttttgttatttgttgtagagatggggttttgtcgtgtttcccagactggtctcaaactcctgagctcaagcgatccgcccaccttggcctcctgaagtgcttttacaggtgtgagcaacttttttacaggattacaggtgtgagcaactgcacctggcctgagattattttttaaacattccaggtgattctaacgttcagcgcaggttgaggaccactcatctggagcgtctgtagctggacatcacttgggagctttgatgactgacccatgccggggtccatccaagaccactgacactggaaactttaaggcgggggtctcagcctgagtatctggtcacagcaagcagggcctagagttgcagctgtagataagagtttttcacactctgggtcaagtggttcatgaaattaatatagtacattaaaatagactagaggccgggcgtggtggctcatgcctgtaatcccagcactttgggaggccgaggcgggcggaggccgaggaggtcaggagattgagaccatcctggctaacacagtgaaaccccgtctctactaaaaatacaaaaaaaatattagctgggcttggtggcgggcgggcacctgtagtcccagctactctggaggctgaggcaggagaatggcatgaacctgggaggcggagcttgcagtgagccaagatagcgcccctgcagtccggcctgggtgaaagagtgagactccgtctcaaaaaaaataaagtaaaataaagtagactagaaattttccaagcacaatacctacgtttctttctttctctttttttttttttttttttgagacagagtctcactctgtcgcctaggctggagtgcagtggcgcgatctcggctcactgcaagctccgcctgccggattcacgccattctcctgcctcagcctcccgagtagctgggactacaggtacccaccaccacgtccggctaattttttgtattttgtttagtagagacggggtttcaccgtgttagccaggatggtctcgatctcctgacctcgtgaaccgcccgcctcggcctcccaaagtgctggaattacaggtagcgtgaactcagctcactgcagcctctgcttcccgagttcaagccattctcctgcctctgcctcccgagtagctgggattacaggtgcccacgaccatgcctggctaatttttgtatttttggtagagacggggtttcaccatgttggccagactggtcttgaactcttgacctcaagtgatccgcccacctcagcctctcaaagtgctgggattacaggtgtgagccacctagcccagcctattgtgttgtttttgaatatatttttgatctgcagttggttgaatttgtggacttggaacctgaagctatagagggctgactgtgtatgataacctagaactgcaaagccagggaattcctttgaaagaaaaacactttttctttctaaaacatctattttgttccaagtattgtgctgggcattttatcatagacgttatatcttacattccttaagataatgccttgagataaggcattccgctcccatttaaaagacaggaaaggtgaggctcacagggtcacactcgctgagatcacagcgctgcaaacttgtttctggccgcagaattgtttccggcgctccgagatgcctttcttgatggagccagcattccaggggcccacttgctttacagatgaggaaactgaggcccaccaagggaggggccctgccccaggtctcacagtgaagcaggggcagagaggtttcactcccagcaatttgtaagcttgggggactgccagcgtggtgtggacacagagctgcgtgacccctcccaggataaaagcaggtccctgcagatacgaggagccgcgtgtcccctcccaggataaaggcaggtccctgcacacaggagctacacgtcccctcccaggataaacacaggtccctgtacacaggaggagctgtgcgtcccctccaaggataaaggcaggtccctgtacacaggaggagctgtgcgtcccctccaaggataaaggcaggtccctgtacacaggaggagctgtgcgtcccctccaaggataaaggcaggtccctgttcacaggaggagctgtgcgtcccctcccaggataagtgctggtccctgcacacacgagggtccgcgcgtcccccgcaggataaacgcaggtccatgcacacaggaggagctgcgtgtcctttcccaggataaaggcaggtctctgtacacgtgtggagctgtctgttccctcccaggataaacgctggtccctgcacacaagggggtctgcgcctccccgtcccaggataaaggcaggtccctgcacacgtgaggagccgcgcgtcccctcccgggataaactctggtccctgcacacacgaggagccgcgcgtcccctcccgggataaacgctggtccctgcacacacgaggagccgcgtgtcctctcccaggataaacgctggtccctgcacacgtgaggagctgtgcgtcccttcccgggataaacgctggtccctgcacacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacgtgaggagctgtgcgtcccttcccagaataaaggaaggtccctgcacacatgagggttggtggctctcctgagggttcacaggttcccggggacccatccacagatccccagataagaacctgtccatcctccccggggcctaagcgtgcccagattgatctcagtttgcccagtgagtagaaaaataggccgggatcagcagattcctatagacctggtggaggcctgggctggagtagacccaggcagagttggtctttcacctcgcccccttccggaggccccgtacccttggggtcagcatccaggcaacatgggatacccagaaccttctttcttgtcctgagcccttctctcccagctcggcatggacttgagtgacagctgctgtgtttctttcctgcccagtgagtggggccgggccctggagctttccctgttcatttgtttcgtctccttgtggggaaagcatggctcccccattttccagatgggaagcaggctcagagatgcaacagaagtgggaagtgatggagcagggactccatagctccagtcacgagtctcaaactctgtgcgcatctgggtcgcctgacccggcctccctgacccgggctgcccagaagggagcccaggaatgccggggagggtcacacagccagggccattcaatgcaggtggtgctgggaccacgccttgagaagctccagtcgccttccctcctctgcaatgaggcattgctagggggaggcgagtgggggaagagaccgggtctgttggggtcagccccgggcacagcacccgacagcagaggagacctccggaaatcatggctggatgggtcaatgagtggtcaatcaggcgagctctgagcgacaggaggggccggtggtgtggagagagggaagaagagcctgcaggagggagacggtgcgtgcaggggcaccacggccagagcctgcttggtgttcagagagccctgtggctgccgcagttgggagaagggcacggggtctgagcacagacagcttccaggccccagggttgggggactttgaattttctccagggcccgggaacgacattgtctgatttaagcagaacagcaacgcaatctggttttgtgtgtgtgtgtgtgtgtgtgtgtgtgtgtgtgtgtgtgtgtgtgtatttttttttttttgagacagagtcttgttctattgcccaggcgggagagcagtggcgcgatctcagctcactacaggctccacctcctgggttcacgccgttctcctgcctcagcctcccgagtagctgggactacaggcgcccgccaccacgcctggttaagtttttgtattttttttttttttgtatttttagtaaagacagggtttcaccgtgttagccaggatggtcttgatctcctgacctcgtgatccgcccacctcggccttccaaagtgctgggattacaggtgtgagccactgtgcccagccaggttttgtatttttgtaattacactttttattttgagatcaccgtagattcccaggcagtggtgaggaatagatcagagatccggtgtccccctcatgtggtctctcccgaggtggcatcctgtgcaactgatgacatgtcggaaccggatattgacgtggacacagtcaggatggggagcacccgcgccccggggtcccttgtgttgcccttttgtagccatacccgctgccctggcagcctctgagctgttctccattccttcagtttcgtcgtttccaaaatgctctgtaaacggaaaagtacagttcgtcattttggggctggctttcgtcactcagcctcatttgctggagattcttaggtgttgcctatatcaatagttcgttccaggctgggctccgtggctcacgcctgtaatcccagcactttgagaggcctaggcgggtgggtcacctgaggtcaggagttcgagaccagcctggccaacatggtgaaaccccgtctttactaaaaatgtaaaattagccgggtgcggtggtgcgtacctgtaatcacagctactcggaggctgaggcaggagaatcacttgagcctgggaggcggaggttgcagtgagccgagattgcgccgttgcactccagcctgggtgacagagtgagactctgtctcaaaaaacaaacaaacaacaaaccaaaaaaccaaataaaatagtcctttctttcttattgctgggcggtgtcccacggtgtggatgggccgtttgtttaaccatctgtcccttgaagggcatctggggtgtctccagcgtgggatgtcgtgaatttaaaaagctgctgccaactctcaggtccaggttttcctgtgcacagatgtcttcgctttcccccagtggatgccaggagagctggtgctgggccgtgtggaagttgtatggctgagttcacgtggtcactctggtgctggcagggcagggaaatggggggccagagaggaagctgggggtcatgggagggatgccacctctagggaggggtgcctgtgtccaaggagtggagatagtggctgggtctggtgggggctgtggaggtaggggggctgcatggtagggcagaggccaggagtctgggactgggtggtcctgtctttgagggaatttggagaaggagcaggtgcaggtgcaggagctgagagtcacctgtgaaacatgctcagcagagaagctgtgcgcagccggggcaggggtgcgtccatggtggggatggtgtgtctgggtggaaggggcggggcatctcccactcccggtggcattgaatagtgcgaggggagtggctgggcgcggtggctcatgcctgtaatcccagcactttgggagactgaggtgggcggatcacttgagttcaggagtttgagaccagcctgggcatcataacgaagccccgtctctacagaaaatacaaaaattagctggggcatggcagcctgcgcctgcagtcccagccactccggaggctgaggtgggagaatcacttcagcccgggaggtgcaggttgcagtgagttgagattgggccactgcactctagcctgggcgacataatgagacgctgtctcaaaaaaataaataaataaataataaaacttggaaataaggcaaaaaatattatttaaagaaaacagaaagtgggaggggagaaatgcacaggatggagcctaggggagccccaggactcgagaagtgggcagaggaagaggaggcaggaggagggagggaggccgggcagcagctgggggaggagggcgtggacaggccgggaaaaggagcaaaggcaggatgaggacacaacactggcctgtgcctggccttgtggcaaacacctcatcccttaggccattggccatcgtccctgctgtcctacagccccgagaggccaggtacgtccatgtgtcgtgcccattttacagacggtggagctcaggcctgggagacagactgacagtgttcggcactaactccaccccagcctttttccacctggccacactgtttactcgttcccgccagcagcatgggggctctggtgtttctgcgtcctcatccgcacctgtcatcgcctgtctttttggttgcagccacttctgggatggatttcctggaggctggtgctgagtctctctaggtgcttgtcggcccattggtacatctttggagcaatgcctgttcagatccttgcccatttaaaaattgggttatttcaggccgggcgcagtgctcacacctgtaattccagcactttgggaggccgaggtgggcagatcacctgaggccaggagtttgagaccagcctggccaacatggcaaaactgcatctctactaaaaatgggaaaatgagctgggcgtgatggcaggcgcctgtaatcccagctactcggaagctgaggcaggagaatcactcgaacctgggaggcagaggttgcagtgagccaggattgcaccactgcactctagcctgggcaacagagtaagactctgtctcaaaaaaaaaaaaaagggggggcactgcgcaccagcctgggcaacatggcaaaaccccatttctataaaaaatgcaaaaaattagctgggcatggtggtgcctgtagtcccagctatgaggaaggctgaagcaggagtatcacttgagctcaggaaatcaaggctgccgtgagctatgatcacgccactgcattccagcctgggtgacagagcgagaccctgtcttaagaaaaaaaaaaaaaagaaggattatttgtcttcttactgttgagttgtgacattttcgtaggctgtagacaccactgtgagccaccggctcccctgcaccccagcccacctggctgcaggctgcctgctccgttggaggttggacttctgagataaactgcgctgggtgtctgtctcttggctccagagtaccaggcacagtgccatgcacacagtaggtgctcagtaagcggcgacaggacaaagccaggatctcagtctgcggcttggaggggtctggggtccggctgtcactatctggctctgcttaccagctccggtcctcggacaccacgacggctgcaggcagagggaggagccacggagtctggggggatgttgggccacacaagtatctactgagcgccgactgtgtgctaggcaacaagctggccctggggacagtggtgaacaaagagccctaggacttcttggttgggggaataggacccgtcagtcagccctgcacagcttcctgcggggcacggatggggcgcaaggaaggggctggagatgccttctagggagtgaggctggtgagcgggttggggaggaaccatggggcctcccagacttcaggaggcgcatctgtgagcaccagggacagaaggaacagggccaccctgggacccagtgcgcaaggagcccaagggccctcacacgtcacccttgggtgtgccagagccagtccagttgttaagaaaaacaagagccggaggtaaaccccttgggaaacagaggtcccagcccacagtactgcgtgggagggagaagtgtgggagtcacctgggctctggggtccctcaggccagcaatggggactgggatcccagcgcaggctgagcctgggtggctatgtccacactgcagagacctatcgtgagcaagtttatggtgcattcctgtgtggaagagtacagcagaggccaggggggtggggctgcagcgacagtgaccaggagtcacccataggggcagggtcctggtgtcatgggccagagcgggccagagcggggacggggggcaaagggaaggagcatttgagcctggatgggggtgtggttagcagagaggtgggaggggagggagagagagagagaaggagagagagggagagaaggagagaagagagggagagggggaggggaagaaggagaaaagggagaggggtgggctgtgaggagagggaggggaagggctgcagagggggaacgtcagtcctgccatgggggggacgtgcgttgttcctcgcccctcccttccaggttttgatggtgctgtttcctgcgtttacaccacagctctttttgcgtctttccttggattccacacagcagccctgtgaggcgctgtcctcctgctgcccggaggaggagactgaggccagagatgcggcaaatttcccaaggccacacggttctgctgttggggcggcactgggcctccctgcccgcctgcctcagtctggccctgtgaagaggtctcttggaactgttaggagcattcgaaagaaactgggcccctgggctgggtacggtggctcgcgcctataatcccagcactttgggaggctgaggcctgagcacttgaggtcaggagtttgagaccagcttggccaacatggtggaaccccatctctaccaaaaaatacaaaaatcagccaggcatggtggcgggcgcctgtagtcccagctactcaggaggctgagacaggagaattgcttgagcccgggaggcggaggttgcagtgagccgaaatcgtgccactgcactccagcctgggcaacagagcgagactctgtctcaaaaggaaaaagaaaaagaaactggtcccctggagcgcaggggtcagcagctaacttctcgccctggcagctggacccgacttggcccagagtgccagggccagtgcccccatctgctctgtgtcgggaggggctgctggcaggaggaggtggccactccaaaatcctatagacggagtccgggggagggggttcgggacaggaacagcccagacctgggatccgcggctgcgcaaggggcttcagggtggtctgggcctggttctgagccctgtgaatccaaggccacaggactgggcctgggggcttctgaatccccaccagtgccttcttgctctcaggagcgttggccaaccccccaggccccagggcttcccctcgtgattctcctctgagagaaacacacccacctacagccgccagccaggagcaattgctgtgcaaacacccgggactgtctcagacggtggatgcaggcagccaagcccccggaaggctccggttgaagggccgggtttattcctccctgcaatgagggtggacactcccccaggaaccacggggcaagagggtgttgggaagagccccactagggtttggggtttgggtgggtggtggggaggggacagtctagggacgtagggctcactagaccaagtgctgttggaaagggggcgattctcctgtgggtgcgttggtcactgtcgcctgtagacatgggagacctgcaccaaaataatgcggagatgggtcaagaagcagccgcccctccccttagtcgagaggggggatggttggtgatcgtgggtggcacagtgacctgtttctatctcactctactgtgatctcagagtgaccttgtctggggtcactggggtgttctgggagatggtttatatccaacagaagaacgacgcagcctggcaggagctccaggtgtcaggggggggcccctttggggtggaggggatgcctcagagccagccgcatgccaccccacaagctacctctctgccgccgtctgccccagagctgcctgccttccgaggcctcagctggtcctgtgcgtccctgcgtctccaggactcttgggtgatggctcaggggaagtttccagaaagcccagccatttcctcctctcctcctgggcttgggtctgaggtcagcttcccagggggcacccaagcctccgtgagcaaggacagagagtggctggagtgagaacgggtgctgctgacctttggcggtgggagggtgtctccagctgtgttcccatttctcagtgactaccaggtgctgtggcccttggctgcagaggggcgtgcaggcagcctctccttcctgtgaagcagcagctgtggcagggccgggaagtagagctcccctctgtgaggctgtggctggggtaggaggagagctctcccttctgcgaggctgtggctgggatggaagtctgccagaggcgggctcagaagaagttccatgaggaactgagggctgggacctgcaggaggagctgagggtgcatggggtctgggggagccccagagatggtcagggtctcctcctgataaatcagacccccccccgccccaccctgccgctgagaggcctggtcctgctctaaacctggagtggatggggagcgtgggctggggctggggggctggggaggtggtgtagccagtgccctgccccaactcagcctctggtcacccttccagggctggcaaggcattgggggtatgagagggccctggggtcccagggtctcagaggacttgccttctctgcgatggccgctactacctgggtcccacaggggggtaagttcagagggggacctggtggaggtcggctgtgggcaggggagccacaggagtgtccaggcccctcccaggccagccccacagattctgaggcagcagtgggggcctcaatggaggagtccactctgcccaccccggatactgcccagccagcctgggttccagcgtgggccaagctctcgtcctggtctcctgggagctgtgtggtcctgcaaggacctcagcaccttccttgctttgagcatccctcccccaaggcctggctgacactcggagccagtatccatagagggctgcaggggcaggcgagggtggacactgatgtccttggctcattcctccctggctggctgctctgatgtccagcagggtgggcgtgaggctcatggggggctccccagccagggcaggacctggggtaaccctatcctgggatgtttgctcccgctgtgtgggggacatgccgtttccatgagtgacagagtcaccgatgtggccagtaccactgtgggcttgaggcatcttctagtttaaggaaatgttaaatttcaagtaaagcttagtgaaaataaggatgcaatttcattccccaacaaaacaacctctatttccttctgtgaaccccttgggagctgcagaccccgagttccggaccccctcacctcactctcctccttcggagccaaagtggtgcctgaaatctgaggccccatctctgagtcctgcactggtcctggcccgaacactcccccacaacgcatgggccacaaggaccctctgggcagattttggggtgtctttggaggtttaggggcaaagcttgaaaactgtggggtcctccctggggaccacatgcccagctgtggggtcccccgaggccgcagagcaagctttctggaagatcctcctcctttgagagccaccatggagcccccataatgggaatggagggtgttgccattaaacatggccttggcgttgcccagaagtctaggtgtgtccctgtcagctgggaggggacagggtaactgtgcggccctccccagggctgaggctggggcagcctccagaggccaggttgtcgctgtcactccccaaatggagggtccccctcattccctgattgcagaaaaagggctccagtaagtctggcttttaaaaaatacagctttgctgacatatgtttcacacaccgtacaattcacccatttaaactgtacagtccagtggtttctagaatattcagagttgtgtcactctcaccataatcaattttagaacattttcatcgtctcaagaagaaaccctctagctagctaccccttccccattcccacggctccccacccctggtgaccgagactccattttctgtctttgtgggtttgctgctcctgacgtttcgcatgcgtggagtcatacgctgagaggccttttgtgtgtcgcttctgttgcccagcgttgttttcagggttcacccgcgtgggagctgcatgagtccacttcttcgtatcgctgagtaatattccactgcggggcaccgcgttttgtgtgaatctgccaccactcaggatggctcatgggtggaaacagcctaaagctggcagaggtttgggctgtttgccagccctgggtcacttttgggctgtttccacctgggggctatcctgagtcgtgctgctgtgaccatttgcgtcctttcgtttcctcctgggtggagattgtggggtggcctggctgggtcgctctgggcccaactctctgagaagagctgttgaacacataccccacagctttttttagtttttatttatttcattttattttttgagacagagtttcactcttgttgcccaggctggagtgcagtagcgtgatcttggctcactgcaacctccacctctcgggttcaagggattctcctgcctcagcctccgaagtagctgggattataggcatgcgccaccatgcccggctaattttgtatttttagtagagacagggtatcaacatgttggccaggctggtctcgaactcctgacctcaagtgatccacctgccttggcctcccaaagtgctgggattacaggcgtgagctgcctcacctggccttattttatatactttttaagacggagtctcactctgtgagccagcacacctggcccatggcttcttttaaaaagagacttctggaagctgagaagtcttttccagggctccacctggcgactgaccactgggcatggtgaggtctgcgtttggaggaagtggggtgacagtgacagctgtgactattggagcacacagtcggtgctgggcaggtgggtcattcctgaaccctcagtgtttccctcctcgggggtcctggccagtcactctcctcctccacaccagcccccagcagctcgcaggctgcctgggcccagccccatcatcagccgctgggcacccacctgagaggtctgaaccctgcccttggtgctgcacggtcacttgccattttcgcagaggggccccctgagcaggaggagcagggccagcatgcacactgcagccaaggtcccaagaaggaagtggcgaggaggaggaggaggactggccccacctgttgccctatgtctcacagcgcagactgggggagacgtgaggatctaacaggggttcctggggggccttcatcaagctgtaatgaatgttgtgccaaacccctgtcaacaccagtgggtacagcacagggttcaagggctgaagaagtgacccagggctagcaaaggagacccggggtttactgcgagccgtggggtggggagggaagtgcagggacgggagaaccgcagcggcttgtagacagcgcaaagttcctatggcatgttcaccccataccctcccctgatgacctccacctgccaaccttcattcaacccaaaactcagggcctcaagcccctgcacagcgcacgttccacgggacaggccaggggctcagaagttcctcatagccaaggaggcaatctccagattggccactcctggattccttagctcaggttgttcttggagtatgcgtaagttactgctatcgggggtgtttaccctccaacaggtgtttggtgggggaggagcctccttgggggtgccaagagcaacagcggccggggtctcatgtctgtggggccactcccattgctttgtgcttagtaactgggtcttcaaggcagccctgtggggtgggaatcatttttatcctgtgatatttcattgtgcacacgtgcagactgaggttgcttaactaccccaggccgcacagttatcaccatggagctgggatttgtaccctggtggcttagcacagagcctgagcacacaactcccacccgcctgcctctctccgaccgcgagtcctccaggaggactggggctctcctcccagcaccaccacggccattgagcccagtgcccaggagaccgaggcctgtgaggtttcacctggggcccggagacaggctccaagtggtgtgggggcccctgtgcccaggttttccccgaggtgccggctcatagctacacatgcccatgggcctgcctgagcccggtgctccaagccacaccccgagtgggcggcctccctgccacgcagtcctcggcctgaggccgccacactcagagccactcagcctatggggtggtgcatgtccagaaccctgacccttgggaaggttgggatggttggagatgcagatgttccaaggggaagtggcgggagcgggtgctggctgggaccaagggattctcaagagaagacgtgagcttcactcaggcacagctcttcagcagcaagagtgttggtcctaaaagatcatgtaaatagaggagggcatggtggctcatgcctgtaatcccagcactttggggagggcaaggtggaaggatctcttgaggccaggagttcaagaccagcctggacaacatagtgaagccccatctctatttattaaaaaaaagttttttaaaagataattttaaaaggtggttgattctgaaataagaatcacctgggaagctcttaaaagcctcaagcccgggcctgccccagccccgctgaatcagtgtctctgggccggggggcgaggccagtcattagttgccaaagttctccaggtgattccaactcaagcctctttgccctagagccgtggctcagcttgaggagcattagggcccctggaggttgttaaacccacgttgtggggccccagcccccagttcctgatgcagctgttggggtgagctgaaaatctgctgcagagcctgcatttcagggttcccaggtggcgccaccagcttgagggggtcttggcgctattgtaacgataacagcagcggtctccagaaccttctgtaggcctctgcatgctcacaggttagaccactgagaccacccatggattttatgtagtagacacacagggtgggcctcgtgcccagtgttgtctaacatgctttgtaagtgcagacccgttcctcccagtgcctttggaggtggagattgtggtccttgttttacaggcagggacagtgaagggactgtgaccgctgttggtgccaggcatctggctgcagctcccaggctctcatccctttgctgtgctcctttgcagcttggagggaatgattttttatccccatcttacagtatggggaaggtgaggctcagagaagtcaaggacttctgtctggggtcacgtggctaggaagctaacagccaggatccgagctcagatttgcccgacttccacccatgccggtgggcgggttttctccttggagaggggccagtcctgccccgaggtgccatctctgcacaggtaacagcatcagccaggcaccctgcaggccaccccgcccctcgcaggggtttccactaaccctgctgtctgccaggccagcctgtgggccccaccacctcctgggtgagcgttcccaacatcagagctatgcagcaggcagtgaggggatcatgggtctggcaggggcaggactgggagggacacccttatgtgctgtgtcctgttcctgcctcccctgttcacgccccacagaggagggaggaagctggggttaagggcaagggacagttcctgctctcccaggccccacaaggcatgcaagaggctaaaaatcagaagccagcaggacgcccaggtctcctgagcctgtgcgtctgatctgctcacctgggagacgatggtgctggcatgggcgggtcagaaggagcagcaggacccttccacggcccaggacaagccagccctcaggggccagagcccccatgctgggcacagggctgccaccttgggcggtgccctccctagctgccgcacttcagagtgagcccccatccctggcgtctgccctcctgagtgagtgagggaggggccgggtggggccggatcgtgatcagagccggagctggccttcgtgagtgatggccttgcctgctctgttgcccggtgacagtaaagaatattcctacagagtgtgggttttggaagcagacatgcctgtaggggtcctggctcagacgcttacctgacgttagcacctgggcaagtggcttaacctcatcactcggtgttggcatctgtaaaatgggcacaataacatgctaatgtctccctcgcggggctgtgcgagaatcgattcagtggcccgtggaaacccctagcgtggcccggatgtgtggtgagtggccttggaggcgtcagccttcatgggaggtgggagagctttgccgtcctgggtgaggtcggggtaagagaaagcagagtcggtccccagcaggtgtggctgggaggatgctcagtcactcccaatgttcattgggagtcactgtgctcccagtggacagagtgtcaggtagggtctacagatgagccccacttcttagccttgccctgggtccacaaatcagccagagttactgggtgtggggcttcctcaatgtcagggatgggggtgaacagaagggctgggtccggagtctccaaggctccttccaggctccagggctaacgctgtggggggggcccaggtctccacctcttgttgctgtgtggccttgggcaagtgactcacttctctgagcctctgtgtgtcatggggaagtgactccatgcctgctgctgtctcggtatttcacaagtgctcagcaaatgccagcagaccgtgtccttcagacgcggcagctggggttcctgactgctgggctactgctgcggtggctcatgaaggtttttctgtccccactacaaaacaaaaggcagctgatgcaggagttttagtaaagataatgtatattttagtaaagataacgtatatttgatttaaaagaatgctctttattctgagatttggtccatcccatctttgtgggtttttttttttttaatttggatgtgaaaaagacattccctttatttgtaattgcccaaagtcggaagcagcgaagatgccattaaatagggaagtggataagcaaacagcggtgacgacgcggagcagccttcaatgcctggtgctcagcgggataagcccgtgtgaagaggccacatcccgtggggttccaactagatggcgttctggaagaggtggaactctggagacagtgacaagatcattggttgcccagggttgggggggagggagggacagacaggcggagcccgggggatttgtagggcagtcatactactctgagatactctaatggcgagtatatgtccggatgcctttgtgcacacccatggaaggcgtggaccctgatgaaaaccatggctctggttaataatgtatctgtcttggcccatcaattgcgacagatgtaccacaagatgctaatatcaggggaagtggggggcgaggggatacagtatatgggaactctctgtactttccacttatttttctctaaagctaaaactgctctaaagtattttttaaaaagaaaaagttaaaaaaagaccacatgaacccatgtggagagtggaagaagcaaagtcaaaacattgcccagagtccatgctggaagccagttggggcgtggctgctccactcagttgactgtctgagtcttgtccccacagcacagattggtggaccttcagcccccacactggaggcactggccttccgaatcccttctcacctgagtggggtcaagacgcacctgggtcctatttgctgcccacctctggggccagctgctgttcttggcacctcccaccctagggggatggtgtctgcaaacggtgcttttggcctctggcatgtccaccctgccacaatcatcttcctcaccctcatctgcagaccttctgacaccacctctgctgacccctctccccttgtccttctggggagatcacgaacctgccccttcctggcattccccagccagtcctccctggggagcaggactgtgcatcgaggccaggctcaggtcttcacccacacccacgttgacaacgtacgagtcccctctgagccttagtttctgtggctggaaaaatgaggttaatatcactattgtgagaatcttctcataaacgcatctttccttcccctcctccttaaaatttttaatccttattgagctattatgtgcccatagtttaaggtgacatttggtgctaaaaacaaaatagagcttggagcaaaaatcatgtgtgtcttcagagactgaccaccatgtttttaagtgggtgtgtttgccgcttcctgagctcatggtcacttttagccattatctgttgactcctactgtagtagatggagattttcaatcccttagacccccattctccccactcccagctatctcaatattgctatattgcattttttgttgttaaatccatactcagtgtttttcattatgactatgtaagtattgcttactgctgagccaggcaatggagtctgattctgtacacttctcatgcataacttgagttagtaattgtctcgctttttttcagttgcaattttctttaaatcactggttcttttttcaccttccaactgctcagtgaaacacctctcaaatgcagcttgcacttgagcaaacctgccagattcagtaatacacacaaatgtacaaatacgtttgtttattgattgattgccttcttcccaattcttcccccattttcctgggtatttccttcacttctcctgtgtttgatcttctcatgtcttctttcatggtttcctccctcatttgggtggagcacatcctggagtagcttcctaagaaaggatgcatggaagatatagtttctgtggcttgattatttgataaattggtatgcatagtatgctaggttgaaaatcatttctgctcataatttggggcggtgggggtgcagtttcccactgacttctaggttcagtgttgctcttgagaagcccatgctgttctgattctcagtccttcatttgtgatctgtttttatgtttctctggaagcatttagggtctttgtcatttgagttctgaatttcatgccactgtatcttggttgggtgtctctcccctcattgtgtggtatctgtgagccctccagtctggacgctcacacccttccattccaggagactttcctgtttaaatctttgcccattttccttccctgctttctagaactcctgctgtttagagttcgggtgttctggatgagtcctttaattttcttactgttttgcctacctacctctttttttgatctagtttctgaaagattttcttgatttttatcttccagcttatttaccaaaatatttcttttagctattatacttttaatttccagaagctctttatccctggtctttcctttttaattgcattttattctcattttgtattttatctctgaggatttaaattctggtccctcgatgtcttctcccacctgctgcattttctgattccccctcttttttcccacttatttgtaagttttggtcttttttgtccctgccaaggcttctccttgtgtctgaggaccgttgactgttcatatattaaagtgaggtacgaaaaagctgagtggaaacttgtgtgtgtggcagccttcgcttctggctacagtctgttttttcagaggaattttccacctctctcctggataaagtaatcctccctgtttgggtggggtagcaagcagggtttttggttcagaatgagcactttcccagtgcctgctgaagcattggcgaaaagacgaaaaaaagagcacttccctggcagtcctcccccaccctcctctgcctggtgggcttgtctgattgttggcctagaaacttttcttcctgggttctgcagaaggagagaaaactctcttcctttcattcattatttatatttctcagcaatctggctttttatcctttttcttggtttgtcctaactttaagagatggagtcttgctctgccacccaggctggagtgcagtggcacgatcaccgcagcctcaatctcctgggctccagcccctcctgggctgaagcagctggactacaggtgtgcaccactaaacacactaatttcaacaaaattttggctgggtgcagcgactcacgcctctaatcccagcactttgggaggccaagacgggtggatcacttgaggtcaggaattcgacaccagcctagccaacatggtgaaactttgtctctattaaaaacacaaaaattagccgggcatggaggtgtgcacttgtaatcccagctactccagaggctgaaacagcagaattgcttgaacctgggaggtggaagttgcagtgagctgagatcatgccactgcactccagcctgcacgacagagctggactctgtctcaaaaaaaaaaaaaaaattttggtagagacagggtcttgctgtgttgcccaggctggtctggaactctggggctcaagcagtccttctgcctcagcctcccaaagggctgggattataggtgtgagcctccacgcttctcctgtccttttacttcattatttatatagttaatcacctcgctagagactgagaattctgtgtcctcaggctgccatcacaaaataccacagacagcatggcttaaaccacagtttatttccttgcagttctaaggctggaaggtcagggtcaaggtgctgggagagttgattgttctttgttttcgtgggcttgtccctctgtatgcctctgagtcccttcatagaaagacaccaggcctattggatgaggacccccagtgccttcatttttaactcagccacctctttaaagaccttatctatctccaaacaaggtgacattctaaggtggtagaggatgccgggggtgggggtgggtaggactgcagcatatgcattttggagaaacgcaattaagcccatagtgaattccggcagacataactattcagaactccactaagattaaccaaaaaaaaaaatttatatatatatatattaaatgatgggcggggcgcggtggctcacacctgtaattccagtgctttgggaggccgaggcaggcggagtacctgagggcagtttgagaccagcctggccaacatggtgaaaccctgtctctagtaaaaatacaaagattagctgggtgtggtggcgggcgcctgtagtaccagctactcgggagtctgaggcaggagaatcgcttaaacctgggaggcggaggttgcagggagccaagatcacacactgcactccagcctgggcgacagaatgagactccattgcgaaaaataaaaaaaatctggtgttggtagtaacgatgtaggggacatggtctctcttatagtcttttctgagggtaatttctgaaaaaccataaccccaaacccttgcttttgaccaagcaatttcattctaggaatttatcctaaggataaattttaatgtcatatgaagattagctgtgaaaacggaggagcgacccgaataccttgcggcataggattagcttgtaatttatgtgcttgtgaaacggccgtgcaatgaatggggctccgtgcagccggggacaaagtgggtgcagagaggcaggagggacaggcacggggcatgggggccacccgtggagaaagccctggagctttgtgaatgccgtctgttggccagcgcagggctctcactgtcacgttggacctgtgcccagggtctggtccctgatctgtgagggtcccagagggggcacaacaggcgaagaccccaaagacaggggtctgttccggggcatcctgggcagagagtgggtataggggacagaaacccagccaaagcggctcaagtggaagatgggtgctggtcgatatgggccagcctgaggggtgtcagagccgggaatggggaggccatcggaagcccacaggagccacttctgagttccctcagggtggaggcctggccgccttcccagtggtgcctgtttcttcctttctctgcgggttggcttctctgcgtccctgcctccaggtgggaaggggtccctgcaggcttcgtctcctcccagccgcagagccaccaccttgggctcccctgccccaggcccaggctggtggatctaattgggatttggtaagctgtgacgggaggggggctctggcccgtgcccacccatgggaaacgggccctataggaggcaggtgaggcgggccagagtgaatcagtggtccagtccagaacggaggctgtgacccgccagggtgggagaggacgggctttggggttgggcctcagccccgagtgggcaggcacagcatgggactggctgagagacgctctgtgtgggcttcggatcagctcagcgtaggtttcagtcccgctctagctgggtgacactggggttattttacctgtctctgcctcagtttccttctttaagtggacacagtaagagtgctgagctcccggggtagtgtgtggatgaaaggtgacctccgcctgcatggagccatggaaatgtttccccttttccctccactggactctgggacagtagtgggagcctgggtgggggcttttgcctgccagaactcatgggtcggggccgcacatgagtgagtgtctcctgggcagggctgtggccatgagctcaggtctttagtgggctccttgctcctcccagcaaagcgttcaccttgccccaccctgggacctctcaggtgctctttggaggtgttgacctggggcatctgtccatggccctgaggaggtggagcacctggtgagggctgcgctctctccagctgggaccccgggctccgaaactaaagttttgggaagagtgtcagctgacgggtggggcttcagaggaggaaaagaaacaagggtgtgagatgtgcaggccctggtgagagacaggcagcagcaagagcctgccagccatacttacccacaaggccggctgaggggctgtgctggcccagggctctggctttcggacccagacaatgctgctgaccaagcaggccaggcgctgagtgactgtcccagcggatctccgagcagggtcccttgagcattaggaatgcagcttctcaggccatgccagcctggcagaacaggaagggaggggtacagccctgtggggacgcagctgtggctcgagtgacacctgctggcggcctcatctcatccgctctctgcgagtctgtggtggttctagtcggcgtttcacgggcaaggtttagggggtttgttcctcagctggggtccacccacgtcttccgacttcctctctcagtgtttgggccatcggtgggtgaggtggctgcagcagagccgggggctcctgtgtgcggaggcagcaccgacatccactgcagccacaccctcctgagagggtctggaaggaagcagggcaccctgcgaacccaccttcctctggggtgtcttccggggccccagggccagggcaactggagcagacaggacattatctagctctgggggccgtgctgaccgagccagaccctcgcggcggcccacagagatgggcagcttgcggggcagctttgtccccccgacactgggtcctgtcttcatgcacacaagccgcctgttctgcaggtgaccagttaggttcgatgggacaggctttgggaatcagcggcttgggtttgccccccacagccttggatcttgaccttgggagaggcctccaccacgtgccctggggtggggtgggggcgggggcgtcctgcatctgcgccgttcagctcagttgccctcagccgcggttggccgccaagcactagggtgttgctggcacagccaaggaactgagcccagactttttgtttacttaatcaagcataaatgcaaagggctgggggtggccgagctgatggtgcaggcgtgtgcgctcaatagctccgtcacagtggctgtcgctttattgagcaaccgagggagcgagggagaggagcaactgcggcgagcgtggaggcccagcccgcagagctcccgtctgggggaagccctgtccctcactgcctgttcccggcgctttggtgccctctgctgtggggtgatgaggtcaggctacgcaggcagtcacggcagaactgaaggccgtgtgctttcgtgtagccaaaccccttttcttactgatatcagttataaaatcagagctatgttcccaccaggggcaaaaatccaacaccgtgcagttgcaaacacggggcaggaaagactccggcgaccctcattacactgtgccgggaggcatggccagagctccgtcagttcatgcgtcgcttaaacctagaggtgggtgcgattgtcaccctatcttacaggtgtggaaactaactcagctccgagatgtgactgaccttccccggccatagtacgcgcagcgcagtggggcctggacgcggctgcctggtttcaggtccacacgctccccagcactgccggccaggctccagcatgacgggggtcaggcctccacaaggccctgtcggccacgggagtttgctgcgagatcctgggtccctgactgtgttctcaaagcccctaggatttgaccagccgttcttttatcttaggagtcggaaatcttacatctgtatttttatttcgctgtgcttccgccccctgctctgctaccctcacctcactacgttgttttattggcatagtataaaattcacattttacaatatgcaattcagtggcactagcacattcacggggttctgatcatcagctctatcaggttgcaggccactttcatcaccccaaaaccccagccctgtgagcagccattcctgctcctccccggccatcatccgtctgtctctggatttacctgttcatgttatgggggagagagagagagagagagagtgtgtgtgtttgtgtgtgtgtgtgtgtgtgttttaaatgaaggcttgtggtacggggtctgttctcattttgcgccggtgttgggcctgaagtgtgtcctgtgtgcatgtctctgacccccggagtcatgggacccagtcacgtgctgcgctgacgtggagtccgaagttgtaaagacaaagctgggtgagaccctagtgactcacaggcccttctgctctcctttccagatctgggactttctcggggacaaccctgggataacagccaccactggagtctatgcttgaaggccattccgcctcgtggtgccctgggcgaatgtcgagggaaagcagactccctgtgcccccggggttggcttcttgctcaaggattccagatgctggcctcctgggtggtgttcccatgccgagctccagttgggggtgtgaccagcaccccgtgcgggggctgctggtgttctgtgttgtcagagcagtgctgttttgtgtttttctttaaaaaaaaaatttttttttgagatggggtttcactcttgttgcccagactggagtgcagtggcacaatcttggctcactgcagcagcctctgcctcctgggttcaagcaattctcctgcctctgcctccccagtagctgggactacaggtgcccgccaccatgccctgctaatttttatagttttagtgaagatgaggtttcaccatattggccaggctggtctcgaactcctgacctcaggtgatctacctgcctggcctcccaaagtgctgagattataggcatgagccaccacacccggcctccttttaaaattttaatttttaatgagatggggtctcactatgttgcccaggctggctttgaactcctggcctcaaatgattctcctgtctcagctgtgttttgtgtttgctccagccctttgctggtgaacagacacgttcactggacacctaagtgcctggaccgtggagcacagggtgggggtgctgttcatggccggaacgccagaggctactggggagacacaggagcgaccaccatgatccacagaccaggactgtacagagcacttgaaggggcggcctcaagaattgtgccggaacagtgaacatgagggctcctggctcccctctgaggacaagggttaggtaggaggggacaggggcagggctgaggtgggtcggcttggttcatggcagggcttggggagtgaggagagtgaggagtaccgggacccggggtccctgctctgctcacctgctgagaatgagccagtgttggcctctggtctccatgtctgtagagaggcttctctgcttcccctcctgtagaatgggaacgacaacatccagccatagagtgctgagaattcagggacaggacacagcgaaggtgccccagtcccccttcctgaccccagcctggcgtcaccctctatccaagggaagaagcagggatctgcctacgaatctctcaggatgtgaagtgtggcccccagcctggtgcctttgcagtgggcccaggacggagggtagccttggcacctggggaggacaggtgaacctggatccagactctgcctcaggtgacagccctgggttctaacgctgccgcttccgcttcctggctgtgtgttcctagggcggccacagcccctctccagcctcagttgcctcacctgggaagagaggtgcagggcttttgcgatgatcataatagttaccatcaatcgagcattagcgactttccagcaccttaaggcagttaccctgtgatctgcacagccgccctcccctcgttgcagatgaggagactgagtcagagagaggttaacccagacattcccaaggttgtagattgagaaagtgttgagttgggattcgaactcaagtctgtctgaggcctcctagccccttcctgaccccagagccttccgcacctcatggctccaccagaccctgcatgaagctcctggtgggcaaactgggcaccttcactttaaacgttgagggaaaaatacacataacctacagtgtcccgtctcagtcatcttcacgtgtgccgttctgtggcattaagcacattcacgctgttcaaccgtcaccagaacttttccatctccagaactttctcatcttcccaaaccgaaactctgtcccactaaatgctcactgcctgtcctccctcctgtcctccctcctggcctccctcctggcctcccgcctgtcctcccgcctgtcctccctcctgtcctccctcctggcccctcgcaccctccgttctactttctgtgtctatgagtctgatgactccagggaccccaggagagtagaatcccacaggatttgtcccttccagcctggcttattccactgcatgacggcctcaaggctcatccaggaagcagcaggtgcccggctttccttcctttttaaggctgaggaatattccactgcatggggggaccacgtcattttatccccgatgccttcacttttcagctcttgttcccatctgtatctgtaagctggagcatcccttgatggaggagggatctcagggagtgggtgagcctctcctctttccagggtcatcctccactttgcgggggcagcccaccttcctggagttccagctgagggggggcccaatttaacaagcactttgggaggttgaggtgggcggatcatgaggtccagagattgagaccatcctggccaacatggtgaaaccctgtctctactaaaaacagaaaaaaattagctgggtgtggtggtgcatgcctgtagtcccagctactcaggaggctgaggcaggagaatcgattgaacctgggaggcaaaggttacagtgagctgagatcgcgctactgcactctagcctggcgacagagcaagactccatctcaaaaaaaaaagggttgtccggttacctgtgcatgccaggtaatcgacaaatgctttttatttttatttatgtatttgtttagagacagagtcttgctctgtcgcccaggctggagtgcagtggcatgatctgtgctcactgtaacctccacctcccaggttcaagtgatcctcctgcctcagcctcttgagtacctgggattacaggcacccatcaccatgcctagctagtttttttgtatttttagtagagacaggatttcactatgttggccagcgtggtctctaactcctgacttcaggtgatctgctcgcctcggcctcccaaagtgctgggattacaagcatgagccaccccacccagccaacaaacgctttttaaatataagtatgtcccatgcagcgtgtcccctaaagaacgatgtgttgttcatctgaaactcagatgttaccaggcgtcctgtgtttgatgtgacaaccctgtccacagccctggcacggaaggggcagtcgctgagggtgcagtcttggggtgagggtccctgtgatggcagcctgtgtccagcttggactggccatgggaaggccactgtgtgggcgggtctggccttggtaaagggccaccccctgagacccaccgagcctagttccagtttcctcctcacaaccccagcctggaagggcgttcgggtgtggagcaagccacagggtttccccccagtgtggttcgcattggggtgccgggtggttccgagtcagctgccccctctgcctcctccccgtgcccatcacaactgcccccagtgctgggacctctgggcaagaggctgaggctgacactctggaaaggtgtgcagtggtgttgtggggtccctggggtccggtccacatacatccctgcttgcccggctcttggcatcctgtaggagaaggtgccacagcctagtgggtgggagggcaggagccccatcactggagtcggaggttgcttttgatgttgatggcagtgaggttgcttctgatgttgatggcagtgaggttgtttccgacgttgatggcagtggacttgcctccaggttagctgcctccccaagcagctttgggggtacagaatgaccgaccagtgtgggatcccaaacatcctatccccttgcctgaaagtgggacgaggctgaagctgacctctcgctgagaccacctcattcggccccgtcctctgctgccacgtccttcttcctggtaccccccttctccagccccaaataagtcacgttcacaggatccccagctcaggctctgctcctggagaagctgccctcagaggctgcgttgccgattcctttttcaacggagaggctgcagcgtgtggcaggtgccaccatctcttggagtgaggcagcctcaggggctctgtccggggctgcagcctgattggtgatctttgcacgccccttctctgccctggctgggccatatgccacatggggcgtgaggggcctgcaacacaagtccctctgggggctcgtgatgtggttgagctggaagatacattctggaacatctaagaccccagccactgtcctgagtctggatgccgcgggtgccgggcatgggggctctgggcccgggccctggggtgcttggaggtgctgtggaggaggggtggggctggcttggagcccatgggattcgattggagggtgggagtgtgagagaggagagagcgtgaacagagccttggacagaaaagcctggaaggatcaggaccctttggggggtggcgggtgaaggtggcggggtgtggggataccctggggacggacaggtcacttgaggctacaggactttgaattccacacttagtttggatcccaccctctggtgtggggcgtgtgagtggagggggcctggctagggaaagggggggggcagtggggagtggagggctgcttcgctccgagagatggcggcacctgccacccgctgcagcctctccgtttaaaaagtgactggcagaacaggagcagctgctgccagctcctgtccattttgtcctctgaaaagagaggtcggggtggccaggtcctcatttttcaggagacagaagagagctgaatttttatgtcaaatctcttggttttgagttgttagcaggtaattccaatgttttatgaaaacagcggtgggacgaataaaacctacgtatcagtaagtctcggcctccaggcctctggtctgcagcctgtgccaccgtgagttggaagagtggtggacggactctgttctccccgcaaaagccctttccagggtggcacatccacgccgttagtgcccggctgcagggagaagctcaaatgacaaatgaggcttgaggtttgccgcgttgggcgtcgtgctgaggcccagccgtcctcacggtgacctttggcatgaggagtcctggttccactctacagacgaggacactgagggccagcggggcccagaaacttccctgagtcacagctcacagagcaagacatgggcccaggtctgctgaccgggtttcctttttattttattgtggtaagagaaatacagaatgtaccacgttagctacttttaagtatacaattcagtggtattaattaccttcacggtgttaggtagctgtcatcactgtttacctccaaggctttcccatcatcctactgcaaaactctgtccctattcaacactgaccccacaaccctccccagcccctgcacccaccgcgctttctgcatctctgagcgtgactactctaaggaccccgtgtacatggaatcatccgatatgtggccttttgtgcccagctcagttcactctgtgtaatgtcttcagcgttcatccacattgcagcctgtgtgagaatgttctaccttttcaaggctgaatgatgttccatcgtatggacggaccgcatggcgtctgtccatttaccaggtgatggacttgtgggttgcctttccctttccagccatggaaacagtgctgctgagaacccaggtgcacaggcagctgctgcagtccccaccctcccttcttctggggatatcaggtctgctgattttatgtctgaaggtcatgggccactgtcccttccctatgcccttgaatctcttccatggtgtgtccactgtgtggtcttcctggatacctccagcaatggggagctcactgtctcccagagcagcccattcagggcttagtgtgtagcccacacctgtgtccctgtagctgccactcattagcctcctaacccaggacgcgtttccttgtgcccttggcaggggctccgtattcactctgggttctgtggtcctcactctgcaccacagactctgatgcctcccttctccctccccgatttccaagagagaacaagatctagccatgagaagcaggatggaggtgtcttcaaaaacagccactggtgatagaagttgtaggaaggtaccatggtctgtctgcctccacgcaaacctcaccaggtttcatcaagatagcacaccaggagtggtgtggctcatgactgtaatcacagcacttctggaggctgaggcaggatcacttgagcccatgagttagaaaccagcctggccaacataatgagactgccatctctacaaataatttacaaagtagtggagcatggtggtgcacgcctgtagtcccagctgcgcaggaggctgaggcaggaggatcgcctgagcccaggggttcctggctgtcgtgagctgtgatggtctcactgcactccagcctgggcaacacagcgagaacctgtctcaaaaaacacaaaacaacaggaagctcagacaggactgtggctgcttcaaccctgtccgtggccaggctgtgccccctcctctgtcgctgggcactcacccctctctcattttctccccagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggtaggagggcgagggggcggggggcccttcttggtgcccagaaggtgtttgtgagcccagtctgttcagtcctgctgtcgctcaaggccttgggctaggcccagtttgaggcctacactggtgtttctcaaactatgcccccatggaaccctagggttccctggaggttctcagaggtgactgtggtcaggattggtgcagaggaatggttgatttgtgggggtgtagaggcctacagcctccttaaactgagcagtgtctctttgttctatatgctgatgtttagtgtaaaatattggtgaataaagaaggtggtctgttccgttagtacaatgcattggagtgctgctgtgctagctagtaggggtgacaccaccaggtgggggtggcaggtccagcactgcagggctgtgggaggtggctaggagctgcctcagctacccagacctgcgatctagattcttccgggaccctgggagatggcagcagttgggaggccaattccgagtgcctggcaaggggctcatgcaggcctggtgctttgggggcagccgctgttctgaatcggctgcatgacttacggaatttggggtccagtggggcctctaggccctaaggaatgggtccagaggtgactgtgggtgggatcgacgtggcttttgggtacctttaggggtgggtgcaggatggggcctttagggctggaggaaggtgcccagggtctggctcctgtggaggtgagtgtgtgagccaggggctggtccccgccaagctgtggctggcaggagccacctgctgcaggttggaggaagttcccctgtggaaagccacgggccccacaggtaggcatttgggttctaaagtaactgaggttactaaagggctttgtcaagacttgggaaggcatttcagaaaacccagagcctttgctttccaccggcatttgctttcctgggccagacgagggcccttggggtagcccggagagtcttggggcagggatctgggagctgcgggggagtccatgggctgcccaggcaggaggcttcccagggcacgttcccctgcgtctttctggatggctttgtgttctcagccaggggcagacctggagttcctccaggaaagctcccagcctgggtgcggctcagcccttcccgacctgtcgctaattaaagttcagcccatttggttctgattttcagtgacctttgatctatagtgaaaaacaaaaatggtggctgcggtttgttggcagaatatgttgctcgcgacttctattgttttagagggaatcaagatcgattccaagaagctgaaagaaacatggaattactacctgacaccgaggtccaaactcgctgtttgcccctccctgctccctcagaaatgttcaggcagggaaataaacagcagcccacgtgtgactactcatctggggttttaagaacaaattagaatcagtagttattttttccatcataaatgtaatacttgttccacaggaaaataaataacactgagaagggagaaagcagcattagctctggtctgatggatcggccgagcgctctccttggcattttggtgaatttctttcctctgtgttttgtttttcgaccctttctattttgtatagttgcttttttgaccctagtggacaagaagcagttttgggggctgggggacagcggcgtcacggaattgaggaagctcgtggcagcttccgtgtgacctgcagattggttcatgagttcattggttcatgagttctcagcagctcgaggacttagtggacagtgccctgcaggactgagcttatttcacagccttggcactgggtggatgtctgtaggactggggggacctgcgacctgagatagttttcagacgaattcccctagacattaagagaagcgggttcccattaaggagcccaggtggcatggacagggctgggggcagcacaggtgaggagctgctccaaggcaggttgtcagcctctctggacctcaacttctaatctctgaaggcctgtgaagcttaggtggtaacagctcccttcctggggcatccaacctcttcctggggttttggggggcccaggggctctgtggagcattgctgggggagatgcctacgtataagtgggcatcatgctggggtgaaagcccaggggctgggccgggagggcgagacctgagacccatgcaaaggagccggggccagggtggggtgggcacggctcctactgagtccccagcccttgggacgctggccagccagccttggcatggccagcatccctgtgtctcctggggaggcattttacttaatggacagaaggacagacagacgggtggagggagtgagagggaaaggatgggtttgcaggctggtgcagctgtgaaactgacggagcccaccccctgccaaccccccgacagcctttgaggcccagcagcccatgctccctggcaggttgcggcttgccttctgcactggcggagtccgagctgactccgtcccttcgcccgagcgggcgtcgcggggagggaggtggttcctgcttccgcatgcgcacaactggggtcttggatcgtagctcctttgtgagaaagggactggctcacccgccatgtcctgctgtccacacacacggctctgcacaccactcacggcctcctcaccgctgtgcacagccagcacgtccatgcgcacctgtggagccagggtgtacggctgcacaggtgcgcctaggtggaggtctccaggtcactggaacttaaagtgtccaagagaggaggtgtcaggcctcaaaggggcactaggaactggcgtctcacccttgcctctgagacccgcagacccacatccagcctgggctgtcgtggctgagtgccccaggccggtcgcctcccctctctgggctgggttccctgctgaaggggggcggggctccctgctccctgtagtggcctcggcgtggggccgggcctgtggttgcaccatctccattggtgtcatcctcccccagccctgctgtgacaggcatgggaggcaggtgtgtttgtgagctcactggtgcgacccttggaggtgggaggctacacagtatttttggtcatcagaggatggaggatgagcctgcattctgggctgcagggcctggagctgtgctttctcaatggacttagaatttggggaaaaaaaaaaggaaaaaaaggagggaagagagtctgccgccctggagagtgaagctgatgaatggctggctcaggcgcccacagccccagggccaaccctccactggagcatgagagcggccgcaccacgtgggctgaggagtgactggccccgggcgggctcctgccactatcacagtcgagagatgcgagggagttgtagggcagctggcactgtcctcacccgccccggccggcagggcttgtcaggccgcgtgaagtgagaaacggtttgcggtgtcctccgcggagtgccgggcccttccccggagagcagctctgcagggaagggaagtgggttttcctggaaaacggggcgggaggtgtggagctcggagagactgaggtcctgcactgctaaggggactggccccggccctgggctgggagagggggagctgggactcagcccagggtggagtcaccatgggttctaaggcacaggatggataccctcctcggccatgtgacatcattgtttgggatgcgcccagtgttcggagccttcgaggctctccaggtgcctggagggcttgtagaaatggtggtcaggccccacgccccagactttgtctcatcatgtctaggtgggggccccagcacctgcatgctgacctggtccccaggacgcagatgctgctggcctgagcgtccccggctgtctcctgtctggtgtgggtgctgccgccgggaggccttggccccacggggagatgaggcatcacacacgcagccacaacacgggtcggaggcagagtccagcccagcaagggtgtggcagtggagacgagggaggggtgaagctggtggttccaggaggttccgtctgggtgagaccctctgctgcagagaggggcgggagccagtggccccgcggagctgaggtcatgtgagaaggggctgcagtctcttctgtgtcattctcctgtggggtcagcctcaccccagtgggaactcccactagtgaaagtctgagatggccccatcctgccgtgtcgcctagcagtgcaccacagggcattcggcccctcctgccttcacacactcaagacgttttcatgactcatctcctgccaggagggcacacacagggcacctttgcacggcgctgcctgtcctgaatgcctcgctgtccccgggtggacataggaattcatcacagtcctcctcgaagcccgggttgctctagaagatgaaactcaattgctgtccttgatctgctgctcactagaggccctgggttgggaatcggaatgtaaatgtgtcacccatcctagagaagaaagtcctgcagtgtgacatggcttcattttcaacagctgagaccctctgccacaacaactctcacagccccctcatccccacccgccgtggaaaccaaataaaagcagaaagctctggtggaagccgagctgggggcgatggggcagattgtagcccgtttctccttcccgtccccctccccactttggcccctgggacctgctcagaaccccagggtgaaggagacatctcaagtgtgacccattggctgcttctgctgcgggagagggagagacggggtggcccatgtgaaagctatgcctcctgcagccccgcaaagcctgcaaaagctcagccaggatttgatgggattgtttctgctgggaccccctctctgctgcgtctcgtgcaaacgttgctgtgaagggatgccaaggggttttgcaaagcagaaacccaagctgagaggaggagaagggattgttctgggggcaggcccaccttgattcagggggtttcgcttcattgtgctttgcagacgctgtgtttttacacattggaggtttgtggcacccgtgcatggggcaagcctcttggtgccgttttcccaacagcacgtgctcacatcgtgtgtccgtgccacactttggtaattctcacggtatttcaagctttttcatgattatatctgttcatggtgatctgtgatcagtggtctttgaggttactagtgtggttattttgggatgccacacatcgcacccatataagacagtgaacttaataaatgctctgtgttctgaccaatcctccaaccagccgctcccccatccctctctctcctctggtctccctattccctgagacacaacagtattaaaattaggccagttaataacactccaatggtctctaagtgttcatgtgaaagaagagtctcacatctctcactttaaatcaaaagctggaaatgataaagcgtagagaggaaggtgtgtcaaaagccgagacaggcctcatgcaccaggcagcctagttttgaatgtaaaggaaaagtaattgaagaaaattaaagtgttactccagtgaatacatgaatgataagggagtgaaacaatgttattgctgatatggagaaaattttagggtctgaagagaagatcaaactaaccacaagcctgatccagagcaaggctcaactctaatgctgtgaaggctgagagaggtgaggaagctgcagaagagctggaaacgagcagaggctggttcatcaggtttaaggaaagaagccgcttccagaacataaagtgcaaggtgagggagcaggttacccagaagatctggctaagattgttgatgaaggtggctacactaaacagattttcagtgtcgatggaacagctttctattggaaggagattccatctaggactttcatgctaggaagaagctaatggctggatttgaaggacaggctgactctcttgttaggggccagcacagctggaaatgttaacttgaagccagtgttcattgaacattccaaaaatcctagggcccataagaattgtgtaaaatccactctgtgctctagaaatggaacaacaaagacctggatggctgcacggcttacagcatggtttccagaatagttttaagcccagtgttgtgatctactgctcagaaaaagattccttttaaaatattactactcaccccggagcgcccatggagatgtacaggaagatgaatgttgtttgcgtgcctgctaacataacatccagcatgcagctgtggatcaaggactaattttgactttgaggtcttattatttaagaaatacatttagtaaggctgccatagatagtgatttctctgatggatctgggcaaagtccattgaaaaccttctggaaaggattcaccattctagatcccattaagaacattcgtgattcaaggttggaggtcaaaacatccacattaacaagaatttagaagaagttgattccagccctcatggacggctttaggggctcaagacttcagtggaggaaggactgcagatgtggtggaaatagcaagagaactggaattagaagcggagcctgccgatgggactgcattgctgcaagctcacgaccacactcgaaagactgaggagttgctgcttaggggtgaaacgagaaaatggtttcttgcgatggaatctactcctggcgaagatgctgcagacattgttgaagtgacagcaaagatttagaatgttccttcaatttagttgataaaacagcagcagagtttgaggggattgactccagtttccaatgaagctctaccgtgagtcaaatgctatcaaatagcatcacatgctacagagaaatcttttgtgaaaggaagagttcattgatgcagccaacattgttgtcgttttttttttgttttgttttgagatggagtctcgctctgttgcccaggctggagtgcagtggcacgatcttggctcactgcaagctccgcctcccaggttcacgccattctcctgcctcagcctcccaagtagctgggactacaggcgcccaccaccgtgcccagctaatttttttgtatttttagtagagatggggtttcaccgtattagctaggatggtctcgatctcctgacctcgagatccgcccacctcggcctcccaaaatgctgggattacaggcgtgagccaccgcgcccagcctgttagaagttgccgcctcagccttcggcactcaccacgctgatcacccacagccaagccaagatcctccattgaaggctcagattattgttcacattttttagcaacaaagtattttaaaattaagatttgcaattttttaagatataatgctatagcacgcttaatagactacaatatagtagaaacataacttttttctttttcgtgacagggtcttactctgccgtccaggccggagcgcagtggtgccatcacgactcactgcaaccttcacgtcccgggctcaagtgatcctcctgcttccgccttccgagtagcgtgtggggagggtgcacgcagctgggctaggatggcctggctggggtcagcccccgtctgtcctggaggccaggcaggtgcggagcttacggaggtggccacctagatgatggtgcctactctcgtgagttgaggcccttggatctctggcagtcagcaggactgtggtggcagccggtgtgctggttgtcagctgatgtccctgtctgtgatttttccgtgtgaatgcagccttgactgggcatgtagatcagaggtgacaagtcctgggcacctctgccactcttcttcctgccctgcacccactacagacacagctaattggtggctgcgttgagaatcttgtcaccaggcaggctcttctgtcggctcaggactgtcctgcgggcatagcaggaagtgaactgcagggggaagttggggcctggttgctgaggagggcagtgcgtggtctccaagccagtcagtgcctgcgggggggactagaattctcacccaggcctctgctctcagtcctgttcctcctctcacattcttcacacccaggctgggctcagggatccttgttgatgatggccttgaaatgtcctctgaacagtgtggctctgggggtgtgtaaaacccagggtgatgcctgctctgaaaggggcttccagatccctttgtgtctccagcacctgccgtgtgcctgccccaagctggggtctgtgagctgtgccttggggcccctgcctgtccccgctctgctctctgctgtggcttgctggctgcagggttctccagtgagtgagggatccctgctggccatgcctggagctgagggtggagggaggcccagcaggaagccccacaggtaggccccagtgagggtgcattatctacaggaaagttgcctgggacactctagtgggccgtctaggaaatgcagcctttaaggacctgaaatggagggggatatttttagtttttaaaatttatttctcattaaaattataacacagcctcgtaaaaatattaaaacagcgagacagatgtgtcaggggttatgtatatgaaggaggtagcacagttctcatcacgggtgtgcttagtgtccccctaaagttcatgccagttaatgtgatcgtgactgtaattggaaatagggtcgttgcagatataattaagatgaggtccttctggagtcgagtgggactggtgtccttagaggagaagagacacggacacacagaatgccacgtgggacagaggcctgctgtctacacctgtgcagaggagacaacaaggagagtggggcatgacccctgcccacgacactcgcctccaggaaggcagccagctgcccatctttggtgcggtcatctctgcaggcaacagaatggcagagtggcagtctgatcactctactccattgtgtgagagtctccaggatgaagaccaggctccccagcaggacgtgcggccctcatggagttctggccttgttttcggctgttgcctggctgatattctgcacatctgcccaccgtcctctgggcggtccacgaatacattgtgccttcctctttgcatatgctggtccctctgctggcaatgcccttccttcttggtgagctccaatgcatccctcaagactcagttcagatgcgcctctctggactcatccccaactcccagacggggttggctgctcccttttttcagatcctgaaacacttacttgtccccctttatgtgggcatttatctgatagtagagtttttctgtactgttggaatggtgagttccctgaagctaggtcagcttccttctcagcattcagcaggcggtgggggaggagggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaaggagccctgggatgctcaggtcatccctgccaccagaatgtccccagagtcatgaccatcagcacctcagcctcgctgctttttccttggggtctgcaggggcaggacgcaaaccccacacgctcgctgcgcagtaagctgcaggggcttctccagcagcacctctgaggcctgcctaccacgtggagatgctgctcccgtgggctctgaccaccgctctgccctcttctcacaggaaccagcgaccactcggcccggcgtaaccacgcatgtccactggtcacctggtggccttcgacaagaacgtgtgataaatccctgccggagtgcggctccgggaaaacgctgtcaccgcaaaccagctcctctttgttgcagtcccccgggggcatggcccggcaagtttccttagccaggggccagtttgcctggggtcagtgggcagcgcctgggagtcgagtgtctcgagtggggctctgcttggtttctccttgaaggtctggcagggtcagaccctgcatcggcagtaaccgcggagatgggagagccgagtctgccgctgtgggcttcctgggccttcccgccacccccgccagggcccttgggctgcatattcgaggcgcgcagcctgccaggccctccggcctccctgcgtggccaccagggaaaatggcttcactttgctgagcctctgtctccctggttacaaaacaaataattttattttttgtgacagggtgttattttttgtgacagggtgttgttctgctctgtcccccgggctggagtgcagtggtacgatcatagcccactgcagcctcgatctcctgagctcaaacgatcctcccacctcagcctcctgagtagctgggaccgcagccgtgcaccaccacgcccagctaacatttttatgtcttgtagagatggggtctcactgtgttgaccaggctggtctccaactcctggcctcaaaaattctcctgcctcagcctcccaaagtgctgggattacaggcgtgagccactatgcctggccaataatgttctattttaatttcctgtattccctaaatagtcataaccgtttccaagggcgatattcagaacacgtaatgagtgcagtgcaggcaccagcccacgtctcggccccccgtgtggggaaccagtctggccatctcatggtccctgcgtctgctctgcccacctcgtaggaggctctggattgaatgaggttcgacagtgctgactgtgagcctggccctgagtccgctcaggggtctcacttgccactctgctgctgtcactgcgccgttccctttgcccacatgccctcctggtctctgcatagatgtcctgagtgggactgctgggagtggggcactgctgcgtggcagtggagcctcgatagtgggtctcttgggggattattggcaagctgcaccccttgaaagttaaccgatcggggtgcatggcgtgaacttcccttcctgagctggtcagcccagtgtatgctgtgagccaggagccctgagggcgtctctgcccgcctatctcagagcacactctgtgttgcaggtgccgtgacacctattttacagcccaggaaacagagtctttcatgctgttccttccagccgaaccctcagctggagtcactccagaagccgcaggcaggagagttcccacaaaggactggatgcacaccttcctgagacggggggtgggttaggattccagcaaaggaagctctaaacaccagagtggccagtccatggcatttgttgggggacttacagagggggcttcagcttcctgtgggaatggggagatgagccacgttctgccccggtatgtctgcaacgacgggatcagattacggagttcatatgagggtgaaggaactcggctcagggccgggcccagtttccaggcttgatcttgcagtgtttgggggcaacaccctgaataaatgaatcagtcagtgcctgggaacattcgaggccctggcttgggttcaagcctgcaggaaaaacgtgcagctggcgggtcaggggcagttaggacagaggacgaggaggaacgggggcccctacgtgccatgggcatgtgctcgtctctctcctggtgtccgcctttctcctctgccttgtggctcagcttggactgccataacaaaatacgatagagtgggtggcagaaatgcattttctccccgttctgaaaactggacagtccaaatgcatggtgcctgtggtgttccgacaggggatcactcctcgggctccttctcgctctgttcacggggctttccttggtgcatggagaggatctccctctcctcctcttcttataaggtcaccagtcccatcagattagggccccacccatatggcctcatttaaccttaattacctccttaaaggccctatctccacatataggcccttgtcatagcggaggcttcacataggaacctgagggggactcagcctggagcacctggtgtgttaggaggaggccaggccagcgctgagcaccctgcctgtgggtgagccctgcttctcaagcaacagtaataaataaaaaggaggaggccaaactgaccagacctaaaaaaacagtatcttaaggtctgacacctgccacggcatgaatgagccagagaaagtgatgctgagtgaaggaagcctgtcacaaaaggacaaatgtggcatgtgaaatctctagaacagggagattcatggggacagggagtggactgggttaccaggggctggggtgggaacaacggggagtggcttcttcatgggtgtagggtttctgttgagggcgacgacagtaccctgcaagtggaccggtgaccgatgcacagcgttgaatgtactgaatgccactgaactgtgaactttaaaactgttaaagtggcaagttttatgttatattaaaaaaatcatatatagaaaggatgttgtattaaacgagaaaaactcatttctctcaagtaccagtcactcattgtggagactgctcttgaggtcactgtgcccaggcctcttctgtcttgagccagtccatctctggggtgtgaccctagcttacccccatgaccacaggaagaccatgagctggtcctttaaggatgcaacctgggagttgccccgaggactgtgctcacattctgttggccaaaactcggttacgtgaccacacctagctgcaagggaggctgggaaatgtagtccttagtctgggggcatgtgcctggctgacaatggggcttcagtgctgtgggagaggaggagctggtggctgccaggggatggacagctgtctctaccaacctggcctcacagtggtcacgctccaggacataaatgtcccctctgcagcaaagacttcctgggtgtggaggggactgggggcccacaccctggtcttcacaagatggtctcctaccccggaaggcaccatgcggcccacgcttcagtgtgaagacaccacctgtgtgttaatgggcccaacaccaacctgggtgcagggcaggtattcagcaaacagtgaatggacaccagggagctggctactatagcgacctcctgaggtcgcagggctaccaaacagtgcacggcatttgcaccccagctcaggcgtcccggcagggattctgcattgtctgcctttgaaaaaagggtgggagagttaggacaggaattttctctgtttccctctctctctccttctccccgcttctccccctctctttttccctttctcttttcctccctctctgtccctccctctcttttcctctctatctccctatctgctttgctctctgtctctctgtcctatttttctccatcactctttgtccttgtctctttttctcgttctctgtcactccgtttctgcttttgttcccccttctctctctctccccaacccccctgtttctctatctcttcacctgtgaattcctgaaacagacccagggcatgatgtcgtggagggcaggccccagaggcgtccaggtgacaccgtgtgggcatttgtaaagcaggaggccccagcaggtggagcaggaggactcacccccctgcagtgggtggtcaagaagagctgcctttcctaagcccctctctcctccagccacccctcacctggggcctgctgagagggacaaggtggattggggcttgctgtggggctggtgctgaggcaggggtgggtggccccccagcccctatttcctcctctccaaacccagccatcccagttaattatttgcccagcagggcagcttgactggctggtgtcttgctgagcaataagcagctgaataagggtgcaattgctggaggcggggtcgcagctgcagacctgggcggtcacttagtctgggacagctgcggcggccacagcgaaagccatgcagcctgccccatgcctggctttgtcgcgacggctgctggaacagacgggtgtggtggctcatgcttgtaatctcagccctttgggaggccaaagcaggcggatcacttgaggtcaggagttagagaccagcctggccaacatggcaagatcccctctctactgaaaatacaaaaaaattcagccgggtatggtggcaggcacctgtaatcccagctactcaggaagctgaggcatgagaatcacttgaacccaggaggcggaggttgcactgagccaagatcaagccactgcactccagcctgggtgacagagtaagactgtctcaaaaaaaaaaaagaaaaaaaaaaagaaaactacacacacatacacacaacataaaatgtatgattttggccaggcacagtggctcacgcctataatcccagcactgggaggttgaggtgggtgaatcacttgaggtcaggagttctggaccagtctgggccaacatggtgaaattccatctctactaaaaatacaaaaattagtagtgtattagtgggtgtggtgacaggtgcctgtaatcccagttactcaggaggttgaggcaggagaattgcttgaacgcaggagacgaaggttgcagtaagccgagatagcaccactgcactccagcctgggcaacaaagcaagactccatttcaaaaaaaaaaaggatgatttttaaccatttttaagtgtaccgtaagtggcattaagcatgtggtgcaaccatgaccaccatctatctccagaactcctttcaccttgcagaaatgacaccctggacccttgaaacactaactccccctcccaggttccctcccccagcctggggattaggcatctagcagctgctgtctggagagggatagcatggccctgctccgtcccttctgggcccgttgagctctgctgtgaaggggattcctttccttgtccctgtcactcctagtgtggaggtcgggggtaccaagccccagccctgccacctggaaaccctgggaaagcagcgtcacctccctgtgcctcagtttcctcatctgtaaaggggagctgaggacaggacctgcctccgagcctggggagagacggcagtgcacagggactagctgtgcgtctcagtaatacggagagaactttgcaggccaatggcgtccctctgagaaagactctccctggattctgtttcagagagttgagcttttccccagagcagatgctttgaaactgtctcaggtggacagagggggctgcagggagggcacagaggacttcctgggagtgaggtttcctgggattgagtcccagccctgctgtagggctggagtgaaaggggcctccccagagagcctctcccagggctctgtccccaagtggccaagctaattcggttccgtgctccccttttgcccacccccaccagaggccacaggctggactgggcgccactgctcatgcttctgtcctgggatagcacagaccagtacaccagggtctggcacatgtccgttgtagtcactgcagccctcccagtctccccgttttgtagaggaagccacagctcggggcaaagccgcacctcgcagtggacaggtgagtctctgcctccccaccagctgcctcttccacagatggacccccaatcacactgtcatatcgcctgtctgagcctcactgtgctagtctgtaggagggggcacctcctcttgggccatccatataaggctggagacaaacagctccacccagttatgggagtcccatgccatccaggacacatccaagtggatctctcatagcctatcatggttcctccaagactcagttttctcatctgtccagtggaatgacaatggtacaggctgtgagaatcccttatctgaaatgactgggatcagaagtgtttcggatcttggctttaagttgtagaatatttgtatgcacataatgagatatcgtgaggatgggacccaagtctaaacacgaaatttataatacataagtttctggaggctccagggagaatgtgttccttgcctttcccagcttccagaggccgcctgcgttccttggctcgaggtccctcctccaccttcagagccagcggggcagcctctcctctcctctccgacctcctgcctccctcttacaaggacccttgtggttcggggtcatctgattatccacccagataatccagggtcatctctctctttcctgatccttaactcagtcatatctgcaaagtcccttttgccacataaggggacacattcacagacgggttctggggatcaaaacagggacatctttgagggctgtgtttctgctgaccacgctctcctctgggcctgccctttgcatctgcagatagcagtggactctctttagggggagcaaagcctcccgctctgagcatgggctggactttgggggtccaggactggggaggggtcgacattgtaggtcaccaccatgtgtgactgtccagggaggctgggggatgaaacagccgagggtctgactgggggagagccgagaacacaccccactttatccggaaggccagccatgtctgctcagagacgaagagtcacgggacagccctgtccaagagcaaagacccgtccaagagcagggtcagcacctcggagagttccccgcaggccgccacggggcggggagagaattcatggggcttcgacttagaaggggaacatacaatgctgtggttttcactgcctctgggtgcaactcagcatttccccaattacgaagccagggccttggcccccagcaggaagcctggggtatttcattgcctcacactcacgtcccatctgctgaggggcacgtacgccaccactactcctgagtggcagttgattttacgctcacagattcgtcctgttatttagtatgttaattcaggcggctatgcatggttgtctcacaaatttgatttttaaggaatttaacatttcaaaatacttggtttcccttgtaacccctcaccttttattttctgtacctacggtcatccctcaagagggatccgtaggcctcccctgcctgccctgggcacagggacatcccgaagcgccggtcccagagcctgggctctgctgctgtttctctgtgacttgaggcaagatatcctacgctgccgagatagcagcccctctgcctggggaggtgagtgtgaggaacccggtgtactctgtcgatgtttaagggtcagtgggcgccgaatgaatggtttctgtcagcagcacattctgcatctcccaaaaccaaaaccaaaaggacagccggattttcccctctgcctgacttcactaggctcgcgtctgattttttttttttagcaccgtcagcataagggcctgggtttattttgtggttgtttatagtggaattgggtgtagtgtcctgatttgttttccaggatgttcgttttggggtcaagggtctttggggtggatgaggcgggagaaccaggcttgagtgaggctctgccctcctttcctggccccctggtggcccctccagagtctgtcccggccatggaccccagtccccgctgagccatgcggagagtttgggagaagtgcatacctgccttgggggcttgactggcaggctgctttcctctggctcatcttgaagttaaaatgtagctcagaccctcctcagcccccacgcagggttgcaacctcttccgtctgtctccctgtgaaatccaccttccagggggcagcctgggacctgggatggccctccctacctgaaacctttcaggccttccactgcctgcagggaaaagcaccggctcctttcacggacttccagcaccccttcggggctgctgctgcctggttggtaagccctgagctcactaatctcagccgtcacatgctgttgggcaccagcctgtctctttggaccataaaaacgccatgttgggttggcaggataagtcggcaagttttgatccagggctacagatttcctggttgtattgtttcaaggttaatttctttctttttttttttgagatggagtcgcgccctgtcacccaggctggagtgcagtggcacaatctcggctcactgcaacttccgcctcccaggttcaagcaattctcctgcctcagcctcccaagtagttgggactacaggcctgtgccacgtgtccagctaatttttgtatctttagtagagacaaggcttcaccacgttggtcaggctggtctcaaactcctgacctcaagtgctccacctgccttggcctcccaaactactgggattataggcatgtgccactgtgcctggccaaggttaatttcttgatagagttggacagtcggttttgctacaaagcttgttttgaaaatgagagttggttccagcatgattgatatatcagggaacagtttcaagataacacaagtttcccgttttcctttgtgagatttcacccaccagaagcactgggtgaacacagccactgcccccagctggcctgatgcacctgtgttcacataggaacacataggatgcatacgcacctcacacagccccagccgccccagggaccccatcctcgtcagggcacaacttccccgtctccactgccccgtctctgccactctgcaccagctctccagcccacctccctcggtaaacttacagcgttttcaagcccaagtgccgtgttaatgtgtctctgaaccccttgacatgtgaagctgtgctgccgtttttattagggtttctgtctgttttgagtgccctttccctaaccccattccccaacaagccctgtggttttgactgtgcggttttgcatgcagtgatttctaggaatgcagacgtcgagttgtggtggaatcgactcttctgtgctcatgtgagggaatggccttgttttgaggaaatatgcgctgaagtactcaggggttaaaaatcatatggccagctgggcgcggtggctcacgcctgtaatcccagcactttgggaggccgaggcgggtggatcacgaggtcagcagattgatagcatcctggctaacacggtgaaacctcgtctctactaaaaatataaaaaattagctgggcgtggtggaaggcgcctgtagtcccagctacatgggaggctgaggcaggagaatggcgtgaacccgggaggcggagcttgcagtgagccgagattgcgccactgcacctccagcctgggcgacagaatgagactctgtctgaaaaaaaaaaaaaatcatatggcccgtcaggcgcggtggctcacgcagtttgggaggctgaggtgggtggatcacttgaggtcaggagttcgagaccagcctggccaacatggtgaaaccctgtctctactaaagatacaaaaattagccgggcgtggtggcatgcgcctgtaatcccagctactgaggagactgaggcaggagaattgcttgaacctgggaggcggaggttgcagtgagccgagatcgcgccattgcactccagcctgggcaacaagagtgaaactccgtcgcaaaaaatagtaataattcgtccgtctcctcggcgagtggaggctggggccagggtggaacaggagctccacggtgagccaccccggagtgaaggccactggccctccttatccttgctgcggtgtgggggtgtgggtgtatgacccacagctcacatgtggaaacatggaggccccggggcctgtgtgacttgcccagggtcccagctagcaggtggcagagcaagacctgtatgcagaggcccaaggaagcgtcatgaggacccaggtcaccagtgcatctccagggtgaacctggcccctgcccagcgcatttgcctgtcccctgaaaccgccaccacacaaaaccatgtgcatcttcagagcaggaggcgtctccaccatctgtttgctcccgtttgacaaatggtcggtgctccttgaacggataaacaggaaccatccggccctcttccttgccggagctcatccctttgactccagggagggaggtcatgagcaccacagtctttatgggggagatcactggcctgcccctgggcggagaagccaaactagaaccttctccccagggtgagctcacaggcttttcccatccgggacccctgagccgattggctgcccgggacctgctgttatatcgggggctcccattgcaaagcccctgcgtgggctggcttccccgggtttggtttctccccattgtgcagggtcttggggtagggtctgagccaggtcaccctggagaaccgacagcaccggcccagccccgctgtgacctgctgaccccggaccccgcactttgcttagtgctttaggtctgtaggagtaatctttggagaatcgtgattctgggacccgagctctgagggaacaacctcctctgagcctcccaaggccccccaacattgtggggtgagccccacctcacagatgctgagacaggcctagaggcgtggcgctcccagccccatgccccacatagctctaaggcctggcctcacttgcaggtgagggtcctaggaagctgggggtgggagcaggcctaggagaggcactcaacaaccacggctcagcatggtctagaactgccccctcttcctcccggctgccccgagtctggcttccgtcagacccagcctccttccccagcccatccctctccctctttgatgaggccgatggggcaaagacctttgcttcccagaatgttctgtccctggttggaacactggtccctgggacacagccctgtcctcagctttgaagtcagttcccatcgctgccccccaggtagctggctggcttctgccaacctcagcctggtcgcagctggcacctcctcaccaggtactaaaccagggtgtgcagaggcccgctcgatccatggggcagatcagcaaatggtagtgcaggatgccccatcatatgtgaatatcaggtaaataacaggtacttctttttttctcttttttttttttttgagacagagtttcgctcattgcccaggctggagtgcagcggcatggtcttggttcactgtagcctctgcctccctgatttaagcagttctcctgcctcaggctcccaagtatctgggattacaggcacctgccaccatgcccagctaatttttatatttttagtagagacagggtttcatcatgttggtcaggctggtctagaactcctgacctcaggtgatccgctcccctcgacctctcaaagtgcttatattacaggcatgagccaccgcgcctggcctatttttttttttttcccttggcaacagggtcttgctcttttgcccaggctggagtacagtggcgcagtcatggctcacttcagcctcaaattcctgggctcaagtgagcctctcaccttagcctcctaagcagctgcaactacaggtgtgcaccaccatgccttactaattttctttaaaatttttttgtagagataggggtctccctatgttggtcaggctggtctcaaactcctgggctcaagccagagaggggctggcctggtgctctgggttctccagaccccctcctgccttggtctcccacagtgctgggattacaggatgagccacggtgcatggccacctgatggataatgtctaatataagagaacccctaatttagctgtccctgtacccttgtgaggtgagcagtattgttgcctacattctatagatggggaaacagaggccacagaggcctagcagcctgcctcgtcaccgagtgggagcttggcagggctgggatctgaacccaggccgtcggctcctgggcctgtgtgccccctccatgaccatatcagcttcctacagcttccatgacaaagcaccacaaaaccggaggcttaaacacagaaacgcagtcccccagctccgggcagaagctcgagacgagggtgtggcagggccgtgccccctctgcagcctctggggagggtcccttccggcttctgggggctgccggcctccctggagtggccacgtcacttgttgctgctgtctccctcgtcacgtggcctctccttctctgtctcttagctccctctgccccgtcctgagcacagctgtgattgcattagggcccacctgtataaccgaggatgccctcttctcaagagccgtaccttgatctcatctgcagagatgcttttcccgacgtgaatggaatattctgaggattaggacgtggacctaccttgttaggggccaccattcagctgactgtctttgccaagcacaggcagtggagactgtgtcatgctctgatccgaacaatcgtccttctgtctgccgcccgacttccccagccctgttcagaaagacagaaggaactcctgccccaccctaagctgaagtcgggagcgtgaggaccctttatctggtctttgggggccaggtgggttcacgggcacaggacagcatgacaggcagggcctggcattgggacacctgggtcttagtcctcacctgtgacagcggggggtcttgggcaacgtcccacccctctctgggccttgaagatgaaggggttagatcctggcctcccggagcttcccctggtgtaggatcaacacactttttctgtcaaggactagagagtattttaggctttgctggccctgtagtctaagtcacatactcttctctgtctgtttttgtttgttttgttttgttttgttttgtttttgtttttcctacaacccctttaaaatgcaaaacccgttcctagctccaggccatggctgccattgggctgtgttgagcctgtggcgcgtgcacaggcccctgcccttggtggacactctgattccacctgcaaatcctgagcgcacaccggctctgaacaggctctgtggcttcagaaacttatcttctggcttcgtcgatctggctggtttgccctggggatcccgcatcctctgactaccgtgatgagcagagcgcagcgcccggctccgtgggccaacttttggtgtcttgccctgcctgagcctgttcctccttcctctccctgcccctccagccgctccgggtcctctgggaagctctggcctcttcaccagccctgcgcggctgctggatctggaggccggagccggcacatgcgtctgacagcagcgctgctgtctcttgtttttcgtggtccatgtttgggggttacatctgggcctgtcccttctctgtgtagcctgaaggcagttcccaggcttgtgtccctcacctctccgcagacgccctttccagatcctgttcaaatcctggccctactcacgggaacttgggtgagtcagttcccttcactgagccttcatgcctccctgttaaggagaagcttcactcggcatggcgtggcccgtcacactcatcctgcatctgttacaccaaatgcagtttcctcttctataaatgggagaaaatcacctgtccttgccaagggtccggtgggaattaaatgagctgagccagggcacgggtggagcttgctgagtgttaggtcgtgtgcctgctcttcttggcggagtctggccagatacctcatctggttccattgctgtcagtctctaaatggggcctttcctgcccagctcccagccctggtgctcacaccatcacaggccaaagaactggattccagacactgcctcctccactgtccccacagtgaaaatggggagggatgtccctgtggagccctaactgggacccagacagccctacccccagctcccaccccctccggctgtcccggaggccgtgctccgtggatctcctctccctcgcctccacgtgggctccaggtagctgcacacgcattacaaacatctcgttaatcttctcggaggtcctgcgaggcgaggcctgtggtagccctgcccttggagcactgagaattagtaaggaaatcgccgctgcatctcccggtggcacaggggcgtggaggcgtggcgggccttccctcttgcaccactttggatcctgggtcctcacagcagtgttctctgcaggggaggtgcaggcattggtctgctctagggccaggtggtctaaaaagtccctggtcagccccgagtcctgcaggaatctgcatgttagtgggatttggggttcaggatgcttgcctgctgggtaggatggggttgctgagtgaggctgaaatcccagatgggatgtctgggctcctccatgcctgacttgggaggggtgagaaaaggaaggagacttggccatctttaggctaaaagcctagtgctgtctcacaggagggaagagcaggtctctgcaacacacgcctggggttccgtcccctctggccacttgtctgtcaccttggacacgttgcctggcagcctctgagcctcagtgtgcttctgtgaattggggtgaccctagcacggtgctcacgacagaaagcatgggagtgcagacgtgggtcagtggcccgcggtgagagctccctgtctgccccatggtgagtttccacagcagtgagagaggcctggcgtgtggggtggaggccgggacagtgtgagggccgcctggtcagagcgggaggcaggaccccgtagggagatgaaagccaagctggacccaggcagaaaaagaggaacgaaggacaggaagtccaagagcagtcactgctgacgtgagtgcggcctgcaggcagccagtgtggatggactctcaggccctccgttgtgtgttaggggaccggaggagcagagaggttgcagcagccggccggcctctctcggtgagggccggactgcacatggggctcagaggccgtgggtgtgcctgcccgcctgtgtcagctccagccgtgggggcgggggtaatccgaggctgcgtcccgaggctgtgggagctctgccttcatccttccattcacaggtagggacacaggcgtggggattccacggtgcccttgaggcagctgtttcctagacccccaaggccctgacggagactcccccacccctcaggagcagagggtgaggcggggtctgcaccggccgatgtgggcaactgttgcaccctcggagcccagcagcgagggtgggggtctgtggggagtcagccgcagccaccagcattgctggaatgtgtcagaatggtggtgcctcctgcaaacaaccttagcctctgttcatcctgtcaccagggtcctgggagaagcaaacccacgtgtggcctctgcagggtgggtggggaggttctcccggccaggcctgactgacgcccctgctgctccctgtggtccagcctggacttgccaccgattattctatcaatggcactgcactgggcaccaggatccaagcagtggactgcgggacaggacctgtccctgtgagcggcctgtccctctccccaggcccagcctcctgttggttatccttccaagcccatgcctgggctgtgcgatccacctttcctccaggcactcttcaggcaaatctctggagcacccactgggtgccacacactgcggatgggacgcagggtaccgcacagccccggtcctcagggacccggcggggacagcactggtgaaaaaccacggaagtacattgatgtgtcacttcaacaggggcctacgcaggggcctgccctgtgccaggccctgtcgttggtttgtggggtgaagaccctgttcctatggtgtggacgtggtagagatccaggggctctggcagcttgtatgggggaatggggacgggaggggggtcaggaatgggcttctcgagagaagtgacatttggtcagaggcccaagagcgggaattgatcctggccctccctgaatcagtgtggtgtgacccctcccgccaaggtgagggtagcaaggtgcctggggctggaatcctggggctgtggcccgtacagtcgcccgggacccatgcccagcagggccctgcacccggagtttaacactgaggtccccaccttgaaattcctaatcattgagtctttgtaacttgtgttagggagtccagcgagacaatggggtatgtgcggggtctttggagcttcagcccatgcacagacacgtctctctgttcctcgactcctagcatgctctcacctgcctgccccagagaccaagccccacctggccccttcgtcaccccgaggtggcgactgggttgtgctgaaggagggaggcccacacgccaccactgccctctgacccgtcaggggccccgagggcctggttggtcagggctgggcactccacccaccccggatgacagcaccaggctcatgtgccaggtgactcagccagggccactcaccagcgccacctggtatgtcctgggtggcggccgctgtgcctgctcctatccaccatggttgggcactggctgggaagagaggtgaccaccaggccctaatagcaggagtcacccacacaacccttgtacccagccctggggtccaggccgcctgcaccggctcagttctgcgcctgagctcccagctctggggtccaggccacctgcaccggctcagccctgcacccgggctcccagtgctggggtcccccaccccttggtgttgccgcatcctccctgggcccaagattcctggagctggagaacccccttcctccctgaggcatggagactgggctggtcctgagcccactccaggcacaggggacacacctgcttccttcttaactgagtagagcagagttattttgaagatcggttttcagcaggacagtaaaaaggcgaactgggagattgttcatgcagcagcttctaaaaccagtttttagataaatgcaccttcgtctgtggggggtggccgcacccagcctcgcttcaggtgcctgacggggtacgtgctgcgttcagtcccaggcaggtgtagggctgggcaggtggagatgcggtgccctcgctcaaccggggtctaggctcctcgccgggcggggttcacctgctatccccagtgtgtgggggcgggggtgtggggtgagggagaagagtggggcactgagtctaaacataggctgtggcctgtaggtgaggggaggcggcagcaaggagggggagatcaactcctgaagagactccgtttctaacacgccgggagccctgcgctttgtcatggaaactggcaagagtccctctccatccctccctactcccagaaacaagatggtcccaggctaacgggcttctctctggcctggccctgctcccagacccccgctgagggtggtaaacaccccagccgcgcccttggcaggggttccgtcccaggggcctccctgttctcactgtgagggtgggcatgatgggcagctttgcggagcctcctcagcacagagccgcacatgacgggggtggacagactgtggccccacagccgtccatcactttcatcctgtattgggggagaacggggcttgcttgaggtctgtcctggatattcgtaatgctggcattgacggggccagtgaaggctctgattggtgcgggtgacgaggacacagtcgcagcaggcgtagaccaccagagcagggtgtccacgtggctggccacgtttagttgataaaagtggcatctataaatgggtggtggtgcggaatgggtggttgattaaatggtattgggccgctcaggtggccattggggaaaggtaaagctggatccctacctcataccaaaattattctaggtggataaaaagtttaaatgtaggccaggcagtggcttgtgcctataatctcagcactttgggaggccgacatgggcacatcacctaaggtcaggagttcaagaccagcttggccaacatggtgaaatgccatctctactaaaaatacaaaaaattacctttgcgtggtagcacgtgcacgtaatcccggctacttgggaggttgaggcaggagaatcgcttaaacccaggaggcggaggttgcagtgggccgagatcgcaccgttgcactccagactgggcgacacagtgcgactctgtcattaaaaaaaaaaaaagtttaaatgtaaaacataataaaagctggtttccttactgcataaaacacttctacaaatcgacaagaaaaaaaaatcaaccgcactcttaataacagaaatgtaaattaaaactacaaggagataatgctgggtttcacttgtcttgggagagatttaaaaaaaaaaactgatctactgaattacagaagatgcgaggaaacagaccccctcgtgctttgctcgtgggggtgtaaatgtcctccctggagagaaaattgtgaatctctagcaaagttcagaccccaggaacatttaaactgcagctttaattcaacagcggcacttctggaagtatcttctgaagatggatttgtgtgtgaaatatcaaatatacaaggttgttattagactgtgaattctaataggagaacatggaagacagccttcatgtccatcagcatgggcggacttcatgtgttctggaacggtcattaaaacaagaggctgggcacggtggctcacacctgtaatcccagtactttgggaggctgaggcgagaggatcacctgaggtcaggagttcgagaccagcctgaccaacatggcgaaaccctgtctctactaaaaatataaaaatgagctgggtgtgatggcgggcacctgtaatcccagctacttgggaggctgaggcagaagaatcgcttgaacctgggaggcagaggttgcagtgagctgagattgtgccactgtactccagtctgggtgacacagcgagactctgtctcaaaaaaataaaatataaataaataatttaaaaattatttaataaataaatagaataagaaagctgtgtttgctgatatggaacaatctccaagatacagtgttaagttaaaaaaaaaaacaaaaacaggccaggcgcagtggctcacgcctgtaatcccaacactttcggaggccgaggcaggtggatcacgaggtcaggagatcgagaccatcctggctaacacggtgaaaccccgtctctactaaaaatacaaaaaattagccaggcgtggtggcgggcgcctgtagtcccagctactcgggagtgtgaggcaggagaatggcgtgaacccgggaggtggagcttgcagtgagccgagatcgcgccactgactccagcctggacgacagagcgagactccgtctcaaaaaaaaacaaaaacaaaaaaaagcaggggcagaactgtgtgtggtgggccaacacttgtgtccaggtttctagcatgtgagagtgtttgaaaactggagcctgtcctgtgacggagtcttgtgcagacatgaaaaacaagagatatcctagtgagctcccaaacagggacacccatgacagagtaaaagcagaaacaagtcacaggaaaaaatatgtagagcataaccccatttgtgcggcaaaaataaggtgtgtatgtcgatcactgcatgggagaggaagcgaaagagaaccactcagaatgaagagtcattttctgtgggaagctggacacatgtggaagggtttgaaggaggagttttactttcattctgtacattgtaaaattttttctaaagaacttgtgttttacttttgtatatttttatttatttatttattttgagatggagtcttgctctgtcgcccaggctggaatgcagtggcgcgatcttgtctcgctgcaacctctgcctcttgggttcaagccattctcctgcctcagcctcctgagtagctgggactacaggcgcctgccaccatgcccggctaatttttgtatttttagtagagatgggggtttcaccatgttggccaggctggtcttgaactcctgacctcaggtgatccaccagcctcggcctcccaaagtgctgggattacacgtgtgagccacagcgcctggccaacttttgtatattttaaaaataaaatatccagccacaatccctgagaatagctaggcagtggaaggatgatttctaccaccccatgccccaccccccagctggcagaagctttcaccccccgcccctcccccgccgtttccccgactcgctgacccctcctctgcccctgggccttttgcatcctggagctctcttccccttgccaactcctcctgcctcccaggcctcagccacgcctgcttcctttgggctgatgctgagcaccaacccagagtgtcggtgctgctcattgctccagtgaccccgtccagaccagcctccccgtccagccttcctcttgctcctgggcaggacctgccctgtgctttgaggccctggggcctgcacatatccagcatgtgggtgtgccctgtctgtgtgtaccaggtaagcgggcagatgagcccagcagacactgctgcagccggaggctgccggcagcccgcagtggcacagccgtgctgtgggagggcctttctgtgtctggggctgtgttttccacactccccctctggcttttactgttttgctccgggagtgtggctttctagagttttgtctgattttatagcagagtttctgttaactcaaaaagggactccacagtgaaggtttaaaggtggtcccagctgcagcaggaagcaggtgtggggtgcctgctgcccaggccctgttccccagcactgcttctgacccaggaggggctggggagaggaccactattcctcacctttcatacacccactcccatcctatttcgcaccccttcctccaggctgcctgcacctctgccctgctggcctttcgctctgtaattcctttctgaaagaaatgttttccatgaaacaacaacagcaagaagaaagcagatcagctgttggcaggagctgggaggagggatggggagggcagctgatggatatggggtttctgtcgcaggcgacgaaagtgctgtaaagttagatcacgatggtggtgacccgcctcagtaaatgtgctaaaaaccagtgaattatactctcaacaggagtgtaattgctgtcttcttagaacgtgtggccatggaaatgtgctctttttatgtgtttacctttgtatcagccgtcttctcaatgagaccagaatccctatcagagcaaggaccttgtttgtgtctcccttttcctctatgtcctaatatacaacagtgtgtttagcttgtagcagacactcaatttaacaacatctttttgaacgagtggatccataaatgcattaagtggctctgtgacttcagactcttcttcaggtttacggtatataaatatatcatttacggtaccttcatttatggtatataggtgatattttagccggggtgcagtggttcacacctgtaatctcagcaccttgggaggcagacgcaggtggatcacgaggtcaagagatcgagatcatcttggccaacgtggtgaaaccccgtctctcctaaaaatacaaaaattagtcaggcatggtggtgcgcgcctgtaatcccagctacatgggtgcctgaggcagcagaatcccttgaacctgggaggcggagctcgcagtgagctgagatcacaccactgtactccagcttgggtgacagagcaagactccatctcaaaaaaaaaattgttatctcagccaggcacagtggctcacacctgtaatctcagcactttgggaggctgaggcaagtggatcacatgaggtcaggagttcaagtccagcctgaccaacatggcgaaaccccgtctctactaaaaatacaaaaattaggccaggcgcggtggcgcacgcctgtaatcccagcacttggggaggctgaagtgggcggatcacgaggtcaggagatcgaaaccatggtgaaaccccgtctctactaagaatacaaaaaattagccgggcgtggtggcgggcgcctgtagtcccagctactcgggaggctgaggcaggagaatggcgtgaacccgggaggtggagcttacagtgagctgagatcgtgccactgcaatccagcctaggcgacagagtgggactccattatacacacacacacgcactatatatatatacacacacacacacacacacacacacacacacacacacacaaaaaaaaaaattagccgggtgtggtgggcgcctgtaatcccagccacgtgggaggctgaggcagaagaattgcctgaacctgggaggcagagtttgcagtgagccgtgatcatgccactgtactgcagcctgggtgacagagcaaaattctgtctcaaaaaacaaacaaaataaatgatatctcaataaagctgctaaaaaaaactcgcccaccaggtacccatcaggtatcttatccagcataagaacagctgggctgtgtgctgtctgcacctcatcccatgaatctttgcaggggttctacaagggtcctccttactaaaccccctgcacaggtgaggaaactgaggcccagagattatgcagcctgcccaggtaaagcagctggtgaacgtggacagcgtggcccccgtcataccttctcgccagctgacggtgctgtccagggagtctggaaagcagagatccaaaggaattggctgggctggaaggctccttacagaagagctcgcttgcccattcactcattcatttgttcagctgaacacccacctacgagtgtgtaccaggcagacccgctcctgtctccacgaaccacaatcacagaattgtgtaaacgaggtaaagccggaggcctgagattgtggggatggggattgaggtcaggactgtcttaccaaggagtgacatttggcctgggattgaaaagtcacgaaggaactgaacattaagaccctgtatgtaaggctgggtgtggtggctcccactgtaatcccagcactttgggaggccaaggtggaggaatgcttgaggccatgagttcggaatcagcctgggcaacatagtgagaccccatctctacaaaaataaacaaaattagccaggcgtagtgtcttcctgcccacttgggtggctgaagtggaaggactgcttgagcccaggagttcaagactgtggtgagcagtgattgtgccactgcactccagcctgggtgacaaagggagaccctgtctctaaaaaataagattataaaccagccaggcgtggtggctcacatctgtaatcccagcactttgggaggctgaggcggttggatcacctgagggttttgagaccagcctggccaacatgacaaaaccctgtctctactaaaagtagaaaaattagccgggcttggtggcacatacctgtagtcccagctacttgggaggctgaggaaggagaatttcttgaacctgtgagaaagaggttgcagtgagccgagatcatgccactgcactccagtgtggacagcagagccagactccatcacacacacacacacaatatatatatatgtgtgtgtctgtgtatacacactcacatactcacactctctgtagtgggctgaatggtgtccccaaaagctaggtctgcctggcaactcacttccaacttcttggaataagggtctctgcaaatggaattagttaaggatctgcagatgagattctcctggatcaggctgggccccaatccaacgaagagtgccctcgtgaggcagaagaggagagagacacgtgccggagaaggccacatgagggcagaggccgagaggcgggagtaaggccaccacgagcctgggaacgccgagggcgccagcagccgccagcagctggagagaggatggatgggaggattttctaaagccttccgataggggtgtgacttcttgattttggactccgggactgcaggaccgtgagaaaaggagtgagtgttaagtccacctagttagtggtcattcattaccgtagcccgggacacttacgtgaacttcagacctcaaatcctccccatcttgcagccccaggcgcagacctgggcagtggggcccccgtgtgcccatcccccagctggccaggctcagctgagagctcctcgacctcctgcctgtccctgccacccttaggagtccgagaaactggacctgcccgtggcctggacaccacttcctttattgcttagggtttctctctttctttctttaaaaattttttaaatgaaaaatggggctgagggaagactcggtctaaagataagagaggggtcacctggatctggaatgttctctggctttccaggctgctctgatcgcagacctcctgtctttaacaacccagcctgggtcaggtctgatgaaatgcactttccagggaatggggctggtttgggctctgcagaagcttccctcttccatcctggcaccggcagaaaagcccattaaaataattgcagggagagactgttacctaagtttcctccccttgagctgttggagctcttctttgacctttatggtttttaaaaccctgccaatccttgccttgtcccccggacgcattcatccagtgggttgggaagctggtgttcgctgtccgggctgggtcgtgccggctctccgtgtgtgcacgtgtgggtctgggctgggtgttgacctgctcctgggccagggcccaccagagccttagtccgggtggccaccatctgggaggcccggccgtgtcctctcttaccccagttctccaggcactggccaggggccccctcagcacacatgtcatagttggtccctccctgcccatggcccttcagaggcccccagctggtcttgggaggagggtgcctgtgtgggccagctttcagcacagcccccgccctctgctccagccttgggtgcaccccaaccccacccagctgaccagcctgttggggggcctgtggaccccgcctctaagcctgggtcttcctctgggcacccgttggggacagggcagccacacacccagcccagggtgtggtctccccacccagctgcctcccttgcaaaggcagggttgccttggcaatgacacctgaggaggagacgcttgccctgggtgcgctgtttccctgtcttcagtaagggaggaggctggcttcctctggcggagggaggcagcagctctcctttgccttggaacccgctttgctccagtgatccctgagccaccacattggtaagactggctggagctgaaggtccgagtgtggcttcaggactggtgacgatggccagggatgaagggctgcggcgtgtggaggggctgcgcccggaaggaagcggtgtggacccagaaggaagcggagccctggtgggcagcctggctgtgctctggcccaggaaccgggccttttcttgcctcttgcctctgactcagagcggcttgtgggagcctcgcatgcagggccaggcagggcaagaacgatcgcgaccttttcctccagggaaggttgcaagaaaggcgggatctgtaacgtgactaggtggaggcactacggagccatggtgcaggggtggggggccccaggtgagctcagatgccctccctgcctgtgccaccgtggcctgaccctccacaggtgggagccataggcgtcaggagccattaccccttggagaactgggtgccaggccgagacctggtgtctcatttatgacaaaccgctgcagtgcgtttgggagtctcctcctccatgacgtgcttgtctggattggttttattttagtgcaggcaccacgtcgtctttttatatacgtgtgaacgtatatatgtaaacacacgtatgatgttggtgagttcatgttggtggtatttttactaagcaaagatgtgggaaccaaatgggcccatccggggagtttcccatttggtccctcgtgctgtgtgtggtggggggcattgtggtcgaggtctgaacagccggggaagtgaaagaccccgtcctctccgggagcttacgggagtgggagagacattgacgaaatattacccatcgcaggagtcaggtgcacacagtgatgatagttccgggaggtcaggtgcgcgcggtgatgacagttccggaaggtcaggtgcacgcggtgatgacagttccgggaggtcaggtgcacgcggtgatgacagttccgggaggtcaggtgcgcgcggtgatgacagttccagaaggtcacgtgcgcgcggtcgtgacagttccagaaggtcaggtgcgcacggtgatgacagttccgggaggtcaggtgcgcgcggtcgtgacagttccgggaggtcaggtgcgcgcggtggtgacagttccgggaggtcaggtgcgcgcggtcgtgacagtgccgggaggtcaggtgcgcgcggtggtgacagtgccgggaggtcaggtgcgcgcggtggtgacagtgccgggaggtcaggtgcgcgcggtggtgacagtgccgggaggtcaggtgcgcgcggtcgtgacagtgccgggaggtcaggtgcgcctggtgatgacagttccgggaggtcaggtgcgcgcggtgatgacagtgccgggaggtcaggtgcgcgcggtcgtgacagtgccgggaggtcaggtgcgcgcggtggtgacagttccgggaggtcaggtgcatgcggtgattgttccggaaggtcaagtgcatgtggtcatagttccagaaggtgtccccggggcaggatatgttttcctattttccttggcttccggggagcttggagcctgctttcctttgggtcctgggctgattttcgggcaggtgctgggatgcagtgtcctgggtgctgcagcatggctgagcctcggattctctgtccagggctagctgtgttcaggccgcgcatctttagttttggggcatcgcaaatcctcctggaatctgatgaaagctgtggaccctctgcttgtggcggggggtcatgcagaaaactttgagtacagtttcaggagatgcacggaccacccaagggcctggaatcggagcccccacaagacagggggtgtgctctctgggccagcgtttggagcactctctggctcttggagccctggtggggcattcccagcagcttgcttcatttcctggacacgtgttcttggctgtggtttatattactctctgtatgtaaatgtcataggttttttttcttctagtaaaattgttcctagttagcacagtggaatcttgaaacaagaaagccatctttcatgaacagtgtgtggtttccaggcttagcccatggagttggagtgacaggtatggcagagatggggggtcaggctgcgtagaaggtgtttgcgccccctaggtgcaggtgttaatcctcaccaccagggcgatggtgctaggatgtggggcctttgggaggtgatggggctgaggactgagcctcatagtggggattagtgccctgatgaaagaggcctcagagagcaccctcgcttcttctaccatgtgagcacccagcaggaaggtgctgtccaggacccagaaagtgggtcctctgcagacaccaaatctgctggcaccttgatcttggacttccagcctccggaactgggggaaagcaatgtctgctattgatgagccgcccaagctgcggtgctttgttgcagccccaacaggctaagtcaggaaccgtgaacaggagacctcccagggagtctgctcggaggggggatttgtcgtgggggaattggtcattgtgcctcagtttccccattgttggggaagtggtgcccatggccactggcaggcccccccgggggccagcacaccaggtaggaagaaatgcaagccccaggctgctgagatgcacagagccccacattctgccttcgggacgtctgtctagtcccttgtcttacaaagggtgggcaggtcccctgcaggactcagcagagggagagacacagtcagggagcggccagaggggtgacgtgcccggctgcccacaggtacaatggctccttcgtgtcacacatgggtgtcggcgtcatctttcggctgggtgagggaactgcccagctgcccaagccctgggttcccaagtcagagttgctgggattactgggcagggaggtggtcccgcaacccacaccggggcagtggcaggaagcacagacacacacagcacagcgggccggcaccgccggggtgggttgtctgggcttggactctttctgtgcacatgctgatgtttgttgataataagaacagaaacattttctttttttttttttgagatggagtcttgctctgtcacccaggctggagtgcaatggcgtgatctccgctcactgcaacttccgcctcccaggttcaagcaattctccttcctcagcctcctgagtagctgggattacaggcacgtgccacaacacccggctaatttttgtaatttttagtagagacggagtttcaccatgttgtgcaggctggtcttgaactcctgacctcatgatctgcccgcctcagcctcccaaagtgctgggattacaggcgtgagccactgtgcccagcccctccccttttttttttccttgagacagagtcttgctctattacccaagctggagtgcagtgacgcgatctcagctcactgcaacctccacctcccagattcaagcaatcctcctgcctcagtgtcccgagtagctgggaccacagatgcgtgccatcacacccagctaattttgtatttttggcagagacaggcttttgccatgttgcccaggctggtcgtgaacgcctgagctcaagcgatcttcctgccttggcctcccaaagtgctgggattacaggcgtgagccaccatgccctgcccagaggtgttttcaagcatgtcctgtgcactgggcctggttggttgatgctcagtgatgtttattgaatgaatgaatgaatgaacgaacaagatccagaagtctgagggtaaacatggggtgccagcatcttgtcttagcccagcccgttgttggggggttggcagagtacctcaacccagacccctgtcacctgtgccccctgccccccctcacgctcctccctgtctcccccaggacctcccactctcgggcaaaggccgaggcagccctcacagcagctcagaaagcccaggaggaggcgcggatcgccaggatcactgccaaagagttctccccttccttccagcaccgggaaaacggtgagtctcgccgggcctgatactggcatcgtggggagggggtgcgtggatggctgggcagtcctggcagcagatgtgtcctccagagcgggtaggcttagatgggctcagccccagctgctcccctgcccggtgtcttcctctcccgccgaaggtgcttgtttgtgccaaggcctggcctggctccccgggacacaggacatgtgtcttggcaggtctctcccattcccacagtccttggggcaccgcgtgttgcttgccggctgtccctgacggtgaattcccacctgcccagcctgtgctgtctgctgcccgccctcccccagtgttgttctagaaccttctgggatgatggaactatctgctgggtccagcgtggcagccattagctgggtgtgtctgcggtcctggctcttgacctgcctctgatgtgaactaacttaccattaaacacacccagtggctgctgggttggacagcgtcacaaatggcagctcccgctgtgcccctcggaaagagctggaagctgctgcctgatttaggaacctcgtcctcccttcgagggggggatcatgggtgatacggcccagtgacagtggcgggggcgtggagggtgtggggtgggtggcggagaggccgtggccagctgcctcccatctcctacctcatcttggaggaagcttcctctgcaccaggaggccccagagaatggggttaggagcgcgccccctcaacccgagctctgaccggtgagcggtattcggatgaggctctgcgcgctggaggtccgcacctgacaccacagccctgaacttgctcgcaacgcctgccactctggccaccaggacaggatgaggagcccagcctgggggctgcggggctgggcgctcccctgactggaacgcgagaccacatcatctctagaggtgaccgtccgccaccactccaagaccttgccttcactgggcgagtgccgggccctgcagagcctgcagctgcagcctggaggtcaggaggacgagcccccgcacccccaccgccttgggcagcttctattccactgcgtcccctccactctcctggcccctccagacacacgcaccccaaagtgtccaagtgggagggcaatgggccacgtgcccctgtggccattggcatcctccatggtctcgccctcaggccctgagtttccttctccctggggcccctccttgcctcgcccacgaccagctgcctgggctgggaggcggtggggcgcacacttgggggcacacgtgtagcgtgcacgtgcatgtggggagtgggtgcagtgctgcgggatggacgaacggaacagggatgctggagaggaagccagtgccgtcgggggcacctgccagaaccctggctgggccactccacgcagaatgcacgtaggacggcatgggattccacgtaccaaccctggcccatggtcgcctcagctccagccctgcctgcgactcacattccactgcctgcggcctgttttgtttcctctcagagcctcagttccatgtgtgaaaggaaggggaccagacagggaacattgaagcctccatcctgtgccaaatcccccaagagacgcatccaccggaagctcccaacgtgacttatttgggaggagggtctgtgcaggtgtcattatggaacagactttgagacaagatcagcctggattggggtgagtcctagatccacgcggcgtccttagaagagacagaagaggaggagacaggggcggatggagtgatgtcagagatcactggagactccgtggctggagggtggctggagcggagaccctggaaggaagcagcactcccgacacctggatcacggcttctaacttccagaaacacgagtttgccttttgggtgtttctacccccacccccgcgtggtgctttactgctccagtcccaagaaatgggtgcaggctcccccaccctgagaattccagttaagactctggagtcggagatgcttcctggagggctcagtcctggagtcagaggagatgcttcctggagggctcagtcctggagtcagagatacttcctggagggctcagttctggattcagaggagatgcttcccagagggctcagtcctggagtcagagatgcttcctggagggctcagttctggattcagaggagatgcttcccagagggctcagtcctggagtcagagatgcttcctggagggctcaatcctggagtcagagatgtttcccggagggctcagtcctggagtcagagatgcttcctcgagggctcagtcctggagtcagagatgcttcctggagggctcagtcctggacttggagatacttcctggagggctcagtcctggattcagaggagatgcttcccagagggctcagtcctggagtcagagatgcttcctggagggctcagtcctggattcagaggagatgcttcctggagggctcaggtccctgcaggaggggccttgggctgaccttttaagtcctgaagctgcctcctccgacagttcttgtcttcatgatacagatgcgggcccctgtgggggccgctgtgatggagagacggggccgctgctgcctcactggtgggagtccagtcctcgagggtctggccaagttggcctcacctcctgctgctgcaccttggagcctggctcactctgagcacctcggtccgatctgccacctctttgggtggcgccccggagccttctctgagcagcatcttccctggagggggcgttgggaccgtgtgttttttacaagcgctgggactggcatgagatttgatccaagcatttcttgtttccgccttggatgcattcaggatcagtgttcccagaccaggcaccccggggccttctcggctgctggggaggggtggggctgggggaagctgtccaggtccttcctcagtcgtcctcacagccaggagctgaggtcaccaatgacagatgacagaacagagcctccaagaggggaacagggttgccagagcgctcaggcaggatgtggtggaatcaggatttaaaacgaggctctgaagcctgggccatgccggcttctagagaagcaaaccatccagcgcttcggctgcagagagtggctggcgccagcctcttgctgcctgtctgggaggtccctggcagcctcccagcccgagaactctgaccgtcagggttctgcccaaggccacgtgaaggcaggaccatgaaggagcctggccatgcggtgtccagtgcccaggccacttccggtgccatccgcccccgccccagaggcaggaggactgagcgtcggaggctgcaggacgcaggtggcttgaaggcacaggaagaagctgcaggggcttcacgaggacccgccctgcatcctcaccacgaggcttctaggaacgttacctgctcagcagctcattctagctgagggtgccctcctgctggtggtgctgggagtcggggcccctctagcgtggggtctcctgggccagccaggcctgatctcggcagcagtgggtggacgacctggtgggaaaggccggggcgccatcgggggatggggggggccttgatcccagcctgctaggtccatagcgtctaaggcacaggaatgccagccccttggaagtcccatcctggccaaggaggaggtacgatgtgggtgatccgtgggcatgattgggggcctctgatggggccagggctgccctccacacaggaccctcacggggagagaggtggtggggctgggcgtcaggtgggtacgtggatgtcagcacagttctacacagaccttctctggcccattccctgctctgctcgggggacacccaaccagcccagccctgtttctggggagtgaccacagagaagcagtcattgagacctcagagtggcccacccacacccccgtgtgacaggaactcagacttgggagggctggccacccacccagagctacccagctgtgccccaagccccaggccagggccatggcctcgctctgctcagcactgcctcttagaccagcaaggaggaggacacagcagcccagcctggtggcgtcgcagcgtgccccgaatctgcttgctaacgtctctttacaaacggagggactatctggtgccacaccgagggtagccatgtctcccagaccttctcctgccaaaaggtcagactggggtacaggcgtctcccagaccttctcctgccaaaaggtcagactggggtacaggccaggagaatgtccgagcgtgagagactctaagatgggcagtggctcttggtgtccgagctggtctcatgaggtggccgccccgggtagagctctgagacctccgtcctcagagggaagactccccaaattcccacagagctctgcaccattttggctcgggcaggacggggatgctgggggcgggggtcccactgttctgtgctgagcctaggacgctacttgagatgaacgtgtaactgttccccggagggtaagaagcgccgcgttcttgggtttctcctaatggaataaagtcgggcatggctcccgtgtccctgcgttggcaggaaatgagatcccagtcaatgttcttggttctcacctcctgctgggggctcacggagctccggagaagtctcggggctagtcctacaatgctgcccctccctatccaggcctccgggtgggggctgatggggactgagccaccggcagacgacagggactctgctggctgcagagctggcccctgggtcctgtggtgacctccccttccggggagccccgccctaggacttgaagccccagcagcctcgaaaggtggggagggaagtcggctcctgggctctcacgctggccccggcactggctgtttctcagcaagactgtcccagcaccctgagacacagtcccaggcgggtaggggtgttggcggccttgctgtgacagctcggcctccccagacaggtggtcagctagggtgaggggcttcctcttaccctcaggacaggcgagtcagggttggtgggacctgagtccacaccccagcgtcctcacgcactttccgagccttgggtctcccttgtagcctgggagctgctgtccgcccttcctgtggtgcctgggcctagccagtctccctccaagtgtctgtggggtggggaccacgggggtcccacagagggctttgggagccacggtccccactcccctcccttgcctgcagcctttcggtgagtgggaagcgcctctgctgccctgaggttccctctggcgccctggcccggggaccgcggcctcgctgtggaatgtgctgggtaacgccgtctggcgtcgtcttgtgtccccatacagggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacggtgagtgggcggccaccaggctggtcccagtggaggcaacatccacctctctgctgacctggtgtttcctgagggtttccagcaaggtcactgctcccctgttcctctccaggggtggagtagggtgggggtacagccgggagtggtggccctcaggtcgctgggaccctcccctaggaagccaggtggggcaggtgtcatacctctttccgtgagaggctgcccccaggttgtccagaaagcacacgaaactcctggtttccaggcagcatgggatccctgcgctccccgcaacgtgctcaaccccagctgctccaagagtctgtgcccctggtcagtagccttgggccgtgagatgaccgcttgagtgtcctgtgtcctggataggaacccagaggcgaaacagctgggggcaaggctggccctggggctgggagtcaggtctggggttggggggagctgccagtccaggtttctctcacccatggggggtgttggggttggagccggctcccacgtgaggcccgctgtgtgcaactcaccgtcagcctcacccagcaccccccccccaaattcgttcctccagggcaggcagcttggagggaagaacagcgtccccctgggctagactcggcgcgaggctgggggtcccaggctagactcggtgtgcgaggctgggggtcctggtgcctcacacagggctggcctccccttgaagggaccttcactctgcaaatcccaccctgctcccttgaccagtgctgcaggaatgaagggctttgggaatgaagggctgtgggacggtggctacataggatctgcgcacggccaggccctcaccccagcagggctctgctcgctcgtggctgccaggcagtgcgtggtgctgaacagaagtgctgcaagccagtctgcccctcgggtgtgaggacgcaggggggtgtccgcagggggcgctcagggcgtgtgggccgggcaggggggaccattggtaggtttattgtcgacgctgcggcaggggtcggtgtctgtccctgcccctgacctaggggagctgtggttttctcctcctgccagccccacccccagaggggtcaccgcgtgacacccctttgaaggggcacgtcctgccgggcggcaatgcctgtttctgcctctccttggaaccactgcggacgtctgtctgtcctgttgggttcctaagatgcctccccgttccccaaagcccacagagaacagcccctatgctcctgctgggaccaaaataccagctcacacttacaacttgattttccccatcgcagccggagatgtgtgcgtggctgtgcgcgcgcggttattttaggaacagccaagcagtgggcagggtgggaggtgtagggacgggttctatttttagcctgcttaatgcactgacacttttgggtgcttttaaatgaacctccctgggggtcaatgcacaagctggggacaagtgccaagctggcctctgggatgagttagcgacacgcagggtgctacatgctgccctggtcctgcccggtctccagctggggctaatctggaggtcccgtcagctgcagcatcatgtcccacccaccctggaggatgccagctgagctccttggaagtggccaccctggggtacctggtgctggtgcaaacaaggtttccctccctgtctccctccccgtctccctccccacagctttggagctgtgttttctgccaggtctgtgaggggagatggtgtgtagaggcgcggtcaatcctaagcactgttccaggccctgttggtgggaagcaggaggggcccgtgccagccggcatccatgtcaggggacaggtgtcagggcagtcgggtgccaggctgggctgagtgccttcagtgccaccccctcacaggggtacagctctctgcagtgtctcccctgggccaccagcagggtctggggtgctgtcttctggccatccccctccaccattcccaacatgctgcagagctcacacgccagaggccctgggtcccactggccacagatgggcctgggattctagcccacatagggtcccactggccacagatgggcctgggattctggcccgtgtagggccctggcaattcagggtaaagtcccttaggatggaagcacaggttctccctaccgctctactggtgaaggaactctggccctggctgtttccctcttggtgaaatgatggatatgacctgatggtggggtccagggttggaggatggctggggagacagaagcttccctcctgcgggcagccacgccctcgcccacagcgtccgtacctgcttcccggcccagagcacgggctggactgtggcagaagaggtgccactgaccaccccactctgtcctgctaccccactacaggctgactagcatccggcccttcctcctcgctggggtgggggaactttgcaccaggggtggcatcagtgggcagggctgggcccttggctgttctctgccccctgcaggctggcccggcccaaccaagttgtcatggggcccaagactcacaatacacctgcctgaggccacgatgccacggaaagctgggctcagggcagcttgctttctctctggctgagtggaggcccttgctgtgtccacaactccacttccatctgcgcctcaggtccctgataggctgggaggttgcggagggtgtgggcctggtgctgctgtggctgcaggtgccccctaggcagcacctcaccctctgaggaccctcctctctgagctgcatcccaaggacagtttacaaagccctttgctgactggggttcagcttatctgttgagcaaactttttctttaaaaagtttcttggccaggcacggtggctcacacctataatcccagcactttgagaggccgaggcaggtggatcacctgaggttatcagttcgagaccagcctggccaccagggtgaaatcctgtctccacttaaaaatacaaaaattagccgggcatggtggcacacgcctgtaattccagctactcaggaggctgaggcacaagaatttccagaacccgcaggaggcagaggctgctgtgaactgagatcatgccactgcactccagcctgggcaacagagcgagactccatctcaaaagtttctcaagccagtgtctctagggcctgagggctccaatccccagtgtgaggtgaggcgctcgggcctgggagctgatgcccagcatacagtcgggggtgcccctgccaggtgtggtgcagagcacggcgggggtgtgtgagacctgaggatagcgtctggatgtttctctcacgttaacgggaatgagataggctcattggctgctcatccccaaatccaaatggaaaaccgccattcgggccaggcagaggcaagtactcccacccgttgccgctgccgtgttgagcccaccgtgccgagtggtgttggcaggagcctcccgaggaagctgtgccaacgcaggagtggtcagagcctgtccaggccacagacggggctacgatgagcactgctgcccagggcatgttgggggcagctcctggagaccacagggaggggaggtgggcacccaggtgtgggcagaactggaccaggaggaggaggggcagcagcttgctcaaggcacagggcctcagccacagggtggcgggctgggaaggggcgagggtgtggtgggttctgagtgccccatgcaacggctgttttgggccacgtgctcaagcaggcacccagggaagaccagcctaggtgctggcgtgaggcccttcaacatcagctacgatgctgcttcatcaggagcacagcctggggaaagaatgaaactgacccaggagacaaaagggtccccgggccagacggtcaagcaggaggctgcttcgctgccgcgggatgtggcatccaggctaggcaaggggacggcaggctgccatccccagagggagttctccgggcaaggccgtgaccccactggggctctgagtttgcatccttcctgtgtgtcaagagcagagccggccactgccagcccatagctcccatggtgcggccctggagagctgacttcatgcgggatgtctgctgttctttgcgtagctttactgagacagaaagcgtgtactgttcacttcaggtggccacagtgtacaagtcagggattttagtgtattcccagttatacagccatcacccccaattctatctagatcagctccatcaccttaaacctcagggccattgagcaggcacttgctgtcccctcctcccccagctcccggactctgctttctgcctggtgcccagcttctcacgcagcatgcactgctcctgcgctttctctgtggcagccgcggttgcacggcccatgtcttccccgctgtgtgttcatcctccactggacagctggctctgcttccactccgtggctgttgtgaatcctgctgccgggagtgtgtgcacacacaaggttttgagtggaggcttgactttgccctcttagatttaggcctgggagtggaactgctgggtccccggtgttctcatcaattctcttccagtctctgggagaggagccagcagcagctgcttcgttgtgggtggggggaagggggaggcccgttgttcgggctcccctccttaatgcaggcctgagcagccctcacctggtgccacatgagctactcagtcttaacagaccaccccatcatgtctttgaaatttgaccagaggccagacttgggggcttaaaggagtccatggaaaaccagtctgttaacagggagggggaggagagtagccatccctgaggaatgtgcatcctgggaccttcaggacaagccctggtccatctgtgtcgcacagcagcaggatgtctgcgtggtaggaagtggagggctccgggggctctgaacagctccttaccacagtggggtctacatctccttccaggtggctgcgagatgcagggcgtggtgggggtggggagaggcaggggcaagtgtcctctggaagcagactgtgggcaagactggagtgggtgtcccagccattcctgggctggggccaccgtccaggaggcgtccattccctgtgcagcaggtactgtatctgtagggcagcacccacccctgccgtcctgggagcttcccagaggggccacgctccctctccccctgcctggtgtgagcagaacacagcagagtgcaggactgcaagaatcactgcagaagggcgcccccggaaaaggctctgttgtgagacgtgtcctacctggccccggcaagcacagggaaggtggcagcttggtccgagtgcccaggctgtgcggctgaagggggagtctggcacttggggctccggcggaggctgaggacttgtgagccacttcagggaggtggtggcagcagcattcaggaccataacctaaatccaaggcagctcgcaattggacacagtcctccagagccagttggcgtgaggggtttgttgaggaaggtgtggtgagggggggttttgttgaggacactgtgctcacggactttgggagtcctctgagttccagggcctctctgctgggctgcatctgacactggccatggcagccatgcgggcccttctgagattctgaggtcccagttccacagggcaggagaagcctgctgactggcacaaaggccacacgcaccgagacgtttgcttgcagggaggcctgggtggttctctccaaggggaccctgggagagctggtactcagggtgtcggggccacaagggaattccaagggaattccaggaccagcaacctcagacgtacaggcagctggggcttctctcccgcgtctggacttcacggagctcaggttctggtgggcctttggtgtccaagcgtttctaacatcctcccgtacgcttccacccccgagggtctgctagcttggtgaaaagacgtgggtgggaggcgtggtggcccaggcagagccccccgcagctgtcgctcacctcttcccctcgctctcttccagggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattgggtatcactcacagtttgcctttttttctgggtaatgttttttggattttagccaaaattctttgcttgtataacactctgctgtgtggcatggcagaaggaggccagcacgcagcccctccagctccacgtggagacagaagggatcccggcacatcagtggtaacagcggacgttgtcctcgtggtcacacgtcccgtcttgggtgtggatggagggcagcccggggcagagcctcagccccgcggcccctgagtggcagggctgactcccgtcgacacgagcttagaaagtggattcactgctttctctgtctagaacagacgggtgacaagtatgggcaggaggcatggggcagggtggcccaccccagtgggcagtagcctggcctttttctgtgtgagatctgtgctgcacacctgagggagggggagggatcggccacctcctccctgtgagacggatgcaggtccttccctcttctcggcactgcccccggccttccatgagaagccgactccccacaccgagttttaaagcaaagcccttttcttctgctgcccactcactgtgggtcccattcggctgtttcccccaccagaccccagggaagccggggcccactccgatccgcctgggctcagctaagcacggaagccaagggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagcatgttccagttaa

SEQ ID NO: 258 - DNA, 1762 bp, Homo sapiens
ggtcctgtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaagccacggcggctcctggctacaggttgccccgctgcctggtggggacagtgcccctgtgccagctgaagggtgttgggggctttccaggggcagagccaggcggggcccagcagagcctccgtgcgtcggacacagcaggccggagacctgcgggaagggccaggctgggcccgcggccctggggaacccagcaagggcagagggggctgggagaagggcccctccccttgttggctttgccccccaccctggaggccgcccttcgatcaggccccagcttcgcttctggtgttcctgcggcgcccgagggccttcctcagccccgaatctgcccaagccgagagaaagggagtgatggggagcgctaggggcgggggatgccaacccgaaccaaaacagccaggcagtacacttctaggtggttggacgcggactagcgctgtcgaagcaggctgctggagggaggagggaggcccatctgctcagtgagagcccaggaatctcgtctttcagtggctgcatcgttttcaccattagttgagggaatcgatctgtgccttcattctaagatgccaccgcattcggggcagagccggggccggaagccagggagctgcctgctgctgctgctgctgctgctgctgctgctgctgctgctgtaagatggtttctgtgcagggaaccttggccggctctgcagctgcccgcctgcctggactctccgatatccactcctcagtgcacctgacacgcatggagccggtcctttcctggaagccagaccccaaacaaactggcttccccgaccagtccactcccatgtgggagcttatcctcagaggcactgggtcctctgcctccctcgggcggctcgcctgtttcaggcatggatgcctgggaagggagtgagacgcagcaatgacttgtgcttctgccgagaataaaaatcctgagcgtacgtgtgctctagtcctcccc

SEQ ID NO: 259 - DNA, 1762 bp, Homo sapiens; identical to SEQ ID NO: 258

SEQ ID NO: 260 - DNA, 617459 bp, Homo sapiens
ttttatggtatcaagttaaaaactctttaatatctcaaaatatcttatcagattgaattatatccaatatcaatttgatggctatattcaacacatattaagaacctactgtgtaccaggcatagttttaagtgctagtgatatattggtaagcaaagaccttgctctcatggagctgtggtctggtgggagagacagataacaaaaacaaacacgtatataaatctgtgagaagtgttataaagaaaattgagcagggttatgagaataaagctacagaatgggggatatctcacacaggatggttagcaatggctctgcggctccaggccctgcctactctctcacttttcctcagtttctccagatgtctcaagctcatttatgcctcaagatctttgcaaatgtttcttgtctggatccccttcctcttcctgtcaactttttccctagttacctcttacaatccttcagaactcagatgcaaatcactttctcaaggcctcaaggaagccttctgtggccctccggaacagatcaagttcaggttcctgcttatttaccccactgagctccttcattgtactgatcacatatataattatatgagtattgtttaagcctttgtcccctccagactgtaagctccatgaaagcaaacactgtgtctcattaacttattgttgagtccttaaaactttgtagtttgcggagtaggtaaccaaaaataattgtcaagtatctgaataattttcaatatcccagaatattcaattaagtaagtatggaaggcccctttcaaagcttgcttagaaaacaccatgcttaatcttataggccatctaagtaattttggtaatttttaatgtagcaaaattactcaagttggctttatttggttatgaatatcagtactaacttatgatgtcactatcctttcatttcaaccacgttcagtatcctaagagacatgctgattgaactataatttaaaatgaataatcttttatttgtaaaagattgagtcataaataggcagaatcaacccatgcttttattttcattgcatataaaaatttcatatgaaggtattgatgtacagtactatccccgtgggctgtaagagaggctaagaaaccactaaaagaataatcatttgtaattctcacacacaatttaccactctgaaaatatatccaaagaaataaaaacaactcaaatcagttaaggatgtttttgtaattatagtgtcccctttgtactgtttaaaacaaaagtaatcaaattcctttgggccagggctgctaaaatctacagtttgtgtcaaaaaataaaataaaataaaataaaataggctcatttttcctagaaaaagaatctttcctttcactgaaaagccacatgattcaagggctgggcaagtactgggaggatgtttccatataatccattataaatgtttcctgctttaggggctggccattgtacaaggtgaaattttaaaattctaaagcaatgaaagttttgcagaaacaaatcttagaggatagtgaatgctttctgctatgtaaactgacatcaacccacctttgcgtttaaatagatgggtttacatatatgtaaggacatttggtttatcttagtggaagaaaaattttaggattaaaaaacagtattttctctttaatgtattctcttaacatgtcaggaagctgatgaatagataaccaacacgagtaaactctggctccaatttcaaatcaagtccattttcctatgagctctagaagccaaaaggacttaaaaaaaagaaaaagattgtttataatcactgggaaagaatatatttccccagttgtgtttccgagttaaaaaaaaaaaaaaaggaaataatcaaatgcaagtagctgaagtagttcctgatcaacagatggcaaacaaccatcacacatgcagtgctgctccctggcaagaagtacttaagagcttctgtctcaaaagggtctcagaatctttcagaggttgtctgtggttttgtaaaatccacctattggcagaattctaatcaattaaaagcctggatgtaaaatgcccagccctagctccactgttacctttcaaatgcagcaaaacagaagaaaatattggttaaagttaaggcacagccctgggaccaaagacctgcagctatgtttttttaaatttatatatctttaagtattttatagttttcttgaatcttccataaacaagctctaaggtgacaagactatattacaggagaaaagaaaaatgtacagagtatgtatacacaccattcattctctcaccaagagtttccaaatatatcaacaccatcccatcatgggatgatgttttaataagaacagataatttacaattaacattacagtatgtacattgcaataaatacatggttgtaaacagacaaacaagactgtattacaggtaaggtcatttggtgagaaaaaaaatgcatggcacaaaaaataaataatgcattcaaaaattatcataaagctttctgtaaaatccatttcattcaagttttttctttccttgtctgtaatttgttctatctacattattgtgaattttaactgatataaaacaaaattaaaacagcattattgtgttcagtaacttgcaagctgaaatgcactggttttacacaaacttggacatttttttccccatacagtacccagatattgcattttcttatggcattttaggaaatgtaaagccacttgtaaaaggatattcttttattcttttttaaagcagtatatatttctgaagcacactttggcaagagagaagggcaaggataagcagattgtacagtgcattagtccctgtctcttggatattgagccttttctgcaatttgattgtccattagtgggtatctttacaacacggtaccattaaaaaccaacaaactggaagaaaaaaaaagagcctctctttattagtgcagttataaaccctttaccctttcaggtctggatttgttaatgacatattgctgctttttattttattcattattaagattctaggcactctgtgggggaaatactaagtgtagggaggagaggaatgagaatgttttggaaagaggaataaactctagactctttacctttctttctagacttcactcagggacaaataaaattaaaagaaacaagttcccaaatattcttgtgaaactacttggtcaaacatacgtctttatttttttcttatttgaaagattaccatctgatctttacagaggaaacagagtagaaaccttgcaattaactagttgattcctcttctgctttatgtaaaagatcagagttataaagacataatttttatttcaaaggatctaagcatcagctagatctcaggggactgaaatggggactctcttcagcatgagtcatttgcctggctgatgacttactttccagtccccaggaggctccttgagaagttccacatataaatgcttttcagagttgtaattcttcttaaacgtttgattttccacttgtcagatacccactttggcttctatctatctcaattcttgaatatcaatgtgaaaaatgattatttgggctttaaagtcttcatagagaaggtaaagaagactttattaaggctgacgtggggataaagtcagaattaaatgccccatgatgccaactgctataatcaggtaaacactaggaattaatctctaaaactgtaatacagttcctggtgctgaaatcagccaagagtgatctctaattttttatttaaccagaatttttaccaatataataaatattttaggatgcatcacagtactaaccctctggtgccagtggcatcatcttctttccctccatgtgtttaaagaagtagttcccctctgcaagatatgcttatggatcgaggataagtgataaaggacttcctacacgttatgtggctgtccattaaggaagagtagttgctacacttaaaaccgtttctcagggatgttcctgatatagttcttaatcccatggtgaaatcattaaaaccaaataggattagttgtattggtgtttgttaatatattgttaatattcttaaaaactgcctagttggctgtttaacttttctctgtaaaccaagagtaaaagctagtcatgatatacaacctcgtggttgaaatgaatgttaaccctaacttaactacctgtttcttttcaccggtgacaatggtagtgatatatttgacaagacctcatctagcaaacatggataaggttcagacacacgctaaattataaagcagcacaaggggaaaaacctttttcttactataactggctgtaaaaacaataaaaatgagcatgaaatgtgtggattattagagcatgaaatgtgtggattattagaaagacatgcacttgtgaaatgaacatctagtgacacagcaaaacgttattaggagatactaagtaggaaaacatctaaaaaagactgaccattttagctactgggtatttatatatctcccacttgcttcagacaacacgaactgatgactgagtttgcatgaagcttaagacacatttgatataacacacataaaagtattatagaacaaatagtcactttgcacatgaagaaaaacactggtgaagagcaactctgcttatctggaaagagtgaaacaaaatgcaaagtaaataataaagacttacaaaaagggtttcctgcaacataaagttgtttttctcttttaaaatatggaagtcattggtatataaaacaaacaatgaatcactacaaatcagttaattgctatgaactataaggtgcaagtaaaattcataaattagatttttatccagtgtagcacagatttgtactgaaaacttgcaagttactccttagaaaaaaataaccagtggcagatgaagttctgaacatagttttttttaaatataatacctcaatacatttaataataaaagtaagctctacaaaaaatctgttttacatatcatacaaaatgtagaggtcagtgcagctcactgaaccacactattcagtcatgtatcaggaagacttgaaattagaaaattatgcaatttctgtggctcatcctcctcctactggtaacagattcgtgctatgtcctgttcttgacatatttgttgcttcgtccattaagttcactctgtgcaatgcctttcttctgaaaatattgcaaacaaataaaaaggaatagaaaccccaagtccaataaacttttgggctgcctgatgagtcacactctcttgaaaataatttggagtagattttatctgctttgtcagctctaccaagctgaaatcttgttaaaaacgctgttcgtgaagatgtccaccttgctcggatgacatggaggtgaaaaaactggttacgatattcctgagcgctggactgagtagtcaaggtcagttttgttcaacaaacgtcctggcagatgacagtgaggtgtgaccgtggttgtggcatgtgacatgcactttggaaacaatttttctacttaaaaaaaaaaaaggcatgaaagtttttgcactgttacgtgtcaggagaacgatcatctatgacacaggcttcaggctggctttcctcttcttcccctactgcctcctcttcaacctgttcatcaaggggaatttcagtagactctgagtcttgagtacaaagagtcttggagtcactgcagctagtgtcttcttccacttgactgccactgtccttttccgtgtctgactcaccatcttcctctaaagttagttcaaactggaatttctcagtttgaccctgccggccctcctctgggtcatcaggtgcaggagaggggctctgagggattgtgctctggtaccattcacgattgtcctccaaagtgtccaaaatatcctgggcgtcagggtggacgaggtctgcccatgtctcccagaggggatgaacaatatagtctatgaagcccacctagttaagaaaaaaatccagtatgagtagaggacttgggactaagaaacaatggaaaagcttaattagatcatggcccacaaataaaacactgaacagaagactactaaacttagtttggtaaaattgtcactattttcaacaacaacagaccatttaaagtaaagtattgctactagctggtcaaaattagcttctagaacctttggttaaagagcatgttctatagcataaaaaattttccagttgttgacatggtagggcttattttacaatcaccaatttgtaggtgaatccagataactgaaataatgccatgtgctctatgtatatgaatatattaaatgaatatagtcataataaatgaatatgtctttagaatatatatatgactatatgaatgtaagtcataagaatgaaagttctttggatcataaatactaaggtgaaattgagcttgtcaaaaacaaagtaattttaaaaatccagtaaaatactatcatatgtaatacaaagtaaccaaatgctaaagcggtagctctgttctctctgaaagctatacacttcatgcattacctgtgatttttccacggaagcattgtgcttgtcacacatggggcttatctccatgccacgttccctctctcggtctccttggcggaagaactcctccattatccggtccgtccactggcggtacagctggagaggctttgttgggttgctcagatctgcacagtgcaccatattctgaagaacctaaaatagatggatgcattctctattcactcctgttccttttttttaaaaaaaaaaacaaaaaaaactagaaattcacattggatgactgcaacacttaaaaatacacgtagtgtaagatttattccaaacagctcaaccatgatgtgtctgtgtatagttcacacttgtattaatagttccaaattatgccacttctactgcatctaaatagcttaagagaaactgtttatgtgcatggctgactagattcagagctgcttaagtggctggttctgtggggtgtttgtttgttagtttttttaattaatgtagatgcaaacagaaagaccagtagaattttacctggttaattctcaggaataaaaatttggataaaaatcctgcctacaattgctgaaagtataaggtgggagaaggaagaaatacatcttatcaaagctgaacacgcagacatgtgcacatgtgcacagacacacacacacagagcaaactcaaacaaggctttacctgaatcctatcggaataattatcaagaagaagaactccagagcttgtcactttcttagtttcaaccatagtcttcaaatcagccagtagattcatgtgttttgacatatctgttgcaagtaccttaaaatatagagtatattattaagttcagagaaaacagaatttacacatgaaaatattacgcagaatataagaatgaaaaaggaataaaacaacactatgccttttaatgacagtggaaaatccttactactccttgggggcagagtcttttcccctttgctatcaagttttcccaaagcccagataaatgtgtgtaatatacagaaatgctaggcactgacaaccactttcatggtgaaaaatgggtgacatctccatggataagacatcatcacaagtttataagtttttgaaagctagagattttcctgtgtctcataatcactgaataagatgcatagaaaaaagagtaaagtcatggatgtctaaatggcactgtctactgatgagaaaaggtggggaaaaaatccatttgagctgtggcccacacaatctgcttttgttagtcatttttctctgcccgccaccagactggaggggcccagaaaataaatgatgagggtgagctgacattattctcaagtccaaactgctagaagtgaaaaacctattacagaacatcacagccagcatcacgggcagcttctataacataaagggccataatatgttttgaaatgcagttccttttacctaatactcatcttgttcttatgtctaaattataaacaacttgcatcacagttctcttctttggcttttatcagctacttacgatgtcaatgaccattttccttaaagattgtctttgttttttggtcaaattctggaaaatgtcacagttttcttcctgaagcaatttaaagcccacagccaaatgatggttctctaagactgaggaatcattgtacatcaaggcaagttcagagtctgtaaaaaagacaaaaggccaaagatcagcaaaactgtttgtgagaagtttatctgattcttaaaattctggatttaggatgtaatttcccctaaacttctctgctgcccttatcattacctgacaatatccaggagagaataaatcagataacataagagcaggaacaacactggaatgaatcttggggagtgaattctaatgctactaacatgtggcaggtcatttcactctgtaggtctcagctttctctaaagtgaaagaattggatctttaacctctcctctagagttgccatgagctcagcagaatatgacattattcttagtatctataacacatccagagcataaggttttgtattcctgataactgtgaattacctaccctgcactatataaagtgaggatcctgtgttacaggattgtttgtactcaaagagggtacaagaacaataaggaatcatatgaacaagtttagatttgctcatttgctcatgtatagctctgaaagtccaagctttattcattgttttccattttcttttccaagtatcgtggcagtcattgtatactgtacagggatattgctcttcctgcctgcttgctcacagcttcacagtgatgttgtgtttggctgtctgtataccctctggtgaagattctgccactctctccctactgccctagacctgtgaattttaggcagggagagattctgcctctctcctacttcttgtaaatagcagacccagagctacaagataatcattaaaaaacttttgatgctttattctctttccacttaatcactgtaaagactaaaagcaaatccgaggcaggaggattgcttaagcccaggagttcaagaccagcctggtcaacatagggagacctcatctcgacaaataataaaaaattatctggggatggtagggcgtgcctgtagtcccagctacttgggatgctgaggtaggaggattgcttgagcccaggagttcaaggctgcagtgagccattatatcgtgccactgcactccaaactaggcaacagagcaagactctgtttcaaaaagaaaagaaaagaaaagaaaaaggttaaaagcacaggtatttgatcttttttctaacgaatgcatagaaaatatataacgaatgcatagaaaatatatttggaaatatatatctttttttaagaaagaaatacccaatactattcaatggctattttaatggagctaggaaggagaggagaggcttaagacattttcaactgagaaattctattattttatcggaactatagaaatacaaatttgcacacttaaatttctgctcccaaactacaggagcagagctgtttagactagtagggagtaggtttgtacagtatttttttgttattttttgttttctttagataaaacaatagtgtttatcttttaaaaggcagtttctggtgaacttttatagtgtctataaatgcctttatgaacctttatctacagataggtaagcatatagaaatgaaaaatttaaaactatataggttcttagcacatattattgtatttctacagtggaatcaaataaacaaacatatattgaaaggaaggcataattattagatactggataattattagagttcgtttaaggaaggaaatatgcatgtagacaagcagtgttaacagaattgacttagccttacaaaaaccctaattggcttatatgaagctgaaggtgaaggaaattaaggctgttgaccctgcaaaagaataagatgatgagctcttccttcaaggaaaagggtgatctgttgtatggaaggtgcaacaaagagtctgagttctactggatataagtagggcctttcatgtagggcagatgtccaagaatactggcaaggcctgtcttggagagtggttatctcctgacacttaaagagtccagattggctagaaaagccaggaaaggatgccttagtggactggcaggcctccatagcctcttccatctcagatgctgttacaggaaagtggtggtgactgttgatttttaaatgaacaaatgttagcatttaagaaactgaatctcaaggaagttatttaactttctactcttctttaggactgaaggcatatggtcacatttaaattgggaggtaggagtctgcagctcctcagcagattttcatcaaagacactaatccattacttgtaagtagagtccttgaaggttcaggaatgatcagaaagttgctgtcaggatggtacagtgcacagcacagaggggcaaagaggttagcttatataacatttttgttgaaaccctttcatcttcaagcccaatataagttacctcttccatcaagtctttcttaattaccagatgaaactgcccactttctcctgtaaacttctatactactttgtaccacccatttagcatgtatcgcattctaccttttttgtctttatctctacaaatcttttaatcgttcctccccaaaccctcccaacctacttagagacttaagcccctacaaaatattaaaggttattaatttaatatgtttggttatctggcttcccctaggcacttcaattatttcaaacttacaaagtacaaacaggaatacagcaaggcacaacatttagaggatttaggtgccattgtgttaaatggtttatgtgaatcatctcatttaatcctcataactcttttaggaagatactgttgttatcgacattttaaggctatgttccattcatggatggcatggagccatataggtgggaagtaagtctttgtgtccttgggataggctgggggatagaaaatgtcccttggggacatcttttatacacataaatatttacatagacatactcatataatcctgtacaaatgaagaaaatgtacctcagagaaggtaggtaactttgccaacatcacctagccagtaagtgctggggccagcacttaaaaccaggcagtttctagagccctcaccttatactgactatgattacaagtaccttatagaggtgaaaacctgagcagtgaacactaaacatgaaccaggaaatcaacacagtccactcagtgcctggcacacatttataaagacaactttgtaagtatttattttttattgagaggccatgcatacctttacaaactcaaagccatcattttattatatatagatcaattgtgctcatttgttacaactaccctggatcatcaagaataaattaaattatgcccaacatatgctactactgaaggcaggaagaccacttttgtgtccctctcttctgagtgctaatgaaatggggggaagggtgggcaggtactaccacataactgagaacatgtacttcatctgtgctaatcttttctctctctgtattaatcatggttctccagagaaatagaatagacatatgtatgagtgtgtgtgtgtatgtgagaaaaagacacatttatttattataggaattggctcaggcaattatggagtccaagaagtcccatgtctgcaaaggtgaaccaggaaagcaagtccaaaggccagagaatcaaccaggaaccctgatgttagaggcaggagaatatgtatgtccaggctccgagaaagcaaattgcccttcccccaatgttttgttcttctctttgaggtcctcaatggattgactgatccctgccaacaatggtaagggcaatcttctttaatcagtctaccaattcaaatgctaatctaatctcttccaggaacactctcacagacgcaccccaaaatagtgttttaccagctatctgggcatcccttagcctagtcaagctgacacataaaattaaccattacaaattctgccccttgtcaccctggtacccataagcatctcctttaaccatatttaatctccataaggccataattctaccaaacaggctacaactatcctgcatacaactaaaagcacactaacacattccccagaagtgaaagtaaagtttttgagtaatgtttactcttatcctgatagcctataacttaaatactatgatataaaataaatacttaaatactaatataaagttaatacctcttatgttatataagggaataagaaaaagaaaatgaagataagttaatacctcttatgttatataagggaataagaaaaagaaaatgaagatatatgcttaatatatgtatatatacatataaatgcattcataagaaaatactcatgacaattatagtccttatttctataactggtcatatggtcatagctggtatttgtaattaccttcttttactactcattctgtattcccttttccctcagcaagcacctcagctggtcatgattctttacctggtggggtgaccgaaaccttcattcgtgaagggtatgggttattagtggtcctgcctggattgggttattttgtgctgaccttaattacagggcatggttaatactaagggatgccctaagggatctccttattccacacatactcttccttaccttcattgtggagtagtaacccaatttccccttggtagtcaggatcagtcaccccagtcaacactgtaatgcccttcttggatgattgaatcagatgcataaggagctcaaagtggctaggtcttaacttccagttcaacggaatcactgttgtgtctcctgatagaagcattcctccttctgaaactaagacctctagctagcagcacataaatttgcaggaacaggaagcaaactttgctagtgggtcactgggggtaattatgagtcgtaacagtcccatttctatccaatgattcctggacccatgaattctggttatgcgagaaatagcaccacatattggatgctgattcagagcatatatggcctttatggccttctggagaaccttgccccagccctgcaaggtcttgcctcctagctgagtaactgagtcttcaaaaggccattctaccaatttatcaagccagctgattcaggatgttagggaatatggtaagactagggacttccatgggcatgagcccagtgcagctcttctttgccagtaaggtgagttcctggttagaggcaatgctgtatggaataccatagttttggcagaaaaactgcagggaaggcacatctgtttccagagaaagtgccttttccactaaggacaaaatgctaccctttccaccatggaagtggtccaatgtaatcaaccagccatcaggtagctggctgatccccccaaaatggtgttatatgggggttcagtgttggtttatgctgctggtggattgcgcacttagcaatagtcatagccaggtcagccttggtgagtggaagtccatgtttctaagcacatcctgccacctccatccctgccaccatggccactttgttcttagcatgttgggtgatgacaggggtggctagggaaccaagttgactagtatctacagaatgggtcatcctattcacttggttattaaaatcctcctctgccaaggtcacactttggtgagcattccttttttgtccattcagagagatcattcacatatctcttccccaaatttctttctcaccagttttccaatcatattccttctaagtccctcactatccagacaaatcattggctacggcccatgaactggtatataattgcacatatggccattccctcttccaagcaaagtgaacaacgagtcaccttgcctaaagttcttcccactggaaagactccccttcaccaccatccttcagagatgtcccagagaggggcagtagtgctgcagctgtatacttccggtggtacctgcgtatcacgcagaaccatccgtaaaccaggccctctgtcaactacttgcagggaactttccatgcgaccacatgtgtaggctgggagaaagaaggcagtgtaattaataggagtggcattagggccacttctttatgtaatttgtgcctttagtgtctgctcggacctgatagatcgtgtattacactacttttatttgatgatgaaatgtcgtacatgcccaacatatggcttggcgcgttagataataccctattaatgatgggcagacagcttaaaccacatggaaacttggtggcccatagtcagtcagtatctcctaaggcccagcagcaggcctatatctttctttcaaaaggagagtagttagttatctttctttggatgatggcagggtcttgctccagagtctgtgctgtgattcacacagagggctctgtcaaaggctccaaacaacattcctatctgccactgacatttcaagcaccattaaatctgctggatcatgtggcccatgtgcagagcagcttgcacagcaggctggacctgttgtagagccccactcaaaactagcagtttttgtgacactctcttgttctgtgccccatctaaactagcagcttttcagatcacttagtaaatgggccagagtaacacacacaaagaaggaatacattgcctcccaaatccaactaagtccactaggtattgtgcctttttgtgtcttatgatggagtccacatggcagatcagagccaatattaagacctggagctgaaacagttaagactggggcagacactatagatatgtatcctgtaagtaagacttacactcactgttcttacagctttactaggcttagccttgagttagttagaaaatgacagcatgctacaccatgtctctaagttacaactgaaataaacataaatcttcaaaaggacttcagaaacaaacatttctccatgaaatgacagagggaagtggtggttttaacttaatattcagttgtcaagaaaactgcctcattcatcactccactctctatgccctcaccctgcattattttcctccatagcacttagtaccatcacatgccataaattcacttattatgctccaccttttctagcagaatgccagctcttaagagccagggatttgtcttgtcttgtccacccatgtgtcctaagtgcctgaaataatatttattataacatttagtaggcttgcagtacatttttgttgaataaaataatctctgtagctatatctatataatcacatttgataaacatgaatttatccttattttgaaggtgtgggtttatacagaaaaataaaattctacatacaatctactagtgtagctatgaaaattttaatttcaaaataaaagtagagaaataaaaaagtgtatactgacagctagatacatcttaaccttaatataatgaaatgcctctgctcttggaaaccaaaaaccgcatgctttgaatgcatcactaatgtgaataaatctttctgccccaaacttaggcatctttgctattaacaaaaataattcatttgccaagtaaaatttaatgctatattctgtacttttgatactttttttcagaaaataaagctaagttaaatataccctccagcattttatattcaaaagttcatgctgctatttacattttatggatttatttatttatttatttatttgagatggagtttcactcttgtccaggctggagtgtgatggtatgatctcggctcactgcaacctctacctcccaggttcaagcaattctcctgcctcagccacctgagtggctgggaatacaggcatgcgccaccacacctggctaatttttttgtatttttttttgtaaagacagggtttcaccttgttggccaggctggtctccgaactcctgacgtcagtgattcacccatcttgacctcccaaagtgctgggattataggagtgagccactgcacctggcctatggatttatttatatgcatcatcctttaaaaatatttacgcagcttcctgcctgaaatttcaatttctctaaatcctgttcacagtacccacactcaaatcatttattatagcttaaccaactctaccaggtagaattgttctctctgcttgcagaacctccagcatgctttcaacgagtgtaaatacaattagtataaaatcatttggcacctaaagctaaaacaactgaaataattaagaaaaacgaagagcacatgtaagaagcaggaggattaactgccctgggaaccagccaagggaatccccagcgccccccatgtgccttaagctctcagtgcttccgtagcttccttaaagtaagacaagtaaccaactatgggtttataaatttgataatcagaggtctttagaattctttattatgagaaatatggattcagctgcaggctttggacaggatggcagctccagctctgaggcaagagctgagaatgtgctggcttgacacatggatgctcaagccatccataaaatataaaaagtcaaattttaaaaaaggtttactgcaaactaaaaataagcacaaattttgataaaatatttcacgaagctacatatcacaagtttacaagttattagaaggattcctttactgcatgctgggaagataattctcttacatgatccctagccaaaccaaactaactaaggctgtaattttgataatgccctggggcccggaacaaccctgggatactttcctgtacaaagtgacaatgctgattcattccctcaggaataacacagcctcatcacacctcatcgtcaaaaaaactttagcaatccaaagctactctggcaactgtgaacttccctatgtcgctgtggtcacacagaaaggagatcattgcaatattactaaataacaaagaaagaatttgcagcggcaggattagttatccttccatcccaggcaggtcaccagcaaaatgactttaaacagacatcctaaggagataaaattatcttcttcagtttcctccactatttcattggttctcaaactttagagtatcagattcatctgtagactgaggccttgttagcttaaatggcagactgcacagggaccctgatgccagggtcctccaggtgccagtcaaagcccaagtgccctttaaagcaggggtccccgatccatccatcggctgtggaccaatatcggtccgtggcctgtcaggaactgggctgcacagcaggaggtgagcagcaggcaagcccgcatcagtactgcctgagctccgcctcctgtcagatcagcagggacattagattctcctaggagcgtgaaccctactgtgaactgctcatgcaagggatctaggttgtgcgttccttatgagaatctaactaatgcctgatgatctgagatggaacagtttcatcccaaaaccattctctccctgcgcccccagtttatggaaaaattgtcttccataaaacctggtgcctggtgccaaaaacattggagactgctgctttaagggctcaaaagaatgaagaatagagcaggtcctcattacccttaaaaaatgtatcagagtacttggaagacagtgacctttctatcagttgttttaatttgtcttctaaatctactcttaattctaagggaacatataatatgctatataacagaatgcaaagaaaacataccagtttgaatgtttggtgtttaagatagatatatatatatacctttaacacaaaaattttatgtaaaaatacattttatgtatttactaaaaattgataaaattcagaatatctcaagacattcataagcatcaaaataaatcaggccaggctcatgtaaagtgccagcatgcactgtattgcatgacctccctgctcttcttagaaaggacataatgaaccctccccactgatacctccccactgataccatgtaaatgcagggagctgcatccaatgtatattaatatttgtatgtatgctttgatgagttctaaaagtacctcattataggtgctcataggtaggtagaacatgaaatgttatcctgtctaatctggataaataagttcctaaactaaacttgtaaaaaaatacttgactaaccacacatctcaggaaatccctgacttttccagtcctctacatggatgagtcattagagtatattttgctataggatagtccagaggccattataagatataaaaataggtaaataatcctaaagctctgaattaaatctctcaaagcaaggttacctctacattccttctttaaatctggctacagcaaagtacaggaaatgaatggtgaattcataaataattctatagctagattgctataggcacgagaagactattattcatagcctcaagcaaaaatgaaagaaaggtggattcttaagcatacaacattttcaacaactttgcatattttttatatataaaagtgaatttatgattttataatctaccataatttataatctaccatatgggagggaattaagtcatagttcacttaaatcacttaccaattaacttcaagtaccaaatagaatttctataaacctaaatctctttaccaagggatagctcaagcattacctaaacattccctacacaggctttctgtgcggcaatgtcagagatgctccatattaaacagtctctactattccttatatttccaaattcagtgatgacttcttataaggtgagatgttaacagtgagaaaaaaccaaatggttgaaaaaatattaagaagttcctgttacccttattagaagattttaaaaaggaaagaacaggggttgggcatggaggaggaagggaagctatggcctctgaagaggattaaatgatgacctacataaagtgaggaacacttaccattaattctcataactttttttttaatttaaaactttagggccaatacaactttctaaatctttctgcacactttcatttttaattacccttgtctagtaacacagcaatatattacttttaaagagaactggaacacatttttcaaatatcacatgcctcaagggatataatgataattttcagttaaattacattaacatgaactatcactaaaacacatatatacacatctcaaaagaacattatggctctggaagactctgagtttataaagacccttagtcattctaaaatgtacaagggaaaaatgtgttctgaaaaaataaagtttacttacttgtattgatcagaaattgattggacacaccaggatgatctacatcatgtattgcactggcaaaaattgctgcaagaatctccaaatctgtaaacacagcctggaaaatcagacaatatagataatattactattctacaatgatatgaattaaaagtataaacaaataagaaatctctagaatttaaatggaaaacaaaatgaagcttcaaaatgtgttacaatgtgtcaagggagagtcttagatacttgtgaacttttaaagtataatcttggaagaaaatattttatctaattttattacatctcatgatcaaatgttttccattcactgtattttttaaaatattattttaaaactctgaaattattttaaaagaaaataatagtttattttctaaatatttaagatgtctaagaatattctgaaaatgtacataaaattagtaagacattagcaattattttctttcatcgaaaccagggtttctcaacttcagcactattgacattttgggcccaataactctttgcgtgggaggctgtcctgtgcattgtaggatttttagcagaattcctggcctctaccaacaagatgccagtatcatgtacaactaaaaatgtgatagttgtgacaaccaaaaatgcctccagacattgccaaatgtccctggtggtggcaggagggaaagaaaggggaagagaaaccatctccagttgagaatcactcacccatatgatgaggtattaacataattttataatgaaaacaaactgaattataaaatatatttcttaagaaaatcaaattgctttagtaaacaactaatgaaataacttcttaggatttagaaaaattaaagtatgtccttctaatatattctatgaaaaaatatcaatatattgcttatgttttataaaacgttctttggcctataaataaaagccgtcagactagatttcaagaaaacaaatgaacaaaaagtgagtaagccagatgtgctttatgaaatgttcagtggatcatttcaaagaagcaatatcataaacagatcaatcactaaatctgtgaccaactttcataagcaaaatccatcaaagacttgattgtctattaactatagcattttcccccataagtcaataagttatacttccaatgaatccaattatcttctccattgaaaacccttcagataaaagtttaatagacctttatgagtggcaagttagtgttcttgaaatttcagaaacagatttacctccaaagcaggtgtagataatagcacatgagtagactggacaacatctgcagcatggatattgttgtgataggccacatcagcatggtaatggtcttcgagagtcataagatatgtaattaaagtatctactggaattttaaatgtttttaataaatcccgttcctgtaggaaaaaaaatcatcttaacatttttgtctttatgtgaaaaatttctccatagagtatgtttaaaaaaaaaaatcacacaccagtgttgccagtggataacctggaaatggcaactgcactctcacatgtctagtgaggaaaatgggaacctctgagaagatccagggactctgggacaaaaccagagttgggttgtcctgctggaacccaagaatactacgccctagctgtatggtgtcaggaatgaggtgccaactctaaaagtttctatgtcccattatcatggaggcagctccagtcaagcactattaactcaacccctgcatcacaccaactaaaaatcaacgtcctctctagggctgaagtttcccatttcggtcccgagatatctacagcagcctcaacttctcatttaaatcccaccctaagctggagcaaagggtcaataagagagagaaatggatatgaagaaagaagcaggacacaagaaagtgactgaaaaaactatattctaaggttagtagccagcaggggctttattcattttttttaagttagtactccattctctatgcagtcaggttcagatgactaagatgatgtctaaattattattttaataaattgcttcaatttggctatatcacatctttttcttaaatgcaaaaaaaataacaaaattgatgttatttgtggtttatccacactccacctttctgtatctttacttgtcccttggcaaaggagcaaataaggataaaagtataaaaataagcaaaaggtggggaatattaaaaaagacaaaatgtatgcataagctacagactggacattaagttcctaaataaaataaatgtaatagaactcaaccaccttacctgaaaaatggtgtgcatgataacagtcaagggccggttaccagacaactctgctattctgaaaacatgaagaccccatttgttcacatcttctagttcctggagtgaaaaaaaaaaaaagatactaaaatattagaaagtggagtaaaatatgactcaatgaacacaatcatttaaaaattacagaccttaggtggccgggcatagaggctcaagcctgtaatcccagaactttgggaggctgaggcgggcagatcacttgaggtcaggagtttgaaaccagcctgcccaacatggtgaaaccccatctccactaaaaataaaaaaaattagtcaggtgtggtggtgtgtgcctgtaatcccagctacttgggaggctgaggcaggagaattgcttgaacccaggaggcagaggttgtagtgagccaagatcgcgccactgcattctgcaatccaacctgggtgacagggcgagactatgtctcaaaacaaacaaaacaaaacaaaacaaaacagacttcagtgtaaagattgttagattgttttaaacaatgattcattttaaatgttaacagacacaccatgtaagcataggcaaactttaggcacatttacttaaatgtactgaaaattgaacagtatggcttaaccttgtgactttgacattacaacacatttatgtactttttaagtatcaatcacaaagcacttctttaatggataaaatctattcacaaaaccttaactgttttcctaaaacccagaagacatgacagatttctaactctttaaggccaaacaatgaaatgaagatgcaaataatcaccccccaaacccctaaaacataccaaaccacctgtctaaggcactttaaaaggagctttataaaatgccttcccatcttcaaaaaaagaaaaaaaaaaaaccccaattaataaacttttctatccatttaaaagactagaagtgaaaattcatgaaagggcatcatttaatatttatgatcctgatctttgaaatcatcataccttggcaaggacatcttcttgttcagttttaactccaaaccttgggatacttgaattagtcagactagagctgtgcatcaatttcttgactccactgatctgagacattggtcttttctttttctccttttccttctgagttggagaaggaatttccacttcatgttgcttatcttgagaaatttagaaaatgttctatatttattattaattctatctgttttatatcatatgcataattggaaggattataattgatcattatatattccaggaaatgtttccaactaaaaagtttccttttagagagttcagtatttacatttgaattggacttaatttgatgtcttcaaacacaaaattaagcaaataagttccattacaaaataataatatcaaatgtattccatggttacctctttgatacaatgtcctaataaaaaatgctgcaagacttagcatgacagcagactcagaatacacaacaggtggttatttccactgttcaattccattcctttgtgaaactgacttaatgaactgaatattgttcttgccaactaaggactacagtttcaatacatactttgaaatggtagaaactttatacgcaaatgtcatgaaaacagcagtatataaaactaacagctaactgaaatgggtaacactgtgggagctgaaacagcaggttttggatgacttagattaattctgctactttttatttctgtatgatagtgagataagggttaaatccccaggttttatgggagcatagagaatcataaatattacctgataagtgaatacgtacataagctaattgtgttctatagtaaaagacctaagatatcttcttactttcatccacgatttcaaggcagtgatgagcaactctaactcatccttatatatagaacatattctaagtgtttaataaatgttaactatatataacagcaattttgttttgaaagtaagtccaggatacattcaaattactgacctttatttactgcattttctttctgtggatgaggtacaagagttgtcccaggacaccaaactcagctattattagcaaacttttatttagcaattgtattttatctgcccaccagtttactaggcttgatgtacacaagacggtaaattcatcgagggcaggaatcatttctaatttatcattaaacacctattgcccaacaatggctggcatttaataagaatttgttgaagatatgaatagatctctctataaaatatattttacagtttggtactatgaaaaaatggcaatatataatcttaattcaagaattcctaaagtcctaaataaaactaagaaaatgtaccttgtcacctgcaactctaaaactcagaggcggatagtgtcgaattattaatatgacgaatgaaaacaaatagaacttctaacacttgtttggtttccaaaatgagttggcaccccaatcctcctacaaaaacaaacaagcaaacaactgaagaaaaaaatttaattgcatgttgttattctcacctaagaatgtgtttgatataaactctgacacttgatttccagaccgactcatttcagagagatgggtgagctcccgattaagcatccttttaaactgaaaaacagaaaagtaaaatgaaataatagaagaggaaaatttaagtgaaatatatatgcatactctgagatacaggaagatatgcccaaagaatttttaagttgtcctgacaatttagaacagtgccttccagcagaactttcttcaatgaggggaaaacaccataatcggtgctgccaattatagcagtcactagccacaggtggttactaagcatttgaaatgtggctagtgcaaatgagaaaccaaattttgaattttatttaattttaactacttttaatttaaataatcacatgtggctcatggccaccagactgaccagcacaaatttagactcccaagggctgaagggaaaatcaggagaaataagcaaagaaaagggaattaaaaattaagatgtattattagttatttagagaagagagaaactaatttatagcacataaaagtgttgccatacaataaaacatggaatgctttcttcaattaatttatcattagcagaaatgaatatatatactgatcaagggctcaaaatttagtcttttactccaaagcaaaacttaatagacttgagtactcttccaggactatggagaagtaaaatatttaaataaatactgtataatgtttccttttaaaagttgtttttcaagtaagagtataacacttattgtttctcaacatccacaaaatttaccattttcccaagtcactaaataggaaacaggtcaattttcaacaatctacttcacagtttttattactgatgccatagtgcctatttcattgaaagaaacactggaattaacctaccaacaccacatggcattaccagtatccaaatctcccaaagattttacacttctcccacccccatcagctgtttcttaagcattaagcatttcagagtcctttgactctgaaaacaacccgacgaggccttttaataagcctttaatatttgccttaatatacagaaacaatgtattttttctacacatagagtaactgctattagatacttgacaaaaaaaagtcagatgcatttactctaatcatcagattagcctttaaaatttgaaatttcaccataaattctcatttaagtatgaaggtaagtgttgaatgtatattttagtgatgtttgaaatataattcttagtatttaattatttagaattattttgcttctctgcataattcataccaagatggcctaactctataccgtttgctaaataacttccaaagtcaatcttatagaccatctagattaagttttaactccgcatttaactgttatcaaaacaaacaaaaaaccctcaaccatttcaatggactgttggatgagagaaatgtgtattcgcatgccagcgtagtcaaaaacaaagaactcgtcatttacattgggtgtatctcctaatgctttccctcccccctccccccaccccacaacaagccccaatgtgtgatgttccccttcctgtgcccaagtgttctcattgttcaattcccacatgtaccctagaacttaaagtataataaaaataaaataaatgctggggaaaaaacaaacaaacaaacaaaaaaacaaagaactggcatgaccagtacaaattctggttgttaaattactggtctagaaagcttagtctcaaactcaggaacactaaattcacttctttgttcatatgtttttataactcctttctaattataaaatgtacatgtgctatagaaaatgtagaaagctataccaaaaaaaagaaaataatgtaaatccccactgctggaagataaccacagataatttgttaaatttccttttatgccttttttctacccttgtatgtgaatacatatttttaaaactggcatcaggtggtatacagaacataggttactgcttgtgttcactcagcattatatcttataacctactgaaaaaaataaactttgggccttctaagaatatttgtagacatttataatagagttcaaaattttttctgtccctctttacaaagttatattttcttgagtaaattatgggctatcatataatttaatgagctaatatagaagtgtcttctatttagcctggcacatagtagatgctcaatattatttgagttctttctcccagctcactttctggcacttggtccataacttttgggccttttaaagtaatagctgatttttatcattgcaggtcagacagatgaaggatttgactgtagttataaccataaaaatagttacttaaatagctagctcctctttctcaaatcccataaagaatttggaatagcattagtatgggaaaccatagctatgtctcaaaagcacagctaaaatgtcatgcatacacaggtttaaaaaactctttgcttaagacttggagccaacccaaatgtccatcagtgatagactggattaagaaaatgtggcacatatataccatggaatactacgtagccataaaaagggatgagttcacgtcctttgcagggacatggatgaagctggaaaccatcattctcagcaaactaacacagcaacagaaaaccaaacaccacatgttctcactcataagtgggagttgaacaatgagaacacatggacacagggaggggaacatcacacaccagggcctatgagcgggtagggaggggaaggacagcattaggcaaaatacctaatgtagatgacaggttgatgggtgcagcaaacgaccatggcatgtatatacctatgtaacaaacctgcacgttctgcacatgtataccagaacttaaagtataataattaaaaaaaatttgctttacagataaattcacacttggaaaaatatactcattaggcaaagcatattccaaagaaaagagtctgctaaacattttaaacacacattcaatgaaatatctctttgacctaaaattgttcatgttatgagctaaaagttgctattaagaactacctggtcatgacaaagtcttttttttcataaaagataggagatgaggcaaagctttcaccattgctagaatctcagcagtctatacaggaactgctgccctccttgcacttctctcaataaagcaaaacaagggaagccttctgggagtgattgataaagatagatagagacccagttatcacaggtttatcttctaacttgtacacaaactagtataaggattatgttgcccaaagagaacatgtggatgctacctgcagatatgctacatatattattggatttttctaaaagaatataaagaacgaagtataattttcctggcagtttgcttaaacaattcaccaaaatagccagttagtacagataactgaagaaaaaagccagtgaaaggaatctaaatattgtacagactagataagtgacatcctgcatgttcatctttctggtcatatacattattcccagagtactttccagcctttgtttaaaacacaaaaacatggattggagaaatcctccatcacatgcccacctccctaccaaggcttataagggactccaaggaagtcaacatttcattttaacataattataaaagacaatatttgaagcaattacttctctactctaggaagacggtctaaggaatttcctaaagataattctgaagcgtacattaagttataacacaagggtattttctaaaaggaattaacattgttttccttttttgctatccatataaaagtttcagtccagcaaagctaaatgaataaccacaaaaattaccataagtgctttctcaactggtagttgatctcacaaattggttttggagtgcatagctagatgtactaaaaaaatgcactagatcattcaacaaacatttaaaaatgtgatacttctctcatctaaaaataattatataatatttactaagataactacataaaattaccaaagggggaaggactgatttaaagctaatacaatgtattcttctgggaaatcccatcatatttctcaattaatatatttagaagggacaaaacattaaactgctgtttgaaacgaaccgattgtaaaatgcagaaccatttaagcatttagtttatttttttaagtgacctctaaatattttccattgatgaatttctaattgtttttggcctaagtagtctgaaaacaatacacagatttagggttgcaactaaaaaaacgggaggatttctaagtgaatgcttttgaatcctttgttctcattatacatcagaatgtctgtgtacagcagttaaggcataaaggaaagtaaaaatgcagttgaatctcaatactgtattttgcttttcagaactgcaattcttcaatttacattaggcatttaagattgttcaggaagcaaactaaaataataaaacaaaatgtccttaaatgtaatctcctttacttctacatcacgccagtgtgctactgggtatattatatatcctcccaatatatatttaaggaggtggtatgggtccaatagtaagaaaattttcttattttttcctgacaatattctgctaaaaatcatttgaatatgctgcactgtgatgcattacaagtttggtagatatcagtattcaaagttatttaaacaaatactccattgatggtataaaaataaaaccttcaaaatgcataagaccaaatatatctatatttgctatttttacatgtttttaaaggtacagtattaaacataaagctgtccaggaaaaattttcctcaaaaagaaacgtactaaaattctatatgtagattcttggcaatattgttcataatcatagtacaaatggttcataatcacagtacaaatgtgaagcccttcaaaaataacatcagttgtgagctggctaaaagctaggagctgaattctggcggataatgagggcttcttatatttactctctatacttttctgcatttctgaagatttttagccaagaaatggctaacaaaattcaaataatggaagtctatatattttaaaaacatttttaaaaatctgaatcatccacagatttaaagggaggtaaggaatcatgactacttggacaaccaagactgaaataagttttctaatttttttagaattcaagtaaatctctaaaacaaaggggaacttgtccttcaaaaagaaagaaacaaagcaaacgacaaacactccaatctgaaaaatcctcagagtaacagaaaatgaatcttttaaaatgtgttgtgattggctcccaggttcaagcgagtggctcaaataccaaaaatctgtgaagtgatgtttcatttaggactgaataaggtttttctacctccttctattgtggagacaggatcacaatgctaatgttaccacagggcatggaaaaagcctgccaagcatggacacaatcttattgaattgtttattaattcatttcttgagattcacaaaacagtgtaataaaaactttgttcagttttgcaagtataatagacaatcaagttttcactttagtatcacttacatagttaagtaatgtcaatttttaatgtcacctagggctttatagctaaaggtgaaaaaaacgtattcctcgtcaggttaaagtagtatagatttttagaaacagccacaaattaattttataaactttatgtgcaacatactaactggaatccataaatcagtataagtaatttggcccaataatttatttgcaatgaatgtatttaattaccatatatttttcaagcacaattcaaacatataccacatgacaaacagaagaactactgcgtatctaaaaaagctattttaacactcaaactacaactgatgaaagttatacaatcttatcttgaccactattaacacgtatttcttcctagttcatgtgtaaggaaagaatacataactgatagtttgaacaaattacagtagagtctaagctttctaaataattttgtaatcagagtaaggagttttcaaaagctaagtaagtcttacctttatgtagccccaagacactgacagtaaatagtttgcttcaggcatttttgattgattatatgtatatatatatatatgtatatatatagtaagctctaaaatgtatttagcttcaaaatctcgacactttaacaacctccacaagccacgcagagtatgagtttttaaagatttttggtaattaagtatacataagaaagcctcgcattaaatcccatccagccgtcttcccatcgaatacatgccatttgtaagactccagaatggcacaaaattcagcaactattctgaataaagaaaatccacgtgataaaggaatatctaaagatctaagggtctgcatctttctctcccgagctccagggcttaatgaataatgtatgtcaagatgcttagttgcaagaaaggctagtcctgtcaaaagctaccaaataaggaactgcagggaagccgggaagagtgacaagaagcccctcccataaaaccccaactctgcaccaattgcattccagctcttagcctataaggcgagggggtgtggcctcggtgcaggctgctttgggattggttggcaagggccagcctctggggaggctttctcctcacccgacaaacgccattgaataatggtatccctgcagctctgaggccaccctgagaaaagatgaacggggcttccctcttgcagtgatgaataatgaccataaaactcctcaaaattcgtagttcattcttaagaattgcccatccttttggagggcattttctatgaattttaatgtcctctggcttcccttccttccaaataaaaactgctccaaaaatggcaatcgagcattttaattgcttccctctctcaaatccaaaacaagtggctccctggtgatgtagaaatgactgtagttctcccctcatccaacataaaagcatagggattaaacaatacgactaatgtccagaattcacagatggcacagatggcaatgacacattccctcacctgtgtgccatggctgctctcagctccttttgtttctattgttatgtatgacagagttctaaaaccttcaaaatctaggggtgggaccacttgcaattctggggggagggaaatgtgaaagctagggcactgtgtatgcataaggaatgcagtgttttgtatatagaactcaggatctgtattttgatcagaagagaatattttatttatttatttagagacagagtctcgctgtcgcccaggctagagtgcagtagtgcgatcttggctcactgtcacctctgcctcccgggttcaagcgattctcctgcctcagcctcccgagaagctgggattacaggcgcccaccaccacgcctggctaatttttgtatttttagcagagacgggatttcaccatgttggccaggctggtctcaaactcctgacctcaggggatctgcccacctcagcctcccaaagtgctgggattacaggtgtgagccaacgtgcccagccagaacagaacattttaataactgtacacaaagttaagaaaggaatgagtggctcttaggaatccagaattgagctcaagagtaatcagacattttacgaggagggttaaatgagaaatcaaagttctttctagaaaaacagcattttctatttggtttggtgtagtattaccctgtaactttaatactaaagaggtcttgtgggtgagaaacaaggaaaaactaggttttagttgattttagcatataattctgtgcattttacctcctctccatctcaaagcctgtgcttactactctgtgctttaacttgctggtatggctactctgcagtcttcctgacatttaactatttccacatgtggcatgtctgtcttagagagcatgctctctgataagcactcctgtaacactgtgtctctctgagtttctattggcctttagctgctacagtcctctgcttttgttaacatctgttgtattcatttccatcactcttactcctctacaaaaggaagaaattaaagctccaacattccactaaagctacccccagaggaatactaaggtcctccttttctctggtctccctacttctctgaagtgttccacatgtttgatcattcctactactctccctcaactcccaggatcctgaacttctttaattttccctaggcccacaatcttcaatgaccacttctaacttgaacttcagtgccatatttctgaatacaagattctcctctcgaatgccctgctagtcacgacaaactttttcaaaactgtgagacatttttctatttaaagtagttcttagtataattacttccatttcagtcagtgagcctatatttcttccagtatctcagatggaatctatgactctttcctaccattcaacaggtgtttcatgtgcgtcagacactgtcaggtgtttaatataaaccatctagctgaatccttgagtaacccggcatgttcccctatacggcatcaccttccctccttcattcaactttgttagcaagccctatcttttatccagagctgtttctttcagtttattccttaccattacccctcccgtaatctgaatccaaatatttaaaagactgagagaaatagaaagtaactttaatatcaccccctctaactccctcatttccacataaagttgagacctagagagaaaaaatgattttcccaggttcactctggtactgagaacaagaattgcaagtttaaatcttttgtgcacaatcactgacaaataatctttttagtgtgtcagcttcctcatctgtaaagtggattactgtggcagctagtctccaaagatactcttaatgagccacactgtcctacactgaatctgagttggcttgtgtaaccaacaagtgatggtgcatgactgctgaggctaagtcataagaaatcttgcagctctcatcctgctttctttgaatgtgctattgggacccctaagccattaggttgaaaaaaaaaaaggtctgactactctgagaggctatgctacaagaagtccatgttaacttcacagacagtgaagagagaaagcgcaagagagcacttgcacaagaaagagcacacatgcctggccagtcttcagcaatgccagccaccccagcccagagccagacctgaggggcaagaagccatcctagccatccagccagttcagctttcagatagctacccactgggctgcaaccatatgaggaatgccaagcaagaatgtctagccaagaccagttaacccacaaagccatgaaaactaataaaaatacattcatatttcaaagtattaggtttgaagtgatttcttacatagcaataaataaccagaacagatacatatgaggattaaatgagaccatatatgcaaagcacttaaaacaacaaatggtacaaagttgaagataagtaggtatcagacagtaaagatgacagtgacaatgatcattatgataatcattctattatactaatatttaaaaaaattctctggtttgtcatttgtttttaaaatatatatgttatatttcctttcaattgcatcacagcactccatgtctcagggccaaaatgctgtaattgcttcttagctcatcttcttgcccctggcttttccccttctagtctcatattgacctctactgccagatcaattttcctcaaatccagccgcagcctgttacttcaaagctagtaatgcctgcttcatcacatccctctgtaaattccagactgccatatctgaccttaatccccaacgccaagcctattttcagctgctctattacatttgctctgttcctgaaagactagtactcctccaccttcaccatacagctgacaatcccatctctgtcttaccaaattctcggcctaaaataccctccttcttctactctgccaacctcaaactggttttctcagtcagatttaaatcattcaaagtacatcttaggaccaaatattccagcctttttccaaattctaacgattctacatctgccccttcattcaatatttattaagctcctactctatgtcaggcactgcctgagaaagagaaacaaagctttctcacctgcagcttatattccaaaactaagttaataaatacataatacgtcatggggtgataagcacaatggagagaaagaagggataaggattacggatagaggttgctataaggtgatcatggaaagcccctctgatgagatgacgtataccaggagatctgaagaaaggaaacaagccatgtggattgcggggtgagaggtagggtagagaagggaaaaccaagtgaggaatggcaaaagcaaaggcctcgaggcaaaacatacttggtgaggctccctgaagaacaggtggaagtgtcataccacttgtcatttaaatgcaaattacactctgcagtcaggctcactgccttccccctcctttaaaaaaaaaaaaatccatccatccatcaattttattctttgacaaacttaagactcagttactttttactttttataacaagtattcatcctgaaatgaaattcctaaatacacttccttcataatactgtactgaatacatataggctaaatactccctacatagatttaaaaaaaaaatcagtataatggcttatcagtgaaataaaggagaaatgagtaatttctatcaaatactacaaaatataaatacttgtacacaactacattttaaaaagtagtcaaaaactactataactgattagctgtgtgaccttggggaagctatttaaatttcccatacttcagtttactcacatggaaaatgagaataatagtttctaccttacagggttgttgtgaggattaaattagtgcatatacataaggctcttagaacagtaagtgctatctaagggtttgctatgatttctcttatggggagaattaccacaaaagtaacagtagcatgaaaatgaatacaggggtgttatgttagaaaaattttcctttttcctgatatgatgaatgattctttgaaaggtttcaaatgtaacaaagtgccatcttcacaatatacactattgctgcattactagaaaatttggtgtggattaaaaccatgtaaaaatatttaatacttatacgtaaaaagtagttgggttctaggctcagagaattataaatgcattttgttttttcacctatgtgaatagctgctgggactttttggaagttgtgtgggacacacagcaaacctccctggtgaaaggctgtcccatgtatcccaggacatctagcctccctggcctctgcccaccaagcaccaggagtactccccagtcactgtcccctgaaatttcctgaatgttccccagtgttaagaatcactgttctatttttttcaactgtcttcaactttgactcctcatccagggtggaggatctttgaggccagaaaagtatcttattatgtccctgtatttctcaaggtagtgtactattgccacaaaaagattgttggctgatgcagatgcaaaacatcaatatttttatactgattataggtgacaggaaaggacaagggttttcaccctcagcaaaatcatcaaaaacatttaaaacagattacatatagtagataatactccttgtcttaaaacattatgcagaaacacacatacagtttcccttccctctaaaatctgcagcctcttctccctgctgaatgtgagtgatggtcccttcattcaacagacttctatttggcaactattatgtgccaggcattctaataggtgctggatgtgaaaggatttaacttattcaaataagtccctaatttgctgcaataagggagattatttaatcatattgagtaaaaagtaccaaggaaagtttccatatttctagggaataagaaatcttttcaaaaatctctgagccaaattaaaattcatttcattttccctaatctccatttctaggagactagaatctccttcctattgccacggtagctgctatctgcagagagaatctagataatttagaagagaaatttgaatagagccagagagatacaattcttatagtcagacttggcttcaccaaatttaatgaagaaactttaataagttacaacatttactaggcacctactatgcacaaagaactttacatacctcatttctaatcttggcaacattctgataagataaatattatccctattttaacatgaaaagatggaccttcttacatattcaataacttgctccataggtgacaggattgaaatgcaaacccagtccttgctcttaatggtgtatgacagctcatcatataattaggctgatgcaaactctatgataaacagtatgaatctaggagtggatttgtttatcctcaatctttttgctaactttacagtgccttgaattaaagaatcatggttactatcaccatggtcagatctctggacagggtgaggaagcaggtgcccacaggcagacagccctgccatatagtgagacacgcttatgtttgggagcgctatgtgaacaacacacagctgccctcatatgcagatgtaatgatgacgacacattcagacaaggaactgaggtccagaaaagttctgacaacacaacttgagggacagcgttacagctagagctcaggtttcttatctgtaatccactgctctcaaatgcccaaatgattttatatacatatatgcaagtgtgtttgttgaaatagaaaaaatagtttcttggcctggtgaagtgcctcatgcctgtaatcccaacattttgggaggccaatgcgggaggattgcttgaggccaggaggtcgagaccagcctgggcaacatagagaaaccaccgtctctacaaaaaatttaaaaattagccaggtgtggtggcatgtgcttgtagttccagatactactgaggtgggaggtgggaggtgctgaggtgggaggatggcttgaggccaggagtttaaggctgcagtgagctatgattgcaccactgtactccagcctggatgacagagcaagaccttgtctcaaaaaagaaaaaaaaaattcccataatgttcagttagttctctttttcagacttttcctagaaatacccctcagaatttctagaggccacttccctgctattccttgttttctcagtccttaccagatacccaagcaattaacaatctttttgaactatttcagtacatttcaggatatttgaaattctgctgatggagctgaactgctgatacattaacacatgctgtcattattgactttgtaacagaggtcaagagagaaaagatgcatttttgaatagggaaaaacaaaactaaattatggggaaactaaggctcagagaggtcaagttgtcttgctcaaggtcacaaagccagtagtaagtaacagggccaggatttgaacccagactgtctggtttcagagtactctaaattgccaaaaaaagaaaactatttcaggcattattttatatttagcctagagcctacataatagatccgttaatataatcaattctaagctgtatattatattactgtgtttgaaatatttaagaaatattgtttaaaataagtgtattagctcttggacctctccaacataaggagttttccaggcagtagcactgtttgcagtaggacttacattattggaaaatattttatcctataatcaatctacatttattttacacctttcaccttaaaattaaaagtcgtggtagttattaatcaagaagcaaatctatataacgtggtctctcatatatccagtactgttcagcttgaacaaatgcaaatctaatttttaaatgtcccttgaagaattctgaggcaaagttaaacttcaagtattaaacagaatagccacagaaaactagtgtttctcagcctccctttgctttcaaatgccttaaaaatattttagaggcagacaataatctagaattgattcataaccaatattttacataacagaatgttacatgtattttcatattataaaaactatactttctttgattaatgctagtattctgaaaacatcgttagtgccagtaaatccactaaatctgtttgtatttactgccctctagtgataatggctctacatttgattaagaaaaaactattcctttcagtaaatgaaaacatctcttgtaagttttatggagatttgagattaagaggaactccaggctgcttttttaaaaccaaataatcatctgaacaagctgagaatcgttctctaaatgatcttattttaatttttttttaacaaaaaagtctcatttaaaatagtaaacacctgcaacatgtatggagaaaggaaaccatttttgctaagaggctccttgaagctgaaataacatgagactgatctgatagctgtatttatatttctcttctacatgggctaactctcttattagatgttagcatagtattctgtaattgttgatacagtttgaattcatatatggtagagacagagttttgtataactatttagtcaatttacctaaaaccagcagcagcagcatatctactacagacttttgtttcactgaagaataatcatgacaataaatgggtgcaaaaacttcacataaatgaagcctccacaaaaataatcttgtatgaaaaagtattgtctccttatagagaaaattaggatctccaattcacttaaattggcctaaatgaataccataatcatcataaaatagttactaatgtcccctctgtacttcgtggtatgctttgtggaaacaatttaaacaaagagaatatctgtctcctaaagtaataataactagtgtaaataggcatgcttccagaaatatataatcttttacacatatcactttaatatgtgcatcttaaaataattttaagtaataaaatttgagctataaaagagaaatgatattcttttcaacaaagaatgcttgaacaattgagcatccactcataaaacaagaaacttcaacctttatcctgcaccacactaacatctacttgaaatgaatcatagaactaaatgtaaaatctaaaactaaagaacttctagaagaaaacacagtagaaagtagttgtgatcttgcgttaggcaaagatttcttaaaccacaaaagcatgaagcataaaataaaaaatggtatactggactttaccaaatttctctttgaaaaaaactgttaagaaaacagaacaacaagccacagacttgagaagggaatatgtacaaaatgcatatcaaataaaggacttgtatccagaaattattttttaaaaaatctttacaacacaataagaggacaatccagtgaaaagatggtcaaaagatttgaacaaacaaacacttcataagaatcaaaaagatcaataagcatgtgaaaagatccatgaccatcattagacattagggaaacaaaaagtaaaaccacagtgagatgccacactacatacttactagaatgtataaaatacaaaatacaaacaatacaaaatgctggcctggatgcagagcaaattaaattctcatacattgctagtgagaatgcaaaatggtatagaaactttggaaaaaggtttgacagtttcttataaagttaaaaagtagagtgaccatatgacccagcaatcctacttctaagtatctacccatgagaaatgaaaacatatgtctatataaagacctatatgaaaatgtttatagcaactctctatagcagaaacccagaaacagttcagatatcagtcaactggtgaatgggtaaacaaattgtgtccataaaatgacatactggaaaaaaatgaaatactaaaaagcaataaaatgaaacaaattaccaatagatgcaataacacaaaatgtattataagtgaaacttataattcaactcaaaactcaaaagtattgtaagtgaaagaagccattcacaaaaggctatatctttaatgtattattcattctggcaaggcaaaaccatagggacaatcagcactggacgtggggtttggggaatgactataaaaagcaagagaaaactttttgggtggtataaatatcctatattatatagtacatatatattataattacacattacctatatatctagattatggtggtggttatccaattgtacacatttgtgaaaatgcattcaactatacctctagaaagagtaactcttatgtaaattatacctcaaaaatctaactttgaaaaatattagctgatgttatcaaattatttcaattccagatttgcttaactttacaactttgcccaaagataaatgcaaaacaaaaacctcaggcatagttatgtatgataaaacaccatttttaccctttcaaagagctccaccattatttcccagaaaacaggcatacagttatccaaggtccacattagctttaatgatacaacattcagtgaattcccagttgtgaaaagcctttaggttggcagggcgctgtggctcatgcctgtaatcctagcactttaggaggccgaggcaggcagattgcctgagctcaggagtttgagatcagcctcggcaatatggtgaaaccctgtctctactaaaaatacaaaaaattagcagggtgtggtggtgcactcatgtaatcccagctactcgggaggctgaggcaggagaattgcttgagcccgggaggcagaagttgcagtgagctgagatcgcgccactgcactccagccggggtgacagagattctgtctccaaaaataaaataataagagaagcctttaggtgataaaataatagtcaaagtattcttttaagtattattattttatttttttttaattctttgtaataaaaagttccataaagtaaaatattgtccttttttgttttatttttatttgtatcaattcaaggggacaggtgcagtttgttacctggacctgatttttaaataaatcaaactcagtttagttatttcatggtgatcctgggagactgtttgtcagtcatcatcgaatagcgaatgagtatcctttgtatgctcattctaggctgtaagtaccatgtcagctgatggagacacaaaaatccaataaagtaggtatagctgggggaggttccaagatggccaaataggaacagctccagtctactgctcccagcatgagtgatgcagaagacgggtgatttctgcatttccaactgagctttgaaaagagtagtggatctcccagcatgaagtttgagatctgagaatggacacactgcttcctcaagcgggtccctgacccccgagtagcctaactgggaggcacctcccagtaggggccaactgacacctcatacagccagatgcccctctgagatgaagcttccagaggaaggatcaggtagctacatttgccgttctgcaatatttgcggttcggcagcctctgctggtgatacccaggcaaacagggtctggagtggacctccagcaaactcgaacagacccacagctgagggtcctgactgttagaaggaaaactaacaaacagaaagggcatccacaccaaaaccccatatgtacgtcaccatcatcaaagaccaaaggtagataaaaccacaaagatggggagaaaccagagcagaaaagctgaaagttctaaaaatcagagctcctcttctcctccaaaggaatgcagctcctcaccagcaacggaacaaagctggacagagaatgactttgacaagctgagagaagaaggcttcagacgatgggtaataaacttttccgagctaaaggaggatgttcaaacccatcgcaaagaagctaaaaaccttgaaaaaagattagacaaatggctaactagaataaccagcatagagaagaccttaaatgacctgatggagctgaaaaccatggcatgagaactacatgatgcattcacaagtttcagtagccaattccatcaactggaagaaagggtatcagtgattgaagatgaaatgaatgaaatgaatgaaatgaagcaagaagagaagtttagagaaaaaagagtaaaaataaatgaacaaagcctccaagaaatatgggactatgtgaaaagaccaaatctacatctgattggtgtacctgaaagtgatgggagaatggaaccaagttggaaaacactctgcaggatattatccaggagaaattccccaacctagcaaggcaggccaacattcaaattccagaaatacagagaatgccacgaagatactcctcaagaagagcaactccaagacacataattgtcagattcaccaaagttgaaatgaaggaaaaaatgttaagggcagccagagagaaaggtcgggttacccacaaagggaagcccatcagacttacagctgatctctcagcagaaactctataagccagaagagagtgggggccaatattcaacattcttaaaggaaagaattttcaactcagaatttcatacccagccaaactaagcttcacaggtgaaggagaaataaaatcctttacagacaagcaaatgctgagattttgtcaccaccaggcctgccttacaagagctcctgaaggaagcactaaacatggaaaggaacaaccagtaccagctactgcaaaaacatgccaaattgtaaagaccatcaaggctaggaagaaactgcatcaactaatgggcaaaataaccagctaacatcataaagacaggatcaaattcccacataacaatattaaccttatatgtaaatgggctaaatgttccaattaaaaaacacagactagcaaattggataaagagtcaagacccatcagtgcgctgtattcaggagacccatctcacatgcagagagacacataggctcaaaataaagggatggaggaagatctaccaagcaaatagaaaacaaaaaaaagcaggggttgcaatcctagtctctgataaaacagactttaaaccaacaaagatcagaagagacaaagaaggccattacaaaatggtaaagggatcaattcaacaagaagagctaactatcctaaatatatatgcacccaatacaggagcacccagattcataaagcaagtccttagagacctactaagagacttagacttctacacaataataatgggagactttaacaccccactgtcaacattagacagatcaacgagacagaaaattaacaaggatatccaggaattgaactcagctctgcaacaagcggacctaatagacatctacagaactctccaccccaaatcaacagaacatacattcttctcagcaccacatcacagttattccaaaactgaccacatagttggaagtaaagcactcctcagcaaatgtaatagaacagaaattataacaaattttctctcagaccacagtgcaaagtagaagttgggattaagaaactcattcaaaaccactcaactacatggaaactgaacaacctgctcctgaatgactactgggtacataatgcgatgaaggcagaaataaagatgttctttgaaaccaatgagaacaaagacacaacatactagaatctctgtgacacatttaaagcagtgtgtagagggaaatttatagcactaagtgcccacaagagaaagcaggaaagatctaaaattgacaccctaacatcacaattaaacgaactagaaaagcaagagcaaatacattcaaaagctagcagaaggcaagaaataactaagatcagagcagaactgaaggagatagagacacaaaaaaaccttcaaaaaaatcaatgagtccaggagctggttttttgaaaagatcaacaaaattgatagaccactagcaagactaataaagaagaaatgagagaagaatcaaatagatgcaataaaaaatgataaaggggataccaccaccaatcccccagagatacaaactaccatcagagaataacacctctacacaaataaactagaaaatctagaagaaatggataaattcctggacacatgcaccctcccaagactaaatcaggaagaagttgaatccctgaatagaccaataacaggttctgaaattaaggcaataattaagagcctaccaaccaaaaaaagtccaggaccagacagattcacagctgaattctaccagaggtacaaagaggagttggtaacattccttctgaaactattccaatcaatagaaaaagagggaatcctccctaactcatttgatgaggccagcatcatcctgataccaatgcctggcggagacacaacaaaaaaaagagaattttagaccaacatccatgatgaacatcgatgcaaaaatccttaataaaatactggcaaaccaaatccagcagcacatcaaaaagcttgtccaccctaatcaagtgggcttcatccctgggatgcaaggctgcttcaacatatgcaaatcaataaacgtaatccatcatataaacagaaccaaagacaaaaaccacatgattatctcaatagatgcagaaaaggcctttgacaaaattcaacaggacttcatgctaaaaactctcaataaattcggtattgatgggatgtatctcaaaatagtaagagctatttatgacaaacccacagccaatatcatactgaatgggcaaaaactggaagcattccctttgaacactggcacaagacagggatgccttctctcaccgctcctattcaacatagtgttgaaagttctggccagggcaatcaggcaggagaaagaaacaaagggtattcaattaggaaaagaggaagtcaaattgtccctgtttgcagatgacatgattatatatttagaaaaccccatcatctcagcccaaaatctccttaagctgataaacaacttcagcaaagtctcaagatacaaaaccaatgtgcaaaaatcacaagcattcctatacaccaataacagacaaacagccaaatcatgagtgaacacccattcacaattacttcaaagagaataaaataccaaggaatccaacttacaagggatgtgaaggaccttttcagggagaattacaaaccactgctcaacaaaataaaagaggacacaaagcttatagataggaagaatcaatatcatgaaaatggccatactgcccaaggtaatttatagattcaatgccatccccatcaatctaccaatgactttcttcacagaattggaaaaactactttaaagttcatatggaaccaaaaaagagcccgcattgccaagacaatcctaagcaaaaagaacaaagctggaggcatcatgctacctgacttcaaactatactacaaggctacagtaaccaaaatagcatggtactggtacaagaacagagatataggccaatggaacagaatagagccctcagaaataataccacatgtctacaaccatctgatctttgacaaacctgacaaaaacaagaaatggggaaaggattccctatttaataaatggtgctgggaaaactggctagccatatgtagaaagctgaaactggatcccttccttacactttatacaaaaattaattcaagacggattaaagacttacatgttagtcctaaaaccataaaaaccctagaagaaaacctaagcaataccattcaggacataggcatgggcaaggacttcatgtctgaaacaccaaaagcaatggcaacaagagccaaaattgacaaatgggatctaattaaactaaagagcttctgcacagcaaaagaaactaccatcagagtgaacaggcaacctacagaatgggagaaaatttttgctatctatccatctgacaaagggctaatatccagaatctacaaagaacttaaacaaatttacaagaaaaaatcaaacaaccccatcaaaaagtgggtgaagtatatgaacagacacttctcaaaagaagacatttatgcagccaacagacacgtgaaaaaatgctcatcatgactggccatcagagaaatgcaaatcaaaaccacaatgagataccatctcacaccagttagaatggcaatcattaaaaagtcaggaaacaacaggtgctggagaggatgtgaagaaataggaacacttttacactgttggtgggactgtaaagtagttcaaccattgtggaagacagtgtggcaattcctcaaaggtctagaactagaaataccatttgacccagccatcccattactggatatatatccaaaggattataaatcatgctgctataaagacacattcacatgtatgtttactgcagcactattcaggatagcaaagacttggaaccaacccaaatgtccaccaatgatagactggattaagaaaatgtggcacatacacaccatggaatactatgcagccataaaaaaggatgagttcatcatgtcctttgtagggacatggatgaaactggaagccatcattctgagcaaactgttgcaaggacagaaaaccaaacaccgcatgttctcactcataggtgggaattgaacaatgagaacacttggacacaggatgggggaacatcacacactggggcctgttgtggggtgaggggagtgggagggatagcattaggagatatacctaatgtaaatgacgagttaatgggtgcagcacaccaacatggcacatgtatacatatgtaacaaacctgcacattgtgcacatgtaccctagaacttaaagtgtaataaaaaaattaaaaaagtagatagtcccaaccgctgtattctttttgaatccttttgccactgtttcatatcacagtttttttttttttctgagccctagattatcagtctgttctttttttttttttttttttttaatgtagtccataggaatctgctgcctcacggtcagtatcgtgccccttaccccaattctaatatgacaggtttttgtctaagacagcatttcctagaatgtgttgtaatgtacagcagcttcatgtgataattctcaaagactcccactgtcaaatgttagcatattcaaggctctgccaggacctgtaatacatattctttctttattctgtttaacttagcatttctgaaacctatcttactactgaactcttgacatttattaacaaacaaatacaaacgaaaataccagggttccaagtaaaattcttatataaagcaaagggctttaaacatcagagttttttagaatggttattcactcatgcactcaacaaacacttattacatagtatgtgccagcataggggatacagtaataaacaaaacagacaagttccctgttcatgtaaaccttggacttatggggcaaaaagacaataaacaagcagacaaaaaaaaattacaaacactctcaatgaaggaaaagagggtaacatcgtacattgatgggggactataaaattaagtagtaaggaaaagctgcacttgagaaggtggtatttgggaagagactcgaatgcctagaataagccaaccagatttggggcacagcactctcaacaaaggctgagtaacacagccagtctgagggaggacaggtctacggaatgagagccgaggcaagtcaaggcaacatcacgtgggtcctgagggtatgagccttccagagggtgtgaggataccattagaaggttctgagcagggaatgataggatgtgatttacattttgtaaagctgtctctgtagaggatagtttgtaaaagtgcttgaggcaaaactgacaagacttgaagacttgcacaacagaactgaagaaatgagaagaatcaactcctagacttctgggatgatcaatgtctaggatggacattggtgccatttgcaagatggagaagaccgggggaggtacggatttaaaggagggtatgtaaggagaaagaagaatcctatgagacaagaccagaacatgtaaatacatgaagttttggatttcttactcttcaaagacattttacctcctgtccccgaagttcttcacagagttcaggataagaaaagctgccagacagttgagttttgaataagtagtaactttcaaacacttgaaagacattatattagaatagactacatccatcaaaatacttaaaaatgtttttagaatagtccaataatttggaatatgaaagcctaagaaacttccttatccaaggccgcataatataaccaaaattagaatttagtactcctagttggcaatatttttatgaaattactgttttactaagacattttagaaatgaagactttactgaaggcaataataagtgcaattaaaagtggtacaataataagacttctttttcatttgcaacaggttagtagtgtatgagaattatgagatgtaaaatagtgtagagcataggcttctctagttggcttcatgtgagttcgaatcttggccctgcctctcttaccagcaatgaaatatgcagcattttacttaaggatactgggttgtatggagagaatcagagttaaggttggtgatccagcagtgtcatgtgtcaggagctaataaattgtattgtgaccagaaacactgaaacttgttataaggaaagcaatctaattaaaacagctgcattaaaatttctacaatatcttcctaacagcttatgctatcaacagtttgtaaactatcagaatcacggatactggctgagaatgcttttggagatttcaaattggcataattttctcagaatgcactgatctgacaaatgtacagacaggcagacaggaatactaccactcttcatgaataactgtctgcctctcctggatttcttccatgttgtgtaagtctattacactttgggtgaatgtagctttagtacattgagttaatatcattcttgcaaagaagctctttataaattccttaaacttaatttgactctggacacaaacaaatgagaacaaaatacagctcaaggattaagatccttaaccaaatatgtaaaaaacacgaaaagccttacaaacagtgatcaacagttaaacatgcgctatcaccttcccctaacagctagggaagcatgtatatgaatggaacatatgaacttccatttggtgtactaagaaaacacatcacgcagatggcttttatagcttcccaaataaggttctaataattcacaaaagtgttgttccctaaaacccataataaacaataataaaacctaatgtttattgagggtctactatgtgtcaaggagagtcctatgtactctcctggaattacttcatttatttctaataataacctttaatgagcactgtcactcccgtttcacagatgagccttaaggtcttagctatcaactttgcagacaacacccaagtaaaatcctgccccctctttttttttttttttttaaccagaaatccagtcctgacaactgaaagcttatagggcatttccgcttagatacatagccttacctaaattatatgtctaaaaacttaactgtcatattgtccagccctcccccaatacccaactggcttctcttcatgattttccaactataattctgtccattattcaggtttagaatttcatgctttcttctggctgtggtcctgccaagtcttatgtatgctgtcacccttctctgtgcaatctttctcctactcattcctctcttttcatcactatcctatttcaggcccttatcactcttacacctaattccctaacggtttcttcttgctttcagtacaatttccccttgatataatctatcctgcacactaccaccagatataaccttctaaagtcaccttattttagtttcttcataatattttccttatagtcaaatgtaagggttcttcatgaattataggacaatgtgcaaatggcttgacctggcatttaagacagtctgcagtatggcctcaatctacatttctcacacctgccactggtcctataatcacatcctctgttccagagaggctcactcctccagaatgcccactaccctcctctccagcaaacatacaataaagcgaatccacatgaataccccatcctaccctgccttatccagcccctggaataccacctcttccctattagatgcctatataaatcctcagtattcaagatccagcttaaggagcactttttctgggaccaatcattctggtcctctgtattgaatactcgaactcctctacaggacaggaacataatgtattattaccctatcattcattaacacacaacaggcttacattatatggctggttgtattttcagaggtatgtctatatgtttcgctatctatctatctatctatctatctatctatctatctatctatgtgtttgaatacagatacataaaaatctcatttcacctataagaacctctggagcagatacatgtcatacaataattgggctaaaacaaaaatccctcagtgaaaacctaaagactgggttgtggttgtttgcagccaaaacgtacaaaatgaaaacctcctaacgatttattttccacatgaaattagtaccagatctagagaaaaatggacaaggatcaaatacaaataataaagtcatcaccaaactaaaaatttcattcaaaagtgatgatgttggccgggtgtggtgactcacacctgtaatcccagcactttggaaagctgaggtgggcagatcacttgaggccaggagtttgagaccagcctggccaacatggtgaaaccccatctctactaaaaacacaaaaaacagctgggcgtggtcatgcacctgttatacccactactcaggaggctgaggcaggagaatcacttgaatccaggaggtggaggtggcagtgagccgagattgtgctactgcactccagcttgggcaacagagcaagactccgtctcagaaaattaaaaaaaaaaaagtgatgatgtcagtaaagacccaaatcagggtcatatgtttaacaccagaaagtttgtatttgctacaagacagaaaccttgacaaaataacttttctgtgctttgttacttcatctgaatgaagaaggtaaaccagttgatctcacaaatctctttctaagggcttctggaatttttttttttttttaaacaataaaaggaaagagacttctcttaagcagaacaaagtccgactcctctgtaaagtggctgacagcaagtggaaaatggaagaagaacaattacctgcaaaatgactcattcccttgtaacaactacactactagggaattccttctcttaccggctgtggctagcgtcagactcatgacaaagacctcatcctggggctagaactaggtttagggttttctcattcattcctctgtttctcagctgcattttcatttttaatctgtgcaatgattacagaggcctatgtttggttttcatttctagtttccccaggaagagacaactactatcttgatattgattaacacttgaaacttctgttaatcacaatttcagtatttcagggaatcagagaaatcatttggaagagccttgaaggtcatccagggtgagagaaaagcaaagcacaagcaacagaccaatgtttagacacagtgaagtgaagacctacaggagaccctctcaacttcaataagagtcttttttatggctgtcttcatattctttcaaagaaatcataataaaggagttagtgagagtgtaaataaaaaataggctatcatagagtgctgggtaactgagctaaaactaaagtaaacaaactcagtgggccatcacatatgcaagctggtaaggtctcataaatcaccatgactgggtattgggatttcaaaggcacactctgtaagctttctcccagccctgttgattcaagctccaattgcactgggttacttatatggcagcatataaagttgaccttttatgtttaaaaatagttccattcctcatccctcctaaggataggccacagtacctatcatatgtccccaccacactacataatttatgtaagttttcacttaattttcaacacaatcctttgaggtagattatgttagtcctgatttacagggaaaacagaggctcagggaggccaaatttatttatttatccaaggttgcaactctactgtagggcagatttatatccagaagaggaattgcaaagctcctcagaatttaggagatttaaaatggaatcaagataaaggttcacatttttcatcttctattccattttactcttccagcatctaataataacctatgatatattagaacaaatcagcccatacttattttgacagtctcttttcaccccatttcagtttgtaccttgctgtctcagagcccatcaaccacctttcctcactcccaggcagccggtccttcaggggatggcttggcagttggcccaccatcctctgctaccagggcatgactcatggaggcaacaggtgaagctgacgccaactattagtgctaaaaaagactcaagcctcatgaaatataccatccataaatcgctctccagtcagctctacccctccctccatttctacagctgactgtctgttcttccttaaacatttacatccgccactgacctgtctgggatttcttttttacttcaaggttctcctaaaggttcagtccaaccaggtttcaccaaatgaaccctgcggtggaaaggggcagcaacgggcattggtcagtttgcctccagccaaggaaagtctgactcccctccttctcccactcttctctttctctgcctcacactgcctaatacgtctttcctctttctctctttctttccttatatcttcattttccaccctattcagaagtgaaacttcccttgccactttgcccccactaagaaaacagacctccaacacaacctcttaacaggctaattttaaaatcatgaacctgcttacaccttccgtgagtttatcctatatcttctctatctgctgtctgcttcccactaaggttttatccctccatcccacctccaaatcctttacagctcagattctcagatctgctttagtcacttggtctcctcatcccactgaccctattatccttctgtgcacatgttagagggcacatgctcctcctaggaactagggccaggtcagttatgctcccatcctgacatgacctagagaacaaaaaaggcaaaacgaggtactgtaggattcctctctaggaattatactttgctgaaattgctcttgctattttggaatctagtgctcactaaatacatttttaaaatattatttggatatattttgaaaatacaaccagaggtcgggcacagtggcttacgcctgtaatcccaacactttggcgggccaaggtgggcagattacgaggtcaggagttcgagaccagcctggccaacatagtgaaaccctgtctctactaaaaatacaaaaaattagccaggcgtggtggcaggcgcctgtaatcccagctgcttgggaagctgaggcaggagaattgcttgaacctgggaggagaaggttgcagtgagcctagatcacgccattgcactccagtccaggcaacagtgcaagactctaactcaaggaaaaaaaaaaaagagagagagagagaaaatacaaccagagaataaacacttgttcttctatctctccatcttccccaccaatacaacatccagaaaatagtcatctttacacttatttagaagcacatagatcttataaaagtttaactgagcattaggttttcatctttaaaaatattctgaggctgggtgcactggctcatgcactttgggaggccaaggcaggaggatcacttgagcccaggagtttgagaccagcctgggtaacatagtgagaccctgtctctacaaaaaaaaaaaaaaaaagttaaattaaattaaaaaacagaaaagccggtctggtggcacatgcctgtggctccatccactcaggaggctgaggtgggaggatggcttgagccagggagatcaaggctgcagtaagccatgatggcgccactgcactccagcctggttgacaaggtgagaacttgtctccaaaaacaaaacaaaacaaaaaacgttttgacatgtagaatactgtttctgggactaaattagagatttaaggtttgaggtatgagaaaatacctggaatcatgccttacattagaaggtaaggtaaatactggtgtttcccaatgagttgtagtcagattgttcatatgtatcaaacagacaatatactgaaatatttaaaaataaggctaaatagcaacaaataatttttcccatgaattctactttttttttttttttttttgagatggagtctcactcagtcgcccagactggagtgcagtggcgccatctccattcactgcaacctctacctcctgggttcaagtgattctcctgctcagcctcccgagtagctgagataacagacatgcaccaccacacctggctaatttttgtatttttagtacaggccaggttttgccatgttggccaggctggtctcaaacttctggcctcatgtgatcgacctcccaaagtgctgggattacaggtgtgagccaccatgcccagctgaattctacttttttttttttttttttgagacagagtcttgctctgtcacccaggctggagtgcagtggcacgatcttggctcactgcaacctctgcctcctgggttcaagtgattctcctgctcagcctcccgagtagctgagattacagacatgcaccatcacacctggctaatttttgtatttttaggagagacgggatttcaccatgttggccagctagtctctaactcctgaccgcgtgatctgctctcctctgcctcccaaagtgctgggattacaggcttgaggcaccacgcccggctgctgaaattctacttttgaaagaacaaattccccttctgtagggactgatgattcagtctgtaatgatgcattctcttcatcttctttttttgtcttttcttctatatatcctttaggcattctactgtattaacactagatagaaaaattaagatttaggcccaaacattatcttctggcataaagtaaactaatcgtttcctgatgtacaataaataaacagacatatttctagtagaagattccttatgatttatcaaaacccaattatcacttacccttatggagatcttagatcttagaaaccatactgacaatataagattaagaaaacaacagaaaatcaaaatatataccaaggataatgttaataggtttcatccttatcacagcatactgttgaaacttacttgaaatatttttttaaaaaagatacaagaggacaagtgtttagtttttaacaagggaggggactagtcaacaaatattgattacctaatttatgaacagctctggccaaagtggtcaaaaaaaaaaaattaggactttagttttcctaaacctatcttaatttttaacaggattatagctttgttcaatctttacagtctttagcctcttttgtgaaatgggtttccttgtaaataataaaatgacacctatatatatttaaagcactcatgaaataattttatctctttattaaaaactgtgataacccttccaattttgaaatttattgtcttcctaaattcttgctacaaagcctatcattaatattgcagttcattttttccctaaagattgaaaaaaacactaacaaatataaagtctttatggtcaaagaatgtactccttttataaaacttggagttgatgtaaaggcacagacaacacaagttaccttaataataaatgcacttttctttgtaattttgggtaattcagtgtgatttgtaattcttttaaaagacacacaatcacttgtatttttgcatggttctttttttcctaatttcccactatagtgaaatatctgtttttccttctctattgggtttggattggaatgatcaggtagaattaaatgtaaaataacaaaaggaaaatactttatagatcttctcaaaatactttgaagggtataatctctttaagatggctttattcatatttaagccaaaaacaaaaagcaaccaaaacactactgtttatacaaaaagcagcttcaaaatcagccagttattttctgaaatggagatggcagacattagcctgcacttactccaatatggcagccgcatctttgcctctttgctatggacacatccccagcaggcctgtactttctactctccagacctgtttatgacaggccaaggtgtttcctattatggtgcctatggctgcacagtgcactgcttgtcagtaataaaagccagaggctgtccctatagggattacagtgcagcagaccagagatgctgatgggaatgcaagcatgccctaggcaaacattgcagaatactctctgacaggcaaaagccaacaaacacatcctttcttcccagactagcagggaaagtattcagttatgtcattttcacttggaacaaactaataagaagaatgttattgctaaaataggtagagatgagaaagagcagtttatgaccatgaatatggcctctatggtttttgcctgtgcactacaaacttttaatttaaacgagatgagattgatctagcatatactatgataaaatttctgagacatgagtatctaaaagcagaactgagattaagtgagaaatgctcaggattcctgtcactgaaagaaaaagaaaaaaacctttcttgaaaggcacaaagtagaatgctcagactctccatctaccaatacaaggtaaaaaacagcatttgcattaaccaacatcatgcattcttgtactaatttatgtgactaactacaaaatgttatattgacactcactgtgtagggtgtcaggatggccaagtggtctaaggcaccagacactcactgggttgggctaaaaacaccgtagaagacctcatcagaacaataaaacagagacacaaaatattgtactaagagttaagagaattacaaataaaagttctgtggaaagtcaaaggtatccaattaggaaagcctgaggtgggagacataggacaccccagatataggatgggaagaagatgggattaaaaaaaaaggctttataaaggatgtaacattccagataggccttaaaagatggcttcgatcttttaaataaaactttttgttttagaacagatctagatttacagaaaacttgtgtagacattacagataattcctatatactctacactgtttcccatttttaatgtctgactttagtatggcacatttgtcacaattattgaaccaatactgatacattattattaaacaaagtccacacttcattcagatttccttagttttcacgtaatttccttttttctgttctggatcccatccaggataccacataatatttagtcctcatgtctcctgaggctcttcttggctgtaggtatctcaggttttccttgtttttgataaccttgacagttttgaggagtactggtcaaatactggtcaagtttcgagggtagaatatccctcaactgagatctgtctggtatttgcctcatgattacactggggttatatgttttcagtagggaaaccacagattaaaagtgccattttcatcagatcatatcgagggtacatgttatcacttatcactgtcaatgttgaccttgataacctggctgaagtagtgataggtttctccactacagtttcttttttttccctttctacactgtactgtttagaaggaagtcaatatgcacagctcacacttacggtgtagggggttatgttctccctccttgagagtagagtatctatagaagttattgggaattccgcacaggaggagatttgtctattttcccccacttaggtatttatttaataaattgtatcaatatgggtttatggatatttattttaccctttgggatataatccaatactatattattttcttgctcaaattgttctagctttggccattgggagctctttcagtttgctcttgcaactcttcagtatattcccacgggtgtagggttccatttgtttgagcaggtccttactttttggcactacaagatgctccaggctcatcttacatatttccttcctgagtccctagaaatcagctattttttttcaaagagtcttggttccttttaccagagaatggtattagaaaccaaaatgagggtgctaagtgtgctcattgctactggggtatggtagcttctagaccctctcggctgatagagcaaggaaatatttgtgtgtatactagatggtaagatgttgagaggtagaatggagagttaccttcttaatatacttttcttaatattaaatattaataagatattgtgtgcctgggttactttcagtcttatgcagaggaagaacgtatgtacattcatttatgaaaaacactggctagactattcttctgcactgcattatgcatttctgctagaaaaagctcagagattttcagatattctgacaaaaatctcaggcttgcttgatgagctatactgtaaaattacagaaggaaacaaagggcaaactccttgaaggatgaaaataaaggaataaaacatataaaacaccaccaaaaaaagtgattaatgggggagaagagtaaataaaacattataatagtcctctttggttagtatcaatattattaggtcactttatcaaaaggatagaaatcaggatggcagacacccttctctaaccctcaccccccaaaataataaaataaaaactaatgttattccttcacatatggaaatgaatgagttctactgagtatctagtatgattcctgactcagtcgagacaattcccatcttttaattcattaaatcaccacagcaactatttaacagatgagaaaactgaagcacagaaggcaacgtggcccaatttacgtttggtaaaaggcagagaatgaatccaattcaggcaggctgtctatagtagggtgctctaaatccacggaccattctgcctaaggaatgaatattttatgaattggaatatttctgctgaacgaatttgccattttctcctctagtggagaaatccaactgagggtaaagaaggaaaaatgttgattgtttaaaacaataaattagtctctaaattgttcttgcagctgatttagactagtgtgtccaaaagtatgcccagtgttagtaaatggtaggcaaaatgctttaaggtggtgcaagatgaatgttttctcattttgttattcattaattttagaaaaaatacagaaaaaatataacttgaacatcaaacctatgatttcatgtataccattacttaagatgaggcacttgggtgagtatttagatttaacaataagttgctcttagcatttctatactttgacaataaattatccaaaaaagaaattaagaaaataatcccatttgcaatagcatcaaaaaaatacttaggagcagccaggcgtggtggctcactcctgtaatcccagcactttgggaggccgaggcgggcagatcatgaggtcaggagatcgagaccatcctggctaacacagtgaaaccccatctctacttaaaaatacaaaaaaaaaaaaaggcaggtgtggtggcaggcgcctgtagtcccagctaattgggaggctgaggcaggagaacggcgtgaacctgggaggtggagcttgcagtaagccgagatcgcgccactgcactctagcctgggcaacagagcgagactccatcacaaaaaaaaaaaaaaaaaaaaacttaggagcaaatctaaccaacaaggtgaaagatctatacactggaaactacaagacattgatttaaacaactgaagaagacagaaataaatgaaaagatatcccatgttcatgcactgaaagaattagtaatgttaaaatgtccacactatccaaagccatctatagattcaatgcagttcctctattgattcaatgcaattcctttcaaaattccaatgtctttttttttcacagaaatagagaaaaaaatcttaaaatttatatgaaccaaaaaaagacctaatagccaaagcaatcttgaacaaaaagaacaaagctgcaggcatcatattccctcatttcaaaatatattataaagctactgtaatcaaaacagcatgttattgacataaaaacaaacatcaaccaatggaacaggatagaaagcccagaagtaaatccaagtatttacagtcaattgatttttgacaaagggtccaagaacacacaatggagagaggacagtctcttcaaatagtgttgggaaaactggatgtccacctgcagaagaaagaaactgtactcttatctcacactccatataaaaatcaactcaaaagagatataaaggcttaaacataagacctgaaactgtaaagctactagaagaaaatataagggaaaatctccacaacaatggtctgggcaatgatttcttggataggactccaaaagcacaggcaactaaaacaaaaatagacaaataggactacattaaactaaaaagtacctgcacaagcaaccaaataatagagtgaaaagacaacccatggatcaggagaaaatatctgcaaaccatacatctgataagaggctaatattcaaaatatataaaaaattcaaacaaccaaatagtaagaaaacaaatcgattaaaattagacaaaggatctgaatagacacactttcctcaaaaaagaaatatgaatggccaacagagatacaaaaaaaaaaaaaaaaaaaaaaaacaatgttccccagccctgcacagtggctcatgcctgtaatcccagtgctttgggaggctgaggcaggagatcacttgaggccaggaattctagacaagcctgggcaaaatagcaagaccctctctatacgaaaaaataaaaagccaggtatggtggcacacacctgtagtcctggctacttgggaggctgaggcaggatcattgagcccgagaatttgaggttacagtgagacatgatcacgccactgcactccagcctgaacaaaagagcaagaccctgtctcaaaaacaaacgaaaactcaacaatatctctaattctcagggaaatgcaattaaaaccacaatgagctatcacctcatgcctgttagaatgactattttccttttttttctcttcaacttttaagttcaggggtacatgtgcaggatgtgcaggatgtgcaggtttgttacataggtaaacatgtgccatgtttgcttcacgtatcatcccatcacctaggcactaagcccagcatccactagccattcttcctgatgctctccctgcacccatcccacccgccaacagaccccagtatgtgttgctctccaccatgtacaatggctatgttcaaacagatgaatgataacaagtgttggcaaggatgtggagaaaagggagcccttctacactgttggtgggaatgtaaattagaaccaccattattgaaaatagtatgaaggttcctcaaaaatctaaaaatagaactaccataaaatccaacaatcctacttctaggtatacacccaaaggaactgaaattggtacatcaaaaagatatttgcactcccatattcatttcagctttatttacaacagccaagatatggaagcaatctaagtgttcatcaagtgtgcataaagaaaatgtgatatatatatatatatatatatatatatattatatatatatatatatatatatagattatacaggccgggcgcagtggctcagatctgtaatcccagcactttgggaggccgaggcgggccgatcacaaggtcaggagatcgagaccatcctggctaacatagtaaaaccccatctctacttaaaaatacaaaaaattagtggggcgtggtagcgggcgcctgtagtcccagctactcaggaggctgaggcaggagaatggcatgaacctgggaggcggagcttgcagtgagccgagatcacaccactgcactccagcctgggctacaaagcgagactccacctcaaaaaaaaaaaaaaaaaaaaaaaaaaaagattacacagccttataaaagaaagaaattctgtcattcacaacatcatggaatggaactacaggacattatgctaagtgagataagtcaggcacagaaagacaaatattgtctttaataaatgatctcactttatggggaatctagaaaagtcgatctcagaaacagagagtagaaaggtgggttaccagaggctgtagaggaggagggagagagaaatggaagatgtcgatcaaacagtacaaaatttcagttagattggaggaataagttttagtgatctattgcactgcatggagaccccagtaattaataacgtattatatgttttacaatttctaaaatagatttttgacattctcatcacaaaaagataaattggtgaggtaatatagatatgttaattagctttactaaatctttctatgatgtacacattttaaaaatcacattatacccaagaaatagatacaattaatatttgtcaattaagaataattgacaaataaattttaaagattaataaaaaatacattaagttaaaacattcaacatataatagcagatatgaatgtacacagaaatgacaaaatcccagcactgtgggaggccgaggagggaggatcacgaggtcaagagatcgagaccatcctggccaacatggtgaaaccccatctctactcaaaatacaaaaattagctgggcatggtggcatgcgcctgtagtccagctactcgggaggctgaggcaggagaattgcttgaacttgggaggcggaggttgcagtgagctgagatcgtatcactgtactccagcctggcgacagagcgagactctgtctcaaaaatgacaaagtttgagcaacattaatttggactgtaaattcttaaagaatagaaaagtcatgtttttcttctaagaaatattatgtttttacattgcaagaaatatgtgacacagagtttttcttaatctctcttttttagtatattctagacaggcaagcacatgcaatttattgagcacccagtgtgtgctaatgcaccaaacggagctttacatacattatagctaatggtctcaataactttttcattttattttcccctttcattatcgccacttataaatgaaaaaactgagctccagagcggtaaggcctattgcccaaaatattagataggaaacaacagagctggaatttgaaaccaagtttgcctaatgaaaaacatttatgttcttttcactgtacaaagctgctgtaagtatcactggtgcctactccaggccagggagtaaatatcattcatccttatcacatacaaagtataacaaaacaaaaacaagaagctctgaatactaaataataataataaatactttataaaagataaactattctctaagagtaaaagataataaacctattgtcattgtagttggtcactgaacttaactaatttcctaatggacgcagcagaattgtttgttgtttaagcaaatatcaaggcataccccccaatccctgttacagggaataaaaaaagtcttcttcaaatgcctttcaaaactaatgtgaatattaaaataaagtgctactgatctctctacattctagaaagatctcagactaacagtgtcaattaaactattacaacaaatagccatgtaaaaactgctcccctactagagctacgctatcacaaaattaaccccagcaatctacagttctagaaaaagagttggtccctcctgctgaaaaagagaaaaccaaaccctacatattttgtgaatccactgaaaataatgacataaacagcactgcacatccatcatgtatttatatcttaagtgatagctacagtctatgtaactatcgcagaaatcttcttaaactgaacaaaagcattatctatcatcctttctctctagaaaaataccagtttgtttaatctacccataacattagaaaaaatacttcttttatcatgggcaatccttatgtttcggaatttttttcgaaaacgtagacagttcataatgctctcagacagaagttaccactactaccccaaatattaagtcaaaatgtaactgaaaaaaagaaatttatctagtaatgattaatttattgaataattaaaaattaggagtttttgataattaaatgttgggaataattaaactttcactaaatactggcacaggaactgaacggatgacaacagagacaagttaagatttgttttaatcctaagttttatgctaaggtaacatcaagggctctacttttcagtgaaagaaaaatttcctttaaaattgtttccctcttccattattacttaaaagcaaagaaagtattttttctaacagtgattataggattctcaatctttcatattaactttaaggtactacatgtaagctacataaatctttcccaaatctacctttattgagtagatgaaaaagcagatatcgaactcaaaacatctaaatgttgattttctataattatagaagatattttcttttgaaatttaaagtttgtatttaggcatattaacacttttttaatctaagatttaatatgttaatgtagaaaacaactgaggctgttttctctctataaaactaacatgccttttccaattaacttagtttccttcttagcaaaagtttaacatttatatctgttgagttacactgtagttgcataatgtggaaatatcttaagatttagccacttctatgaagatcctatatttgttataacacccctcttgcccagaagaaaatacatcaacaaaaagtcctactatatgttctgcattgactattacaaagcagtagggggagcagccagagaaagctctgagacaaagcacccagcaaagcaatttaatttataggcaacagaaacatgctagagaggtttgccaaaagccaaatacacaaaataaattccataaagaagtcatgaccacatttgtaaagctggcctaagtatatttggaatgaagtatagaaaaatctgaagtctcttagaaagggtctggattctaacttcaagacagactttcagcttgaaacacagtcatttccagccatgccaaacctcaaactgcccccaaaattagagcagaaacaaaatacatttttatagtgatatgtcttgggaataactcaaaatgatttcgttttctcctttgaacctcactgaacttacagggaaggcctggtgaaatgtgcattattaggtcacaagaggataacgttacagggttccatagcataatccttgaaagccctgaggcccaggccgctgtcctgctctcctctctactgactcccatcctcaatatactttccatgagagaaaggtaaccaaaaacatggtgaaactattctgcttaaaaggtgttttactgaaaaggcacattgaccactaacccttattacatttcacatgttctaaaaattagtaaggtctgcattttcagttttagagtaaaacaggaaaagtacttagttagctcttctgtctggcattctgtaactggaatttaagaaaagcctaaacttctaattagaacttcagaatgttcatgtctgtattataccacaaaaactgtaaatataatttaagcatttttatgatacagaaatgtgcgctatagacagttatctaagaattataaaaatccatcaaacttgaagtgtctggtataaattacaaccgaatggtaaaaagacattttagccacgtaggcaaccaatgaagtttgacctaaaacccaaataatagcaataacaacagatacagtgcctactattgtcagatactatattagctagctcttttgtatatattctttggaactcttacactgacttttcaagatagttattatggtgcccattgtatgctaaggaaactgaagctaaaaaaaattgaagtcatttctctaatgtaactccattagcaagaaacaaaaccataattcaacttccaggtttgcctgcctccaaagctttgagacctcactaaaattaccctcaattgtagcaatgaggttccaaaggaaatctgtacaaatctcaggcagattaatgtgcttataagggtaaatgccatagatttaatcactcaaattaaatgccatctggaatctcttaccctacttggtacaagcatcctacatgtgttacagccaaccctagccttggccaagaattcaataattttcctgcttcaatgccatcaacaagcaagaaacatatataataccaatacaggaaatacagctagttgctcctagagcatcatttaaaagctgctaattggctaagatgccttttattgagaagtctaagaaacagaaataatgtgttaacccagtttgttaaatgggtttgaggaatcagtttcctccttcctaatacctaaatccatctccataataagtattctctatcaccatttaaaaatcctgatctcttactagtgtttttattgtgcttttcaatctattagagtaaattttttaaaacctcaagagagaacacagaaaactgtcataatttttcaaaggctaaaggagaataaactgaaaatatcagtttgaacacgtgtatgtaaaaagaatggatggtaataaaactaacaactgaaaagcaatgtttctgactcattcattcatactcaagaaatatcaaataactgagtggagatgatgcaagctgtacacatttccagttcagactgaaggtgtggcaacactcacaggggccttccgatcagctgctccaactcagtttacagcttttgtggatgtggcttattcatgcccttgttatgaagaagaagggtaactttacaacctttagcaagagcttttttttctttctgtgctaacccttttttgtctataacagtcatgtaagcttagcactgatttagaaataaataagttaaagaagacacgaatggcttggacattaaaagtttaagcaacagcttaagctgagctaagtttaatgttaaaaattagtgtgacagcaataatttttcaattcagctctgtcgtgggctaggaaaaaatatcctaatttttcagccacaagacataaacattgctagaatgactacattttgaaaaaattatcttctcactttacctagatttcattttaaccaaacagaccaacctctcctattaaacctgtaaattaactcaaagtctaatctggggccttcataataaagattttttttttaaatccctgtcttatctggtgcctttaaaagaaaggaatcattttaggcaattattatgacctaaaaaatttttaaatcttaacgtatagattaattccttgacagctgaagtcatttacaatacattattaaatttcacattcagttttaaatccaaacatagatctcaacattaagaatatggattttagggaaagtaactagctgctcaaattcatttagctgaaaaactactgtcgaatcaccttgaaaatatacactaatgcttgcacattgctaagtggcttttgattctgctcttcattttcttacacagaatcaaccacacaatagaattaagaactcaggcccatggcaaagtgctcccatttagcagttaggacactggacatattcagcatatgtctactgctattgagaatcaaattatgaaaacaaactatattttataaaactaagaatttgttactcagatgagaataaaggtgcctaatgctacagcagggggtaaaagtcccagtaagagagcaataattggtcattctgatgaggagctgtgccaaatttagaaatgaggcacaaatgacaaaaaaattgatcatcagtgtggacatgggtaggtcagtgtgcatatgggtaggttagtatctgctggccgtgtctacagagccccttttatttatttgaagccaacttttcacttgacaatgctacctacaaaagcactgttaatagataagacaatcaagtggctgttatgccgtggcctttttgtaaaaactgcatgagaacaggtgggataaaaaccatagaaaggtagaaaaaaaaaagcatcactcatttaaagatatgtgcacatagatgaactgtaagataatataaccttcttgaccttgtaaataggtggccaaaaatacttaaatatcttgacgaggcaactattactaattgtctcacaacattaccagtccttactggctgaatccttcagccatctgcatacgacatgcacaggcaaatagccactaaaaacatacacaattccaattatctccttgcataactaaagacaaaaagaacaggaaatccaaaaaatacagcaaaactgaaaacactataccttgccttccgtgctattttaaggctgtcccaggctgaaggttacttctcagccctcaaaactccattaactgccaagaccagcaccttagcacatatggcacagatgcctagttgaagcctccttgtactaaatgacctcaaaaaactgggctttctttccaagattaatggaaacaaaagtaatgatcataaggaaccttctaactctgttaatgtttcctgcggatatgtatggccaactgaatatataaaggctcagttcttgcggggtaccctgacaactagatgaattagggtgaaggttccaagttcgatgaactcttctgagtttgagtgccctaggtggtgacattcaagtgatttcacagacatccaccaattcttattttcaaccgggaatcccaagaacacctttaaacatgcaatgcccatggaccctactgggtttctgctgcaagggctcagtgttacttaggaaccctgtgtcttgggagatacttaaatttagcacgtcaaattgcttttggaaaatgtttatctggcgtgactaggggaggcaaagcaaggaaacaggaacctccctctaaggagcagaatagccaacatgcagtaagcctaaaaaacctctcaatttatttcccggggctatgggtaccagtggctcgccggcatgggaatcagcagcctgggggcaccagtgacagcagaaccggggcttaccttgttggaggccatctcactgacggagtgcctggtctgtagggtctctagctggtccagacaccagtccagctcctccagggtctcgctggccagtttctggtaggcctcctctgcgaagagacagggaaagggggactcagttctcaagcgcttcacgggtccgctagcgagttcaaagggggccatcctgccataccccgccatgctcggatgcccggtgccggcacatgagggctgctccttcatattgcccagcccggcagtgcaacgggggcggaggctgtgctcgcggggcggccggcctcggggaggcacggtctctccagcttggcgtctcgggtcggcctccagggagggcgtgcaaagagcggcgagccaactttcacacagcgacgcgagcggaaaaaccactatgcgacttttcaactgtgcggcgggcccgagtcccagtccaggagcccggctctagcggatggcgagggggtggcgagcgcgcttgggtgcccgccccgcagaggagcgtctggtccacagccggatctcctcggtccccaacccggagccgcggccccacgcccgccccgcctgccgagccttctgcacggcacttgaagtgaatgaatcagccgcggccgggtgcgcggccaccacgtttcctgttttctttctcaactcctcgggcggcaggcgcagcgcggctccaacgccgcagctttccgggaacactccccctcacgcccctctcggccctcggcgctgcctggctcctcctcaacccccttacgaaaagattccgaattgcaaaagcctgtccctgtccgtgccacccgccgcgtccttcccctcgagctctgccccgggggccccgccacctcgcagtgccatccccccggcgcagccgggcgccactcgctttgaagtgcagacgaggaggcgcgggcgcgagcgtgtgtgtctgtggggctgctgtgggactgtctgtgctaggagagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctccaggttgcccagaccgctggagcctctgcgactccacgaccggctgcttcctgcgaagtttcacaaacaaggttatttaggaccctcaaggtttctgagggtttaagttttagggtttctgggggttcgtttctaaaggcttaggattcacctacttcaaggaggcagggttgtgggaattaagaccgcattctttttctacccagcccagtccctactaagtaccagacttctaaatgttggggcggacagaaacaagcaaacaaaatatacaatgttgtggggtcggaacgctttataattcacaaatttgacaataggctgcattttcatatgccgaattgcctaagagttctcttaaaggaacagcaatgtgaaagaaccacatggtaaggagaatttacgcatgtcctgcatactactcctttcccctgtgaattgcataagacctagatgatcttgggccaaggaagaaaatctggaagggtgtttctacccaccatgtgcagagtacactacaattttgagaaaacggaaagaccatattcaaaggcatacagaaaagcctgttctgtttacaaaggctgacccagggcaccagggacactgtccctaagcagatcagttgtgggagaacttttctacattagcatgcaataagcaaaccattcatagtgaggagaagtcaaactcccaagggtccatttgataaaactttgtcattgtcgagtggaaagaagatactgagaaacttacactaagtggtgggatcccttgtctttgtctttgaatctacaggtattggagaagaaattctgcccttgaaatttagactccataaattaacatggcacaacaaataaagttcatggactgaatttaggctcctgggatttttgagatagctttttatgtgaactttgtaaaagttagagtaacttttaaagtagttgttacatgtgccacgtggcttattgttatcaagaatacttgaactatttactgttcactttgagtactctaggttaaaatttgcctcttttttgttctacttcctccaccccgcagtctatgtaaatatatactttagatggacaaacaactgcctaaaccttgccaggtgaattaaagtttcagattgaagcttttttttcccccttaacaagcttaaagatattaataattttaaatggtaaatataaaatacctgctctgtatagcttccccaattctaagaatgtaaaaaatattacatgcttgttataaaaattgaagcattacacacaaatataggaagtccattgtaaccccacaccctaaagatcacaaacaatactttcgcctatggctctaacacaatcattttcattttactgaataacttccatatgcaagtatagcatcacctagttgccatggtagtgcatctactatatggtttggttttgatattttcctctctctctcattcccataatataggaatgtaggaaattttaagaggacattgacttgttttatgatcatttgagctgtccatagttagcctatccagtggattaaagatgcataaccattgtgtctgggatttgttcagtgccatcttttcaatcattggttacaatgaagctgggagtcccctctgaggttcggctttctgtggctcctctcccctgcactccaactttctcaaagcctgagcctcaagtgatttcccagtagctaagtaaactgcccccttcctccatcttcaccaagttcccaaagctgttcagactcaggcttcaaatctaacaggatgtggctccacacattatatttcagttgttattttttaatgtggaaaataattcaggaaagttttggctaatgcttcaagacatcatgcactttatacacaggatttgttcttaagaaggtagtatagtgacaggaggaacaatttacttcagaatatccattttatgtccaagccatgcaccagccacttttgacagacaggatttgagtatgatgataaaatggggtaagcatatattttaagttctaacatctgtataaataagaaaaatgaaaaatcactggaacacatctacatgctagtgagaaaataattactaacagagtaaagtttgctctgtgaaactgttgctcaaataaagaattattcttgatattagcatagagctgagaatattgcttttttccaaattcctaggtgagtaggcaatatagctagccacgatttttcaggatcatttgtaaagcttcacttttaggaattttaaccccaagtgttctaagacatcaagtaactgaccttttcatcccgccgaacaaacctcaaagtggagttgccaactatcccacaggaaattgagtcaccacaccaagcaacacacctaaatgtcgacagctagcaggacaaaaacagtgagccagtttaattttggcttttaccaagaacacatactgcattcattaataaaatacttcccctcaacccctgccagagtagtatacactgtggctctccttaaaaatacatgaaaactctttaactgcaccaaatcttgctaagtcaaggaactaaacagagaaaaacacccaagcaaaaactattggctaaactccctaaaggctgggagagggctatggaacagcaactgagaaataaattgagccttgaaggcccctgctacaacagcatcagttttcttcaaggcacctttgaactatgtaacacccgcattctgctgaggctcttctgtgaacaaacagtcctcaattcttgcgggccagcacttggcttctgtcacagtgatatgcttagaggttcccctgacacatggcctgaaactgtgccaggggctccaggagaagatgctgaagaagcagcttccttttgaaaaaggaaaaaagtaatcacctcagagccacagcagttagctagaggttgaggtcattttttgtgaaatgttcagtccattactcttacccacaactcacagtgatgttgaccattgaggtaaaaggatccactgtacgggatgtgtaactatgtggacattagtttctttgccaacacttgaaggtctgctaaaggactgtatcggcttgtcataattcctagatagacctattggtatacatgaagagaacaagtccaaaaaataccacttattttggacactatttgtatgcccttaatttaaaaaaaaaatacaaattataacagctgaggtcgggcacagtggctcacgcctgtaatcccagcactttgggaggccaaggcgggcagatcatgaagtcaagagatcaagaccatcctggctaacacagtgaaaccttggctctactaaaaatacaaaatactagccgtgcatggtggcgggcgcctgtagtcccagctactcgggaggctgaggcaggagaatggcgtgaacccggcaggcagaggttgcagtaagctgagattgggccactgcactccaacctggacaacagcagaagactccgactcaaaaaaacaaaaaaaattataacaactgatccagattttttttattattacactttaagttctagggtacatgtgcacaatgtgcaggttagtttcatatgtatacatgtgccatgttggtgtgctgcacccattaactcctcatttacattaggtatatctcctaatgctatccctcccccttccccccaccccacagcaggccccggtgtgtgatgttccccttcctatgtccatgtgttcgcattgttcaattcccacctatgagtgagaacatgcggtatttggttttttgtccttgtgatagtttgctgagaatgatggtttccaatttcatccatgttcctacaaaggacatgaactcatcctttttcatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagacccttgaggaatcgccacactgtcttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtcatgatgagcactgatccagattttttaaaaataaaagaactacaacaaaaagctcctaagagcaaatacttaaatctccctaaccagttccagcttctcttctcttaattcttacaaaatttcccctttgttctacggaaggaattgatactgtctacagtagatagaactggaaaaaatgatttctgtttcaccgtgtattgctttgagctagtcattcctttagtttgctacagtaaaagatttgtgtaggttaggtctaacttttgctgacttaattttttttcctctatacattttatctgatgggaaatacatgaaggctttggattctctttcaatgtgtacatgtaataggtttaagcagagtttgctagtggcaagctgctctcatctccaagtgtatttctggcatcaaattattgttttgaagtattttaaaattgtataaaatatataaaactttatttagtacttcataaagcttccaaaggaaagatgtgtgcaattttgtgacggttttctttttcttttatcttctcactaactacaattgtttttccgaatgttgcctatgcctctagtagaatttttatatgaaataaacatgaggttggctttcattgacttttagtcccaccagtaactcaacatttatttagcactgactatgtgccatgcactttattagaggctgcagaaacaagatgatgaaaagagtgtgtcccttacccagagtccagcagaggaggtaatttcagcaaacaactgtagagtgcactctcacagaaggaagcatgtgggctatgggacagtaaaagaggactatttaaatcagacagggacagaggtggagtgggaaaaggctgagtcctcaagaatgaaataaaagagagtgggaaggatttttaagagaaaagatgagcaagcacacagacctatgatgaacaagatgtctgtgtcggccaggcgtggtggctcacgcctgtaatcccagcactttgggaggccgaggtgggtggatcacctgaggtcgggagttcaagaccagcctgatccacatggagaaaccctgtctctactaaaaatacaaaattagtcgggcttggtggcacatgcctatattcccagctacttgggaggctgaggcaggagaatcgcttgaacctgggagatagaggttgcagtgagcagaggttgcgccattgcactccagcctgggcaacaagagcataaaaactctgtctcaaaaaaaaaaaaaaaaaaaaaaaagatgtgtgtgtcaaaaaagaaataaccatgagtagggccttgcttaggggaacagattctggagaaatctgagaaatcctcagccactggccatctcaaagactggccatgtcaggcatctgcaggtaggactatatcttcaagagtaggagtcacagagtgactcagagtactgtgtgacatgggatctgattttattttatatggaaaattctagtgctatgcaattaatggaatttaagaaagtaaagttgaagtcagtgcaaccattatctttgaccatattaagaataaaattaaataacttatagaccatttgcttctctgacgattattcttatctaagacaatctctgtattaaaatcctacgcagacatatgttcccacaatatgtcaggtatgaacagaaggactgcccaatgtgacttgaaagggagtggacttcttgctcttaaaaactacaaccttgtagtcactaacttattaatcatactgtaataagatggagaaaaaaacaatggaattcaccagaatttctttcacgagagtctgcctgcattaaaatgttcgataaagctatttatgacagaaggtgagactttgaagagctttggtttgggtggaactaatctgtgcctcatctacacaggaaaggggaggaatatgccagttgctagagagggaatatgtatgtgtgtgcatgtgtgtaagcgcatgagagagcgagagaatgtgtgtttgtgcacatgcatgtgtgtgtgtgtaagagaaaggagtcagcttggtctctgtgtgtgcatgtatgtaagggcatgaaagagtgagagagagagagagaatgtgtgtgtgtgtgtgtgtgtgtatgtgtgtgtaagagaaaggagtcagcttggtctaaagggtaactccaatttgtacatttttcctttctcccaatcatcaataaggttattgaagatgtgtgtgtgtgtgtgtgtgtgtgtgcatataagagaaaggagtcagcttggtctaaagggtaactccaacccgtgcattttccctttctcccaatcgtcaataaggttactgaaggtacaaaatcccgacttgttttgttttgttttattcattgaagggactgagcttgaaggccagattggcccaagcagaaatgtctctctgagctgacataagagaagagtcaaagaaagaggagaaagcttttataagaataaggaggccttttgtccaaaaaattggagtttgagctaagtttaattaggcatctaggttgggggcttcatgtgacatgtgtgcaactgtgagtgatattattctttgaaagaaactggaagagtggagaaagattccaatctctattccacttcatacaagcaattccaggcaattcagctactaatctttctagggccttatttcacctatagattggagataataacaagagccttgtaagttattttagttcaagtgagaggttgtgagttaaataatcttgcattgattgcctaatagattcttttcccttcctcctccattgtatcttcactttctcctggactcaagtctctaacttaaatgcaaacattctattaattttagtgagcctatcaactaatacctaggtataacctcggggtccagaaacttaatagttacctggaacagtttttagggtagttagaaagaaaaaagaatttcaaggaatgaacagggattcattctgaagaagttcacttagagaacacaggccattcaggaagctacaaacaggtagggatataaagtttagatcagacagtggacaaagataaagatggagaactagtcttggaggacttgtatactattctaagacaatattttcttctaaagaggccattaaaaatcttctaagtgaggaagtcacatggtcagatttgcttttcaaaaagattactctgggaatagtataaaggcagatcagaaaagtaaagaccagttaagaggttggtgaccagataaggagaaaatcctaagcagtccctgaaggggaaggagaagctgcagaaagttaggaggaaaaactctcaggagcaaagaaaaaggaaatgtcaaaggaaaatattgttatggactgaatgtttgtgtctctccaatattcatatgctgaaatctaatccccggtgtcacggtatttggagggaaagcccttcggaagtaattaggtcatgagaatggagccctcatgaattagattcgtgccattataagaagaggccagaggttgctctctttctaccatgtggatacatgctatgtgggcagtctgcaaccctgaagatgccctcaccagaacctgactatgctgacaccctgatctcagacttccagctcccagaactgtgagaaataaaagtttgttgtttaagccatcagtttatggtattttgttatagcagcttgagctaagacaaatatcaaggctttgccattgatattcagtacagaccgtatatacccacaggtttgcgctaagataattttcattccaaacacatatttcagcaacacaagactaaagagggtgttaaagaatgctactgaggaagcttttgtctgggaagttgtttgaacaaagttacaggacaatttttgcaaacaggtttaaaaaaagttacaattatgtatgctatttacgtattcttgttgtaattttaggaatcaattttatttccctggggggactgtaggagagcatctgtgtttccatcatatactatcaatcttaggatataacagtcttttgttcttcacctttgtcaattactgcatacagtattccttagagaaaacaaggagtttgaacagattatctttagcacctacccagctctaacattcatttattatctgatttctgaaattgtactatctgggttaggtgttggttttaaggttgttcattatagttagcctggatggggtcagctatgtttgtagagggaattcctaaactgaccagttacttgtcaaggatcccatccaataccatgatcctggaattctgtgagtttagctcaactgttcttcaggggtacatgttttctatttgaaattgaggtattctcagaaataaagctattaataaatagaaagttctggagtatatttacactcactctgcttatctccactcctacccctaccatattcccatccaatactttgccagttgacttaccaatttcttcttaatttctgtaactgtcaccttcagtcaaattctcatctgtgtatttctagattcatataatggtctactactggatctccttggattcactttttctcaacacagtcctatttataaagtcagaataatcttccttaaaccctggttttattgtttcattcttttaagaacctgctgcacaactctctcctacttattgtattaatgtcacacttctgttcacataggcctttttcggctgcttttcaatacctttcccttttatttacatctaagactatcccatccaagactgcccatcttagccaatctttccacctggaaataatttgctggcttctgcctgtatgacttttctaatgtcatttttatatttgtgtctaggcctttctataactgtctagaaaattcctgacatttacaggcactcagcaaatatttgtgagtgaataatcagtaagtatgcttgttttctatcagataagaatatttatttccaaacgagattcaaacagtaatactggcctgggtgtggcttcctacatgtaatcaccctcgtctatctcttgttctcagtcttttgctttcaaactctttctctttttttaaaagagtattaggaactaacattgccaaaatttggtaatggtcaagcagatcatggtgtcttactgaagtgaaatattaacattaaaataaaaatgacaagtattatggtatatcattcatatgtaatgatccttacaaaatagagtaaaattttaaaagaattcaccaatacaccagtatgatgtttgggagaaacagatgaatgcacaaaggtgcatctgatgcaaacacccccagaaaaatgagcataagttcatattatcaatatttttcactctaaaagtgttcactgacttccctgaagtcaccaaggactccaagttaagaatactttcctgagtgaagaaaagaaagcaattattttaatcaacactgccccagaatcttttattcggaatcgctatctctgctttcttcttcttcttttttttaactttctcataaatctctgtttagcatttatatctctctcactatgagatacctaagggttaagaagtaatgccaaagagacatttgtccagttgaagactgggattaagaaaaaacacacagccgggcatggtggctcatgtctgtaatcccagccttttgggaacccaaggcaggtggatcacctgaggtcaagagtttgagaccagcctggccaacatgatgaaccccatctctactaaagaaaatacaaaacattagccacgcatggtggcgggtgcctgtaatcccagctacttgggaggctgaggcaggagaatcacttgaacccgggaggcggaggttacagtgagccgagattgtgccactgcactccagcctgggcaataagagcgaaactctgtcccaaaaaaagagaaaaagaaaagaaaaaacacacaaaagatttcccgaaaagactaggcccttttaaacaggctatgaacagagtctcagaaaggtaatttcttatgtacaatttttaatctcattacttgcattacaagcaacacatatgagtgataaactattttggcctactggtaaacctacatttgttaactgtgtgtgcattatagagaacaaatttcagaactcaagagtatatcggttatatttggcttatccagttgtatatgaactggctccatacacgaataagataaattagttttataattttacaagaatatctatggagatttagatttggctaagaaagttattatacacacagaagaatccacaacctataagagctcttcatgggaaatagtgtgatagatcagaaagagcatggacttttgagtcactcagaacttgaattccagccttgccattgttctagttgtattatctgaaataagccatttaaaagacctgagcacattgtatacattgagaattacagggttattatgagaaatgcataagaaatgtaaagtaccaagggctgtatctgacatatagaaggtattcaatcaatagtaggtatactgaaccactttgcagagttgtttaaataagttaattttaaataaggtagttaatatttgagagtttccttccttttccacagattctcaatcctaaaacagttactatttttccatcatcaccatcaaccctcaaatattaaccagttctgagccaaatgtgagtgaacaacctatgatttagaatagcttttagaccaggcacagtggcttacgcctgtaatcccagcactctgggaggctgatgcgagcagatcacttgaggccaggagttcaagaccagcctagacaacatggcaaaaccgcatctctactaaaaatacaaaaagtagccaggtgtgtgtggcacatgtctgtagttccagcttcttgggaggctgaggcaggagaatcaattgaaccctggaggtggaggagatggtgccactgcactccagcctgggcaacagagtgagactctgtctcaaaaacaaacaaacaacaaaatagaatagcttttacaagaccacaccaaatcatgaaaagtcaactatgtaggaagaatatgtatttgtcattggttaatgacagagcatcacttacactgaggttactgggaagatcatttcaaacatttcccaaagaatgttccaatcaatattgtccttataagattctccttactaatgacgttttgtggtcaaacaagcttgggaaatattgtatatgtaggctttttacagtgatttctaatggacacgaacctaccaaaagctagaaggtccacagcaaaatgagatatttaattttattaacaagcattatctaaacctgtttgattttagaatgcatttttcacacaacaactatcacctcttgaagaatacctggaataggttttcctatacctatacctatatgtcaggtaactccaaaacattaacaaatacatgtgtttagtaggttcccatatggttgaaatctccactaacgacattttatttctcttcctcctgactttgtatgctatcgagaaatggtcagagagtaatcttcctccctccctttcttcttttctttctctctttttccccctgaaagagaatagtcaaaaaatccatacatatttattgagcctctctgatgtgatagttgctgtgaaatacaagaacatgaaagattcagcagcctgggcccaggaaggaaccataataacctgctgagaaaatcagacacatgatcggctgctgcctagagacagtgtaaggtagcatataaatcattcagcctgggagtgctactgtagttcgagcagggagagggaggtatggactatagctcagtgtgctgggtttcaggaagaaggtgaacttggatgtaggtcttcaaggaagactgtggttttaatggctgtgggaggagggagtccgctggcattgttttcaggtgtaggaaatgtctgcagcctgaataaaggttgtatgtgtggacagtaaatgggctgggtggagtagacacattccagggaggagaagggatatagagttgaacacttaaatgtgtggccttgagctagtggatattgtgggaattggataagtgcactggtagcctaagaggatagaatggagaagagagaaggatggagactaaggagctattgtggtagtccagatgcagtggaaagcaaagagttgtggaggtatccactttagtggtctacgatgacagttacaagcaatagaaagagtatgacttgggaacagtggttcaaatgctggctctgcaacttagcaaccatggggcaaatttgggcaaattaacttctctgtacctcagttttcttttttgtaaaatagggctaaaaatacattccctagaaggtggcctccaggccattttcccacactttatttgaatgttaaaactaactttaatctaaaaatcatatattcatatctctatcttttttggcggttcagttcaacttaaatgtgttatttgttaaaaacttgtaattatcatctattacatgtaaaatataagagctgcttttaatagtaattcatctcctccctatctttttttaaaacatggtcaaaattaacaaaacaatcttgtatttttgatactagtagtggtatcactactactagaggtacaaggactcttgtacctctctgaaaagtagcataattagcaacagtattgatggtatctgctattttagattatttaaactgtagtcactaaggtaagcaaggggaagaaggcatgtcatttatgtgtttttcatccttaagattagcgtttggaagcatatattattccacagcaatctggataggtcttgccatgccctgatcttgtaagcccaaattttattttgaatactccagctttgcacttaaatgacagctccttgataaaagaaaaacaattgcctaacaattttcttccaattgtctgaaaacataatgggtgtacatacacacacacacacacacacacacacacacacacacacacacacaatctctagggcatatttactagatagtattatgtaatgtgtagacatttttaattatgataattaagacaaaaatatgtgtagcaagtttttgatttgagacaaatttgagatttactaaaattattatatgtgtgtccttctgaagacttcatattttcattatatatcttcattcttgaagtataactcttaaattgttgaattaagttttatgaattaagttgttttgttttttgtttttttttgttgttgttttttttttttggccaggcacggtcgctcatgcctgtaatcccagcactttgggaagtcgaggtgggcagatgacttgaggccaggaatttgagaccagcctggccatcaaagcaaaaccccatctctactaaatctaatcttgtgcctcaagcgaggcacaagactcacttgaacctgggaggcagaggttgcagtgagctcagatcgtgccactgcactccagcctcagggacagagtgagattctgtctcaaaagaaaaaaatttttttccatttttaccaataccactattctcaattcatccactatttcactaggaattactaattcagtttacataatttattcaatgaataaattattcaatgaagaagcttctgggtatttaggtgctacatgctaatttcaattggcatattttgtttttcaaatttgttcttggtgacccaataattatacctgtccaccttgaaagtgtctttcttcatcaccttcaaggccaccgctaacaagacctttgaaaagaagtaaacagtagagaatttcaacttctgtgatgaccaccgtcttcttctgaatccccagactccactcatacaaggttttggggaagtttaaatgaaatgaagcagtggcttacaaagtttattgacagtaaactacagtaaaatttatattttatactataacctggtagatttgtttaaagtaagaggtgctcacttttgaaggcatgtggatgctggctttcagtaatataaaaaaaatgtacaaaaaggttttatacctatatttatttttaaaaggtagaggagagcagtggactcctatttaaagaaactcttgtgttttataaataatagtcatggcaaaatttgtttacagtctttaacaaaccatgcatttcagtataaattaaaccaataaaaagaattatatatataaaataaaaaggaaatgtatatataggaacagtatataccatacacataagagtaaatatatattcgagccaatacagagaattgaaacataatttaacatgaaataacatttatccttactatgtatgattcactctgatgttttctattttatttaattttaaagtattaattgtgaccccttaaattgattttgaaatctaccaattggtttgaaaacactgaggtaagaaattaccttgcttaataaatgttagttttgtttccctcttccctcttcctccctttttataattaaaaaactctccctctacttctctacttcacgtgagagtagaacacataaaaagatttcagttaactactgtgcatattttttgaagtaatttctccataatgtgtgagttttctcagggtactacaagtttaccaacagaacacataaagcagcggccactcactgaaatgcctataggagacagatagaccatatgaatgaatgaatgacatggttgctgggcatcctggttgcagtggctagaactgtggagggtaggagcagaccaccatatatcctaggcatttcattggcaaatgaacaggagaaggacacctttccgtttggccctcattttcctagatctttcctcccttcctctgtcaatccctcctacatagcctatgttcccaaagcaccccttgtattataataataattattatgatatctgtccttaatcaagaacttatactggatttttaatgcctttaggtcttccccaaacttcagttcatctattcgaagtccctataaaatctacctccttagacttgtctgcccccattattcccctgtggttgacctcacctccatctctatcttttgtcagcaagtttcctcagagttccctctctgcatacttgttcatgctgggttatttgtttttgccacttgatcatctagacctttttccctctttccctccttctattcaatttctgcctttcactgctgtacaaaggaggggcagggaggccctccagggtggagggaatcagtcttgagataactgagagattcagggtgatgagtcccaaagttgaagagaatccacatacttcttctgtttttgttttacctagcaaggagccttttctatagacaaagttgggaaaccagaggttatgacgtgattcatctttgcctacttaaactttagcttgattcatcacttctcaacaaatacttgttgaaccccaccagtaatacgagaagcttggtattctatgaggtgctcaacttccaaagcttagttcagaagaattctggcctcaaggcgtctaccatctagaagcaaacaactaacaaatgaacaaatgcagtgatttcaaaagaaattaaggtgtgctgtggtagaggcatgcacaggtcagaaaagttcagaggttccagacaggcttcctggggaggatatccatgccccgcctccacctggtagttcatgatcagagtttgcaagcttggctgggatagagggaatagcgtgtgaaccacagaaggagtggatctggtggctcagacacggcaagaaccagctcatggcactaggctgcaggcacaccatgcacaaaacagtcttttctttccccagttctccaaattctctaaagtggaagcctaggggtgagggtaagaaggaggtaggaagctacaaccactggagcaaaggacgaaagaaggggcttgagtgtctaaaagtgcagaaactcaaccgactggacgctgagacaatgtttaaaaaggagtttttttgtttgtttgttttcttgtgtttttttttactttaagttctgggatacatgtgcagaacgtgcaggtttattacataggtatacatgtgctatggtggtttactgcacccatcagcccaaactaggttttaagacccgcatgcattcggtatttgtactaatgttcttcctccccttgctcccccaacccccaccaggccccagtgtgtgatgttcccctccctgtgtccatgtgttctcattgttcaactcccacttatgagtgagaacatgcagtgtttcgttttctgttcctgtgttagtttgctgagaatgatggcttccagcttcattcacgtccctgcaaaggacataaactcattcttttttatggctgcatagtactccatggtgtatatgtgccacattaaaaatgactttttaaagtggcaactgtgggaggcaaaggagaaaaaacaggagctgccagataagggagtgaagagaacccagcactttgagaattccgttacattttgcagcttgaattcttcactttttgctcccattatgtgcctctttctcctctccatgaactgggccctgtggacccaggatcctgctgtctttgcagggcaaagaatggttagaaatgaattcattaaggtgagaaaccattgctggcataattctccttcacggaaacctggcacttaaatttaacctgtttggttagatccagctctgcctcccccatttttttctgcagaaacaaggctggcagatccctgttcctcttaatccttgaatggaccaaatgctgggttatgctggggcagtgagggaccttacaaacactgaaatttaagagaacagtttttggagtaaggcagtccttgtttccaaatctgagctttgccactgattgactagcttggcaccttataaaagtgaattaacctagcttgttttctaatttataaaatggagaaagcagtacctatatcacagtatgattctgaaaattatttaaataggactatgtatgtaaagcagtgcctgaaaaatagcaagtggtcctaaagtcactatgatgatgaattttatatgcaggcacctagagcatgttaggatttttgggatctttcccagctcacactgaagcttcactcttctccaacagtctgttatccaatgctggataactgagatagtcttcccagcatttatcaatgtggttaggaacagtaatcctggaaagcattctcaaattatttatctaattaaacaagcaaacctttttagcccagacatcctaaatctctgtagcttgtcttcgctgatttggtcagaatagctcagatggtaggaagggctttctgggtagaaaaaaataaattagcagtctggaaaacaaaagatctctgcttaaaagagtctctaaaacagcctgatcagcctgtgtattttgccatattatctagcattagtaggggactgggaaaaatccagggctccttgtagagatagagactggcaaatattatgtttgatgcatgagaaccaaatcagaagttaactctttaagttattaaatcactaaacagtctatcacaattatgtgtttattactagactgaatttctctggggctggaaccataatgaattcattttttgatctctggtgctaaacactggctgtcatatactaggtatccaataaatgtttgttgaatggaactgaaaaagcatgaaacacttcccctgttaaggcttcttttctataatatttccatagtttctaatgcatctgagaatcattaactggactgttagaggaatatgaatatggttgagggagctacaaacttcatgctctgagatgtcacatgattagtgtaacttttgttccaggggagagaaatccctaagagagtgactgttctccatgcccacccacccacagtgtcctatagagcctttcattctccagatgcctataatgactatcacattgatttgtttacatatctattgccttgtcttccttataggtacagagtccatacatcctaattggcctggaacttccaaggtctatgcctgttataccagtgtaattatgaatagcattgcctttcattctaaaaagtgttctggtttgaatgctaaatcatctagacaccctacttatgagagggttcactgtacatcgtttagtcccccaactcccctccccttggaaatctgggtactaccctctaccgggggctttccactatggaggcagctctctcaatcacagcattcaggaggtgtaagtccactcccaacagaacagacacctgtctacaaagagactcttggtggaagaaaaaaaaaaatcacttccgtaagtttaagtcttccttttaaacttgggtctcttttgcacatcagaaacaaagaatctctaataattacatccctaaatgtactgaagtctagaagacatgcccatttgaaaactctaatctagtaattaaagcttctcaggttaaactgcaccttaataatgtagcttattttgtcaagatcagttaaggccctgtaatgtgatttggaataaatggacagacagaaattaaaatgtgctggacaaggtaatcagaaatctcacttcatttagtcaataacaatggcaattcagcgggttccttttactactgggatgtaattgtgcttggctttaatttcttgtaatgatggaacaaattaaattacttcatacttttaggaacatttggctacatcatgttttggtgcttccataaaccccactggaaattaaatcagctctgtggttgctcattctccctctttagtgccatgtctgccttctgtcagcaaaatggtaatattgtctaccttaatccaccagatgcagttgagttaaaagaaattacctctcccacctctttcctttcaaatctccctatttgtagctatcaaattttggcatgcctgctggaacacagtcttgttagaacaagcacggtaattctctcgtgagactttaggactctctctacgacaaggtcagaatgtacctgtgattcaaatttagatgaggatatgagttggtaagaacatgaagagcatcagacagttttcaggacacccactacttttattttgtgctatcagtttttcctttcccaaattgcaggtggagatgcaatctttaacgctggaaatctcttgctatatgccattaaaattaattagtctagcacattttatctttaggcccttacctagggcaggtaaaatattctagcacaaaataacacaactttcctgaacaccatggctactaagttcatatggtaaagattatactatacattaccttgcaaatagagtgttgcagactgatattaaatatttaaaatgtatgcaggattattaataggcaacattgtggcagagactgctaaatgtcccctaatattgatgcttttcttcatcacttgttttcaaatacctgttttcatgtaagcatgtgactgcccaaaatagagaaaattcacagcctccttggttgccaggtgttgccatataactaagttttggtgaatgagttggtagtagaagcgttatgtagatattatatgatgtgctagaaacttcccttaagagaaatttgtcatctatctttttatctgcctgtatttattgttttctctttcctactggctagaatgtgaagttgatggctggagtcggagcagccatattggatggtgagttgaatttagcaacagaggctacacctcacagtgcaataagatggaaagagcacgtgtccttgaagactgtactggatagaggtgccatattaacctcggactgccaactttcagattttacatgaaggagaaatatctgtcttccttaagccacttctattttaaatctctctatttactgctgaataaaatctcaactaacgcaaacaccaataacaaaaaattcctattcactcatgatataggattataccttagtcttttttgtgtcatatatctgttcattcaccatttttgctttgatgttcaataaacatctcaaatttaacatatctataaaaattttttaaattttacgttcaggggtatatgtgcaggttagtcatataggtaaattgcatgtcatggggtgctggtgtacagattatttcacaccgaggtaataagcatagtacccctacagcttagtcttaagaagaagtatgttcacataggccaggctgagacttggatgttggatgactttcttccagcttactctgatttgaatatattgtgtggtagtagatggctaaactgcttgctccaaaactatctgacaatgctttttagaaagtctgccaaacaaaactacaagaatcaccctggagcttcccttaggcttcagatatttgtcttccctgccctacttggaaatcattccagcctggaagtcattgtgaggaaccaaaaaatggtctccctaccatgaagaataacactgcttccattgttgggaggctctccttcctacaggcactgtccctcactcattagacacttgaataataaggatgttcatatatttattggtgttggtatcagttagacagttgaatgatacaaatgttcatatatttcttcttattcaatagtctcacaagaacactattcttgtaaagtcattaaaaactggatggtcttttcataattatttccatgatttgtcatctaaagccagtgttctctcctcctgtcaatctgatagctttaaagctaagttctgggtgggtccaagtcatgcctgaaaggtttatcaaatgacatattgcagtcatatggtcggagcacaaacacctctgaatgtacaatattttaaagcaaaacagtttatgtgtaagctctatgaggttacggaccatgactatcttatttattaccaaatccccagctcctagaacagtgcccctcaatataaatctgtcaaatgaataaacgaagagtttgcctgcagtagtaaacttgttatttgcacacactcgaggcccacctctatgtgtacattgtcagtgagtcagcctcgtggatgactctgcaggactgtctgtataacatccactacagttaccaggggacccaattttcataaattgctccagcatcacaccctcctcttacagagactcttcctgtccattctaatccctgacacgttgtcatcctcactcagattccccaatagatagaaatgctgttaaatatacttgggtagagagggataggcatgctcaaactcgttttgggaaaaaaaattgcaactgtcagaaatgtgttagctatcttcacagattatgaaacataaatatcaattatctgttcacagcagtgaaagcctgcatatttttttaagatagcaagtataaaacggctataagtaccatgttgagtagagacctaccaccgaagtagagaccttcactgaaatagtgaagggatggttgtgttgcagggtcagaatgattacccactggttgacactccctccaggactaaaggcagcatcaccagcgtccactctgcttctccactgcttactgttaaggagcaaggcaatagcattatctaagtaggaactacttcattctttcaaaacctggaatcggctgatcagaagaagaaaaacagtataaaaatacagaaagacaagattctctggctgtcctaatgaatgctagctagctataatagcatggataagacatataaccaaacatataagatctattaattaaggggaatctctatttgtattaactcatctattttctctaaaaccagtatttagttatctcccatacattggcatattgtgtatatttgcagaattcaaaatgttactgatgtgacttttttccatcagacatctgagctatccctcaactaatagttgagctgttcctctatagctcagtatctgagttagaactcgaagtaaaaaggtataaataagtcatgctataaaattcaaaggcaatcagatgtttgagactatagttatacagaaaagtgtccttgttcttgggaggaatacatcgaggagtttagggatagagggctatgatgtgtgcagttttctctcaggtggttcagagaaaaaaagacaatgtgtgtgtatgtatatttgtgtgtatgtgcacatagagtgatactgcaaatgaggtggaatgtttacaatgagtgaatgcatgtggttttttttttttttttgcactacccatgaagctttccagtgtgtctgaaataacttccagataaaactttttttaaaggcaatcagaacagtggcaatgaataattcaattatttcatatttgagctgtctttcctgccacccccaccccctataacactacatacatacataggctcacataagtgacacttactatacttttttgcctatgtaatgagtgttggcgaagtacgtgagtgggaaattcagtcttttgcattcaagctctaagtaattctaagagaccttttagataatgatttgacttttaagacaacaattttgaggttataatatgatgtcatttcatataaacagaactgcccttttgtcctttcagatttgattgaaaatggcccatggagtacaaccacctgggaacatatcctcgagaaagacagttgaggcttattgcctaaaccacaggctactgaaaacttggccaaaggcgactactctagactggtgacttcaaaagtgctgatgaatacagtgaaccatgaaagatgcattatttgttttgaacattttactatgattgatgacccagatttggcaagttagttcactcccagtggagatgaaagtttcactgccttctttctttcaacattcttgttgagacagatttcacttttattggccaatgtactaacaaatcacttgcatttgcagcataatgaattcattagcaacactgtggatcaatgctatacataatattcctgagtcaacattaactcttaattaaacttccttattataatgcctctggaaattttccttcaggctactaaacttcaagccaacagtctaagtgttaatcagtaatcatgctagtaactttttgagatgggtcagggccagggccagggtcagtgatccatcatgaatggcaggtttaaaaatggatatacgtgatcaaaaatacccataagttgaccaaagcattctaacctttgggttattctaacactcagtgtatcagccttctgagcaagccaattttttattgccttaaaaagtctaaaagaaagataaaaacagagataatcagttttgtttggcaatggcaggggtgtgggaaatgaaaaagaagaaagttaaagatgagtgaaaataggatagtcttggcactttggtatgaaattgaagtacttatttaaactgatgaatattgtacagaaatatacagagagcagtgaggggctaagaacctaattccaaggtaactacaaggaaaaaattattgatctggattgtgaccagaattcaagagtttgactgttgtcattgttgctgttgttattaagttaaaaaaaatgagaaaaaaatatacttttttctagtatacttaccaggaaaggaaagagagaaggagggagggaaggagggagacatggagggggcagagggagagagagacaaagacactgacaaagtctggaaaaagacacaaattcagatttaagatcccaaaatatgctacatttctgcccccttcaaaatattaaactttgctaaaatacactggaaattttttttattgtttattttttaaatcaactagcagaccaattagccaagatgatattttcatccttggtactctttcaggtgagctctgtgggctaccaccagaaagtcctagccaaccaagctctcactgggtcactctgtgctagctagactacatagcctcctaaaaaagcacgcagccctgatgctggtcctgccaaagtgtggtttgctgtcatgtcctacaggctacccgtttcccagtgatttatcataataaaccaaatgggaatgaaatacccagaaatatgccataaatctactagtggtgaattttcaatattctgcacaccatggtgatttgttaattcagttggatctctattaaacctctctaaaatgtcattaaaccatctgttttgacttgttaatcaaacaacttttaaaaatgtatttagagtatcagtaacccttgaattaatgcatccatcagtaataatcccctctccaactttagatttatttttaagctctagcttttttccccaccattccaacaaatagcctgacttccaaaagtaagaatcaatcacttcagttgtagaaatgtccagagggtgccctactttcgaaacaggaagtaacttgatccagcagtcccacttcttggtatatatccaaaagaactgaaatctggatcttaaagagatattttcactgcagcatatttgtaatagctaagatacagaggcaacctaaatgtccatcaacagatgaatggacaaaggaaatgtgatatatatatacacacacacacacacacacacacacacacacacacacacacacacacacacacacatatacaatgaaatattattcagccctaaaaaaggaaggaaatcctgtcatttacaacaagttggatggaactggaggacatcatgctaagtggaataaaccagacacagaaggacaaatactgcatgatctcacttacatgtataatccaaaatagtcaaactgatggaagcagaaagtagaatggtagttgccagaggctgggggaagatgggaattggtagatgtggtcaagggttacaaagttttagtcttgcaaaataagttctggaaagctgctgtataacataagtatacaatcaacaatactatattgtatacttagaaatttggtaaaagggtagctgttatattaagtgtccttaccatgaaaggaaaacaaaacaaaaaaacccaaaaagatgggaggaaacttttggaggcaatgaataagtttatggcattgattgtaatggtggttttagggtgtatacctgtctccaaacatcttgcagaataaacatattaaatctaaagtttccttgggaaagaagatgagaaaataattgtcaagagactgtacaccaataaaatagtcaaggagtacaatgaaaacttaggaatcccatttcttcctttgactcacactgtttgatgatatcattcacatcggcatttggaagttattgagacatttcaacataagattgtccttatgatctatgatttgggactctcttataagaaagtccattctataccaatttgttttgttccttggtaactagaccttctttaattggatctaagaattaatattcctatctcataaagaagactaaaaggatccaagtagatggagtttcaaaggtggtccccataaaagcatttttaccttaagcaaagatgtcccaatttttcctgcttgcttttcggatgctgttctaaaaaaaatgtaccttattccttctactaaaagaaaacctatcaattcattgattcattgaacaaatatttattgaacatgtagtatgtactaaacactgggtaagattccagatatgcaaagaggaataagtccctgcccttaagaaaactcacagtgtggtcaagctaacaattctagagcaactgtgtgataagggctccaaaagcacatgcaggaacacagagagaggcactcttagtcttggaggggcttcctacagtgggcaatttttgatgtgtcacaaaaggaggagctattagggcacaagaagagcaagggtgaagtgcagaaaggagtgaatagatggggaggggacccaggcaaagagaataacatcagcaaaggtgcaacttcatgggaacacagtacatttggaagcctgcccaccatttgttacagcagaatgcatgtgtgggtggagatgaggctgcagagatgggctggagaggattatgagagatggatgactagcaaaggaagttggtcatgtccttatgtggtgggggaccatggaaagatttttatttataagacgtggtttattcttcattctgtggcaaaaagcagatactatagtctgaatgtttgtgtccctccccacattcatatgcgatgaaacctcatcaccaatgtgatggtattaggaggtggggcctttgggagataattaggtcatgagagcacagcccttataaggggattagtggcttataaaggaggcccaagagagctgccttgccccttccaccatgtgaggacaaagccagaggcactatctatgacccaggaaatgagccctcacaaaataccaagtctaccgtgccttgaccttggacattctagtctccagaactgtgagaaataaatttatgttgtttataagccacccagctcgtgatttatttatttatttatttatttatttatttatttatttatttagagagagagttttgctctgtcactcgggctggatttcagtgccatgatctcagatcactgcaccctctccttcccaggtgcaagtgattctagtgccttagcctcctgagttgctgggattacaggtgcttgtgaccacatttggctgatttttttgtatttttagtagagattaggtttcatcatgttgcccaggctggtctgaaactcctgacttcaagtgatctgcccacctcggcctcccaaagtgctgggattacaggcatgagccactgtgcctggctatgatattttgttacagcagcttgaatggactaagacagaaggaaaaataggcctttctgtagcgtgagctgaaagacagaaaatagccataggtttctaaagagagaaaaagatatatgtttgacaatatgtttcaattagtactttttttgaaatgcagtaagttacctataccttattccatttctaatctatatgatggcatttaaatattgactaggtttctgatacagtttttggagtctgaatgtcactgcatggatgaataaaccaaacagatcggattcatatgggtttgccaaatgacaaatttttttccatgtaagattagaggaaaaactgatttcacccaatttcctgccttatttatattagaactgaagtcaatgctgttatccctttgcatgttcttttgtatttaaaatctgatatagaattgtgctgttacagaagaaataatttaatgcattctgccctcttatttctcatgagttttcatttaaaagaaaacaaaaaagaaaaaggacatggacttttctttatttctagactttataaactttttagttatcaaataaacacatgtattaattaagtaggtaaaatattgcatatattaaaaggtacttggagactcatatgttgtcagtttttcatgactcaaaatttatgaaaaaccatctaagactatcgtaatgaagttcaattgtagatcttgaagtgacaaaacatgaaccacattgacttgaggtccagggcttaaaactgcctatttgagctctaggttaaaagcatgtgtgaaatgcaaagtctgacatctgcacagctgactattgtgaagtctcagtatcattgttcataagtaaagcttgtccctaagccataccacaagcattcccagaggatatagatttcatttgatttaacatgattgttgatattggtagtgtatttcacgtgaacttgtgaaatcattgtctatacagacaattgagacactaaaacttttttttaagtattttttgttaggggctagatctgaggttttttattcatttgttcttttgttcactcatttgttagttcagttatttactcaaaaatgtatattgagcaattcctatatggcagacactgacagatgctggattcagtgatgagcaaagcattcgtggtttctatgcccaaggatcctatcccgtggagtgtagagtcaagcaaagaatgtcaacaacaaatgaaaattttaatcttattaatgttatatgcaaaaatgtaacacctccaaaaaagacaatttatttcctattaaggaatgaaggcagtccactgaggaagatcaacatgtaagcacatgtaaagcaaaataatcaataggtaatgtagtttttgaaaaagaaggggctttaagcaggaagtcctgggtttggacttgggtttcaaatctagctatgtactcttgggccacatacccaagtcttgtaagtctcagtttcctcctttttaaagttagcctaaaactacctcgctcatctaatggtgtgagaattaggtaaacagccaggtagctcatcaaattgtaattattataattgttattttttgagtcatgaaagttttcacactgaagggaacatttcaacttgacctggaagagtaagtagtttatcaggcagaaagaatttgttagggtattccagagagaaggaacaaaatgtgcaaattcaagtagtcagaatcaaaatggtttcttaaaggaatgacaaacagatcagtgcagttggagcctaaagttatctaaataatccgttagaccttttctttaactgataaaataaagcaagcattccaaaaatcaatttaaatccatcttcctccttatacctctccattccccataccatggaaacacagttttacctcttttacaatgagttgtcagcatgaagagacttggttcattaagattagcaaacttcacagcattgaacaaaagataaagaaaagtttatagcaaatacgttccatgtgaaagcatctccagcaggttcagaagatgcaatgaaaagactaaaacttgatatagggatatttcagtggtgctcgtaccagcgtcctaacattttgttctaccttagtaaaatctatcccttattactcatcctatctgtagactctcttatggaacaagaagcttttttttttttttccctaatcccgtggggaagccctctccttccctgggtgattcctgagcaaccaggaaaacagcagtcacagtcaacacagctagtacttgcagaaaatctctcttctgtgatgctctgaatgactcacagttccagatggccttgtcagcctttatccgcattccactcttggcaccattaacctggtctactgtggttgcaacaaataacttttcttgttatgaggaccagtgttttgaaaaatttaaaatgttataaaattaaaatgtttatatttggaaattatttccaaatataaaaggagcctgtcttcattatagattatttggaaaaaatgcagaggggtgcaaaagaaaaatggaaacaagccatcttttttttacccataattctaccactcagagacaactactgtgaacattttgatgtatttatctccagtctttctagaaggtagatcactgtaagagatttctgaagcagaagtactaagtcagaaggaataaacatttttatacctcttaatgtgtattgccagatagtttttgagaaatattacagcaatttctacttttagaagtactgcttgagagtgatgttacatggtattctcactaacacatatacaatgttataaatatgtccaaaaataaaacttagcaactatgttatctccttgtttcaatttgaacttattacaagagtgatcaatttttaaatttaaatgttatttttagcaaagttatagatgcaaatagtttagagaactaagtagtaccacaaggattaaaaaaagagatctcctgcagtgcatcccccacccacaatacatacatgtatcttccactccccagagggtacccattttcaaatattttagctgattcatttgctatactccactctatctctaaatgatataactttacagttacttcttaatagttcatttttttgggcattgcttattgatacttcatagcggaagataaggatttacctttgcaacacttcacacttctcatcacccatccttctaatatattatagtcttacttagattgatagtcattgtgtttccatgagcagaaccaaagaaaaactataagcagctaaactatgtaacataccctgattacctttttttctttgttttccttcttgaaaattcttgtcttttgttagtttctttgttcccttagatgtccatatatacttatcactaattcaatcccaaacttttcccatattacaaaaatctaagtatggctcaaacacatcaagaattttattaaattcatcttcttgaagaaatctcatccagaggcctctttgacctggattggttattctccatgtctcttgctcagctgtcactttgggatgttctttccttattatcccaagggtaatgtttttagagtttattcccttgttttggtgagcacgttttccagtagcttcctgagtcagtatgcatcagagatacattttttaaaggctcgcacctcagaaataatctttattccatgctcactcttgatcaatagtttggttgagtatagaattcttggttgagaatcactttccttcggaatttaaaaggcatcacttcattcttttctaggtttcaaaacgaatcttcagaagtctgatgcccttttgatttttgatccttctatacgatacgataatgatccttagaacaagtcacaagtctcttttttaatactttatattgtgctaaatgctccaattaatgagttctggaaatttttcttcaattttgtcctcctgcagttttctcttttttctagaatttctgattttagatgttagatttcctgaactggtcctctgatttcccactttttcttctgtattttctacctttttgtatttttgctccatttccatagagatgtcctcaatttacctttcaacccttctattgagtttttaacttattctatcatgtttttactttccaagagctcttttcctattctctgagttgttttttttttttccatagcatctgcttttgtttcgtggaagcaatgttaatatttatgaatacaatatcaagtgtatttcttctcctctctctgatgataccttcttcctgcaacatctgtacttttttatttctcttctttttttttttttttttttttgagatggagtctcactctgtcacccaggctggagtgcagtgggaccatgttggctcactgcaacctccatctcctgggttcaagcaattctcctgcctcagcctcctgagtagctgggattacagttgcctactaccacgcccagctaatttttttatatttttagtagagacggggtttcaccatattggccaggctggtctcgaactcctgacctaaggtaatccccccgccttggcctcccgaagtgttgggattacaggcgtgagccaccgcgcccggccaacatctgtactttgaagttggtctttttccatttgttttggtttctttcacttactttttctaagtatttgataaatcttatctgtctactcatatttaaggctagagtactaaaaatcagattggaagctctgtttgcataggtaagatttgtcaactacatccactttttgatgatccaactgaacagtttcattcagaaataccttgcaccattatctttgggttttttctcttgggttggtgaattctccaaaggttatatcaatctcctgtccagaaggcttaagcatagttggaagctgactaggggaagaaggttgggactttcaaccttcggaattcattcaacaaatatttgagcatctatatttggcagcctctattctagccaccggagacacagtggtaaacagaatttaaaaagccttgtgttatcatgaacacaaatatataagtgtttatttaatccctctgttttcagaatggcactcagtcttcaacctgcctaggccccccttgtctagggacggttttacattcatcaggaagtataccccttgtatacttgtttttcagcttccaaaattttgttgctgttatctcccttcccactttctttgtccttgtcatttatgcctataaacatccattgatggttttctgaaggcagaggagttaaatggatatgttaattactatagatgtaatcagaggtcttcatgttgtttttttgttttctgttttactattctaacttggcatttatagatcttctttgtgagtagtctgaatttgtctttaatgatttaacattgaaacagtattttccttacttatttgcataagctctttctttgttagtgtattagccattgacctgcaatatcttttaggatgaccgattctgaagcctgctgactgagttgcttgtggttcctgtcatttagaatgtatgcaggtcatgaatcgcttagatggaacagatggaatgaaacttgctctaaatattttaccaaaataaatacatttaaataatgtaaagaaaaatcttcaatcactaggctttgaacttataacagaaaggtatctgcttttaactatattaattcaacaaactttattgaacagttggtaagtatgaagcatcatctctctgagaacaaaataccaaggaactgagtcccatccttacaggattctcaggagtaaatgggtcaatacatagttataaaatgatgagggctgatctatagcagaagtacaaagctgagaacaactcacttgacctgctaagctggggaattcaggaagggttcagatctaaagagcagacatttgaggtggttcttgaaatatgagcacaatgatggttttaccaggctgcaaaggtgacaaagtgcattccaggctgataaaagagggcatgcaaaatatggcaggtacaaaaatgtgtatttaaggaagaatgagaagtttctggaagttgctgaagatacagaaaataaagtggggggcggggggggcgggtggttggagatgaggaggagatggtaggcttgattcaaattatggaaatgtatttataatgcaccaacttgtaaagacactgttgttccctacccagcagccactagaatttgttcaggtgtcaggcggttggtgcttcaagggagatcaggcccctcccaggaccaggatgaaccatgattacttcccagccaatttcatagcatttctcttgccaatgaatggcttagatataagcatatgatgaatttgtttctaatacagatctgagaaagaaatctgttaaggaacttctggtaaagtttttatctttcttaaaaagtgacagaagaaaaggaagttgtataaatatacttagagctgctgtagtcatcttgagaccataagaggataaaactgagatcaaaaactactgtgctgaggatgggtgactagaaagaaggaaagaatctggattcttgatgcatgtttgtactactagaatcattctatcactaccttcttattatataattcaataaatctcttattatttaagctattttaaatgaagccttctgttatatgcagcctaaacaaatatactgattcaagctcccagcaaattctgtcacacataattcaaggaacgtttgttaataacttcatactattatatggggaataaatgattagtcaagaaagactttctgttttgaaaaattctggaaagatgataatacagtatgtagatttattgtcatggctaatatacatctacatataacatgaattaccttggagtagtaataaaagggcagagtaataacttgtgcagagccctagactagaaaagttgaaaatataaaatggaggaaaaagtgagttatgagattcagtaatatgaaagtataagaaataaaagaatccaaaagccatagaaggttgaaactgaaaagaattttagaaagcgtctaggccaggtgtggtggctcacacctgtaatcctagcactttgggaggccgaggcaggcagattgcttgaggccaggagttccagaccagcctggccaacatggtgaaacctcatctctactaaaatacgaaaacataactaggcgtggtggtgcatgcctgtaatcccagctacttaggtggctgaggtggaaggattgcttcaacctagggaggcagaggttgtagtgagccaagatcgtaccacttcattccagcctgggtgacagagtgagacactgtttcaaaaaataaaaagagagtctagcctaaaccccttaattatacagattgaaaaccagtcctggagaaattggaagtcctcaaagagtttaccattaatggtggaaccaggacttccacacaatgttctgacttcctttagagcactttttattatatcatatagttccttacttctcactattaatagagattattttactaagagtaagtataataagagctgatcagaagacctgagagacataatggagtttcaattctaatttgctgttggctccttgaaatgctttgttgagaaggagtaaaaagcttacaaaacacacacacacacacacacacacacacacacacacacacacacacacaatttcttaattatgtctaccatgggcatgggatggtaggaatgccatgtaactagtttccatggatggaaaccacctaatgggaaatagagaaaaagaaaaagaaaagaaattgtgtgtaaattttcagctcattttggcttagattacatgatgaaacttatttctttgaaaaactcatttgattttgaattagattatatggaacttctcctttgtcaattttaatttcttgtcttgttttagtttgcttttctgagcagtagatatcctcccaattggagattccgcaaaattagtacttagtcatcttggttcctttcaagtagaaaagtttcttttaaatacttcaaatcattggtatgcacatttgttgcaaaaaaaaacctcattctggaaaatgttgcttattttattatccaaaaaataggtatttattaatatactgcatttcttttaaataaaataaattacagattttcttccagcatccacttatttggaattgggtacatatgaagaaaagacttcttataatatggaattatttcaaaagctattattacttcttataaatataaagcatacaagaaattctcaccattttctaagatttacattagaaagatataagtattgtcttttagaatactgtttttatttttctaaatattccttataacttacttattaattttatcctttctttgttataaatatccattttttttaaagacccatactatcttttcctatgcaatttaacctaacatattttctgtaaatgaggttatttagttatccatttttctacctcctgttgcttggcagtcctcaaaaccattgcagatctttctagagagcagtttttaagaacagtgctttacttttcaactcttgatcaacctgatgagaattctttgaataaaccagaaggaaggctaaagagacaaaagaatactatagtttccttaaagttaatgagccagaatcctttggcccactttggcattgaacaatgtgaataaaatggccactctcacatcagtaatttacattttatacagtgtgtactttacactgatatttacaaagaggaaaaacaacagttttttacatgtaagaggagctccttggcagataaaagaaaaacttactcccattagtacaacactggagtttaaatctagagaacaagtacttcagaacctagtagaaaaagtccctgatttgtactttgtatgaacaattaggtttgagaatattgctatataatcacagaaaatactggctattatactacgtgaagtcttcagtgacaaagagagaaacagaaaaaatagttaatgccataacaatgaaaatgtggaatgtgaggaacgcccagtgaccgtaaatatctaccttaataagcctgacaatttgtatacagttcatgcaattaacaagtgtgataaatatgattattactctcaagttgaaatcaattttcttggctaaaagcaaagaattgttattgagcagatgggattacttttctttgccaatttatcttcataaaactcaatcaatgccttgccttaaaaatgtcaaataactcagatttcaggataacacatacaaactaatctcttctgcctgtctctacctgatcactccctacttcaaaagctccaacaacatagtataactgacacaaatcaaagcaaaaactatttttctcactgctacatggtcttatcaataatccagtatttcaatatctaataaaagataccacaattcaaagcagtaatgtgccccaagctaccgatccacaacatatatattgatatctaaaaatatatggatataacttgttatctactaaataagtttctttgcagtgtggtgttaatagccagaattttaaatacataaaaacttgggttcaaatcctaactctgccacttaaatgctatatgacaattggtcaagttacttaacctctctctggtctcaagtttcttgtctgtaaagctgtaatagcttttagagtgctcttctgaatattaaaaaggcattatactcttagcataatgtctacatagagtaaatatttaacaacaaaataacaaatattaggtgtgttattggagaattggagttttaaataaaggagttgtccctaaggtacattcaatttaactatgatatttaaaacttcaatttttcacattatttttccaggaaaatatttcactcttatttctccataatttgttttgaattgtaaaagagatttgcaagcggctgaagcagttacactatactgtatatctgcaggatgggcaactgattttttttttcttcttttttttttttttttgagacagagtctcactctgttgcccagactggagtgcagtggtgcgatctcgctgcaacctctgcctctcaggttctagggattctctgcatcagccccctgagtagctgggactgcaggcacacgccaccacgcctggctaatttttgtattgattttcaagatttgtcaagagctcctaatattttcttttctcaaacacatcttaggactaccatgcatatcagtcagtcagctactctggaggtctgctgcaaggatacacaccttccattcccacccatcagatacttgtctcctttctcccccactccaagacagcaaccttccagctctagataaaaagagctagtctttcttgcataagaacaacaaagacaaaaaccattttggtagtgtatactgcagattttaaccaaaacttctctgaagacctctgatttcctaaaaaacctcttcatcccagtgcagttgctctttcctaaatgagcaaccgcgcatctggtcaaatttggtgaatattctgtgctccagaaacaactgattccatcccctttaatctcttcttctcttatatccatctccctccttgttgtttctctccatgtttacaactagttcattgatttaaaaaccaatgtaatacacaaggaagtatgcacgacaatgtttagtgtagtatggtttgcaatattaaaaaaggccatcagtaagaaaatagttaaaggataaacttgatatacatactatgctgcaatttaagaaaactggtatagatttatacgtactaaaataaaataatctccaaaacatagtaagtgcaaagatcaatcacagaataacatctgtagtatatcacttttgatttttaaaaattacccctaattctaaatgttcatatatataaatattcagttaaaaattctgaaaagatactgctatggtttgaatgtttgttccatccaaaactcaggctgaagtttaattgccattgtaacagtattaagaggtaggactcttttttttttttttttggtgacagggtctcacttcaacacccaggttagagtgcagtggcatgatcatagctcactgtggcctcagcttcccaagctcaggtgattctcccacctcagcttccagagtagctggaactacaggcacatgccaccatgcccagctattttgttgtatttttttgtattgatagggtttcttcatgttgctcaggcaggttggtctcgaactccttacctcaagtgatccacccacctcagcctcccaaagtgctgagattacaggtgtgagccaccacatccagcaagagttgggacttctaagaggtgttaggtcatgtgagctttgccctgatgtaagggttaatcctgttatcactggagcaggtttgttataaaagagtgagacgtttggtcccctttcctctctctctcccaatctgtctatctctctcccttttgctttctgccatgtggtgatgcaacaaaaggacccttaacagatgccagcaccttgattttagatttcccagcctccagaactgtgagccaataaatttcagctcatgataaattacctagtctcaagtattctgttagagcagcacaaaatggattaaggcagatatacaccatattgtatccatcactaagtggatactttcaagaaagacagcaagactaaggagcatgaaaaaggactttctcatattctgaattttaaaaatattttatgacatgaatatatttatctattacctatgtaataaaactagacattaagagaaaaatctcatggtagaaatcttaggaaatagagaaaaattagagaaaattaagaaaaagcatgcataatttcacaaaccaatggtagccactgtaaaaaaatgttatttcattctaatacatttctacacacatatgcacacagtgcatttttgaaaacataactgagtcttttctaattgacctcttactctacaaaatttgaaatagccaaaacaaatttttgattcctataaagagatagcactagagctggaagagatggctcatgcctgtaatccctacactttgcatgactgaggccagagaattgcttgaggccaggagtttgagaccagcctgggcaacatagcaggacccatctctacaaaattaataataataataataataataataagctgggcataatggtgtgtgcctattgtccttgctacccagaggctgaggcaggaggactggttgagccctggaagttcaaggctgcagtaagctatgattgcattacactctacccagtgtcaaggaaaggaaaggaaaggaggggagaggaggggagaggagaggagaggagaggagaggagaggagaaggggaatgggcaggggcaggggcaaggcaaggaaaggggcaggggcagaggcaagggaaggggaaagggcactaggacctatgagccaacataggctatggcttccactagtacaacttaaaactcagctgaagacatgacacatagaaaagggttgctgtgtctgtacacacacacgtttcccatgttcccaatcccagtctgtggtcagtgaaagtgaagattgcctcagagcctgcattatctcaagctactgacctaattgctaatgctttactctggtctatttcctgcatgacctcagaatgtgtcagtgtaaattccatagtaagacagtagttgcacattttggagtgtggattctgctttgaaacacaaataagtgtgatgaacgtgaccctggcactctgtagccctcagtttcctcaacgctaaattgatcactacagttccttctagtgtaaacagtcccacgaagaatcgtgctgaatggatgactacataatggcctgctcctagagttcttaaatcaatccttaaaactggctgcaaaatgacttcactcctttaacagtgtgggacttgtctctgttctccagaatgctcaccagatggtgaagaagtatctctctacctaccaacatcgtcatattgcttcttgccactcgctactcaaaaactgtgaaaaacctgtgggagcaagtatcagctgaaaagggtggctttctccttaggcaaaagctacagggcaaaacgggggccccaaacttctatcacgtcaaagacatgaaacagatgatccctagttttgatcttctttgaagtttattaaaaacaagcttgaatctgtaccaatcctgacaggtgtgaatgtaagactcacaaatgagaaatgctaagctttcctaatgttcaatttaatcttatagaccatgaaacatgttataattaaagatctgaactattaatatgaaggagatagcatatattcttaccccaaatatgactaactaggtaaaatcttcaaaatataatcatggcctgattatcagccattgtggaggagaattttaaaaagttcttcattgacatcccaagtttatgttttagacacttctaatcaaacatgaatagattaacttcaagtaaaaattaatagtcacattattgattatcatgattggaaatgtatttgaccagaacaatgaggaaagagcatagagtcctgctatcttcaagtatgaatttacacttttaactgatgtcaagtcatccatagtatgaaaactcatttatttttatttgaaaaatttaaaaccatcaaaatggatagtgtgggagccaaataatatataagcaatattttatgagaactacaaaactattaagagcagtaactagaattcggttactgccgttccttatttcagaagagaaagtcaaatgttttctgatatttaagaagtaataacttcctgttgttcagttatgctttctataattatatatgataagcaacagaaaaataggtctggttttggctgtaatgtgtatattcaattcaatattaatttggactttaaatcattttgctatcaaatattttgaacctcatgaccaggaagtaatcaggtaaaaaaaaaaaagaaaaaaagtgggtttgttacctgacctatctcttaagttcaaactttctataggtatttttctctacctttgtccatatggttatacaattatcactagatgcttgaattactaaatggttttgtatatcttttcctcaaatttatatttgtcctattattggcttagtctctcaaagtattacttttatgatattgctataatggtcctctatagtataaagttgagcccacaccatttatcctgccacttaacaatgtccttaatgtagattatatggtttggccatgccctaaccaaaatctcatcttgaattgtaatccccataatccccatgtgttgcgggagggactgggtgaagataattgaatcatagggcagtttcccccatgctgttctcatgataatgaatgagtttcacaagatctgatggttatataagcttctggaattttccctgctggtgcttactctctcctgctgccctgtaaagaggtgcattctgccatgattataagtttcctgaggtctccccagccatgcagaactgtgagtcaattaaacctcttttctttataaattacccagtctagggtatttcttcacagcagcatgagaatggcctaatacagtagtatatcacacttattaaagagttgatagtaaaatagcactctcagtacaataagaatagaatagttccttttcatggtaatgaatagcttttcttcgacatctataattaacaatgaaatcagaaacaaaaagaagctgtctccactattactgaatgttgctcagaaaattctaacgtaagcaaccaaacaagaaaaccaaatatgctgtacaaatatttttaagagagaaggaaatcattctattttaagataaaaattctgtaactcaaaattcaggagaatcaactgaaaggtataaaaaaggtagaccattatgatttataagaaaggtcaaacattataaagcatgtatccacaacaggtttttttctatataccagttagaaaatagataaatgatcctattcataatagtaataaaacatatcaaatatgtataaataaacaacgaaaaatgtaaaactcttgtataaatattattgcaaaacatcactgaaggacatttttaaaaacttgaagaatatatctagtttcctacatgggaagagtcaatattataaagatatcaagtcttagattaatctatgagttaaatgcagttacttttgccctaaaatgttaaaaggctcttaattatgcaattcgaaatgtgatgtctactttcttcttgaaagcatttttcctggaaccttctgatgactctaacttaggctgcctgctttctaggcctactactacacagttgtcatactgggatttattttcataaacatctgggttggttccaatgctctttgtatcctaggttttctgtataggattcccgttgctttgttttgcttgaatatatcttcgagtaatacttccttttaattaggaagaatctgtaggaggtaaagttgtaaacttgagtccttccatgtttaaatacatctttagtttgtcttaacacttgatagtttgactatcaattttgggttctagttcttcttcctgagaactttgaaaccttgcctagtctgcattcacttctaatcttgctgatgagaagtttgatacctttgaaagatcctttttttttgttctctggaaggattaatttcttatacttagaattccaaaattttcatcagcatgtgtatacacatctagatatgtatccttttttccttgttcggtgttggatgaaacttttcaatctgaggacttgaattactcttcaggtcaaggattttttttctgttattttcccacatcctttcccattcctccacttctaccacattcttcatatcttttttacttttccatcatattttatatccttggctttttgctctatattctaagatatttgcttaattcaatattcaagaatgaatattacttgaattgcattttatccaatctttatatatacatatatattcagtattctgctatttatggaaatcagatcatacttaatggttatattctccccctgaatatctctgaaaatttaatattgacaaatttttcccacacttttcattgtctctgtttcttctggaaagcagaagataaattgtctcaggaaaataaatttgtcctgtttatttattagttcctttttgtttaggctactggtttttttgtttggtttggttttttgtcttttttcaaatgtctggtgatcctttcttgactgggaatatttgtaatttaagaactaggagtttcttaagtagttggcagggatatcataaggagctctgtagtacttataaactgcttataagcaacttaatgcaatttcaatcaaaatcttaatgggtttttttgggggggacttgacaagtagattgtttgtataatttagcacaacgatgtgagaataacccaggaaattctaaaaaataagattaagagggaatatgttctcccagatattaaaatgtatttcttaaaatccataataattataacatggggctttttgtctagaaataggatgtaaagattaaaaaaggaactaaccataaacagtagaagtggcatttcaagccaataaggaaataatagattatgtaatacctaggattctgacaatttagaaaatctaggaaaagaacatcagagccctgaaataaagtaaaataaattccataattattagagatataaatatatgatgtaaaatgattaaatactagaagaaaatattggtgttggaaaagaattgctaaggatttataaaatatatttatatagagactatataaacaatataaacatacaggctacatagggactatttaaacttctatttattaaaatagagtatctgtaaaagtaaaaatagaaatgaataaatggcaaaaaagtgtaaaaaacaaacataaatgaaaagttaatattcttaatctctaaagaacactctaaaatcaataagaggccaggggtggtggctcacacctgtaatcccagcacttcgagaggcagaggcagtcagatcacttgagtccaggagtttgagaccagcctgggcaacaaagtgagacacctgtctcctaaaaaataaataaaaataaaatcaacaagaaaaaacaaatcagcccacgaataaataataaaataataaaaagcaaatatgtataattgccattagacacacaaaacagattttaatattcttgaagctaaattaattcttattaaaacaaaatactatgtgattcatcaaataaagagaacaattaaaatgataaaatatagcaacggaaataatgtagaaatagagactgctgatgaagtatatataaactttctgcagggcaatatgacaataatagcaaaaataaatctttaaaatattgggcaattctttagtttgacaattctaattctagaaatatatagtaagaaaacaacccagccttgctataaagactctacacaaagatattcatcacaatagtgcttataatgtgaaatctggggagagcttcaaatatttaataatagaaaattgcttaagtgtagtatattcatgtaaggaaatgccattaaaatgttatatagagaattgtatttaatggtaagaaaagtgttcatgatgcaatatactgtgaaattttaaaagcagattataaaatattaccttcagtataatctcattgttgttagtaaaactccttctctctctacatacacactctcacacacagagacagaaaaattatctctcaatggcataattattgacagttcgttttctcccccttgcttattattattttgtaatagatatgctatagccactcaataaatatttgttactaatttcaaaaagtatgtattattatatccaggttgttcatggaatttatcatgcaaacaactaccctcttgagagagtcaaaagtggacactataaattatgaattcatataaactatatcaggacaatgggcataaactgagtgtcccaggcacggcaaaatgtgcggataccctggagatgtatcttgactttaagaagtttacaatctttcttggggatagaagattaaaaaacatgaaaccattagaaataatctcccacaattagttttgtaaaagcaagtgcttaattgtacttgacaaacattagatgttactggaggtctaagaagtaagagctgaatactcgtcagaaaagctccctggaggaagtggggactgagtgatacttttagaataggtaagaaaaagaataatgagaacttttcaaatggaggttggggttgtagaaggaaaagaatcaagtattcagaggtagctgataacgatgttgtatatataaaatcaccctgacttttgcaaggggtccgtctatacagaagagtaaaaagtaaacaatctattaacaatgtactatcactgcctccactttacacaggagaaaatcgaggctttagaaggttacataacctgccaagggtcacatagctaaaagtggagagctgagatttgaacctaaggagttggtttcagagtctatgctttccaccctatgctgtactgcccactacagtcaagctctggcttcttgtataaatctgatgtcactctttgtgggactgcttataacatttcctcacccagaatccatacctcctcctttctgctctgtcagagctctttgtctattcacacacagttcaaagaataccttctccatcaaatttttctaacaattccaatcttggaattctctcctaccttggagttgagaacaccactctcctaaatttctgcctacttctcagccactacttctcaatctctttgttggattcttctttctctatatttttgtttttttagtctactcattgcctgtgtgagtaccttcacccccaaaactacaatacctacctaccattgtgctgaaaaccccagcttacattgctcttccacattccataaatttctatctggatgtgcacagacacctcaaacttcatatttccaatactggcatttaccctatctgcagtttttactatcttatggacagcagatgccagaaatctaatcactgaaaccagaaacccatgtacaattcttgagtcctccctctctcaagcctaaaatcctggaagtcaccaagttctgtctattttactctataaataactattagattcttctttcatctgaactcccttagttcaagccctctttgtttctcatatgattattgtagtaggctctgaactggttttcctggtacctgtctttcccctgcctactccaattctacctccacatcaacatttctcaaatttgaggggtcatagacttccaaggacatttccacaatccctgagaagtatacagtttccatatgagaaatcactgtagctaaaagttaaatacttttcttcagttgattatgtatagctaaggcaataattcaagcattagtaaatacaaagccaaaatgcaggcacattacgcagaaaatgcctgttcttgggtttttaaaaaatacgttaaaaaaataaggccagatgtggtgactcccacctgtcatcccagcactttgggaggctgaggtgggatgattgcttgagaccaggagttcgagaccagccaagaaaacatagggagaccttgtctctacaaaaatttttaaaaattagccaggcacagtggtgcgtgcttatagtcccagctacttgggaggctgaggcaggaggatcgtttgagcctgggaggtcaaggctgcaatgagccatgattgccactgctctccagcctgggtgacagagcaagaccctatctcaataaataaataagaccacaaaggaaaaaaattcttacagagaattattgaagtataaattgtgtcaaaattgaagaatataataaaccctaagattaatagtcctgtccttgagaaagatcatcaagtgatgcccccatgctttaaaaaatattccaagctttttagcataatatctaacatttcttagcagttcctaataggttacttctctgtagttacctctctcactccttccccatcacctatagtgccacaatctgtaacctgtttgaggctctctcacacctttcatactgcaatatttgctcgaactattgacccccaaccttactcatctttcctttctaactaactaacttctcctcatcctcaaagccccagctcaagaattttcatttctggaagaatctctgattttcttctcttctctagtcttgaaatggtatgtgtgaacccacagcttgttgtaatgtcattgtcctttctgtttaacaccctcagttgctggtccttgaagtctgggactgtcttaatctactttaaagtcttcaagccaagtacaattcctaggcatgcaatacatgtttgttaaatagatggatgacctttatttatatttatctttcccttttctgctacaattagttaactcattcatttcttcattcactaataaccacttatctgttattttctgggaatacaaaaattcataaaacatcatccttgcctccaaaaaacactttattattgtgccatccttctctctctttctctttctctccttctctaattatctagttgtgtaggtattttcttcaaaggaataacaggtactcagaggaacacttatacactgttgatgggagtgtaaattagttcaaccattgtggaagacagtgtggcaattcctcaaagacctaaaaacagaactagcattcaacccagcaatctcatttctgggtatatgcccaaaggaatataaatcattctattataaagacacatgcatgtgtatgttcattacagcagcattaacaatagcaaagacatagaatcaacctaaatgcccaacagtagtagacaggataaagcaaatgtggtacataaacaccatggaatactatgaagccataaaaaagaatgagatagtgtcctttccaggaacactgatggagctggaggccaatatccttagcaaactaacacaggaactgcatgttctcacttgtaagtgggagctaaatgatgacaactcatggacacatagagggaaacaacagacactgtgacctatcagagggtggagggtgggaggagtgagaggatcaggaaaatcaactaatgggtattaggtgtaatatgtgggtgatgaaataatctgtactacaaaccccatgacacaagtttacctatgtaacaaatctgtacatgtacccctgaacttaaaagttaaaaagaaataaaaaataaacagaatagtagggattcattacaatatcttctctcctcctcataattcttaaacctgtgtagaagttcaatacatatttgtggaatagccttattacgcctttagggaatggagcaatgccttgcctattaatctatacttctatcagagtttcctgctgtatggaaaacctgagtgttacacttcaaacaaatgaggcaatttatacatttttgttgttgttgttgttgttgtttttggcataaatgtgctaagtgagctggagtttcagaagagaaactgaatgttatatgtgaatccaggtcagtagcttggctctgactacaatactgatttcattcaagataaggaaactaattggtatcaattttagttgacattatatgttagttttataatattcaggaatttttgaaggattatttgatttttatttttatagatgttcttgctctttaacactaaataatgaggaaagataatagggctaacatttattaagcatttatgttggacaggcactgctttaagtatttttatatgtatcaactcattgaattttcacaactcttagatctatttgatagctggggaaactgaggcacagagaacctcaagtaacttgcccaaggtaagccagctagttagcatggaccagtgattcaaaaacaggcagtctgtactccttacaactgtattatgctgcctataaaaggaccactagactaataattatgaaaccagatttttaatcttaaattagccatataatagtagagtgcatttaaggatgtcatctgagtttcattgtccttgtaccccttacagcctgtgagaaggaacctttatatagtctttcataaactgtaaagtgttataaattcaaagatttcttataatatgttaaaattacttttaagagttgagaagtccaaataaaagcagagagatgagaggaaacactagcactaaatgttcagacacccactgaccacgtcaagctgcacattttgttgctaaacctaagggagagattagatatgaggagagtgggaagcaagaaggtatgaagtctgggtatttagggactaatagaaatgattttctcgattagtttaagaacattagcaattacttacgggataagcacagttaaaggaatttctggaaggaataaaactataaaaattagtcaaattgttaaaatatcagaactgtgtaaaagcatataaagtttcatcatatctttcttttgaaaaacaaacaaacacttcatgttctagccagttgctaatagtgatcagttgatgaatacacctcatgtttcacgcatataaaattttacaccatgtctagtccataggcattagtgtaggagtcagaatacaacctgaattctgttcgcagctttgtgccttgtcgataaagcagtggacatctctccacagggagatatgtttcctcccgtgatatagaggatgttgattcacttgtctcctctctatttcgaaaagatgctctgaagattagtgagacaatggctgtaaagctctttgcactgtttacaacataaatcatacacagacatactggcatgagaaacgctatcatcatctcttttatacatgagaacaaccataaggaaaacaaacctcagagacagtcctgtattataaaaatgttgggtagagatgccaaaagttgtagggtaggaaacagcaacaacaacaacaagacggaatccaaagaatatttgcattctataatatattctacagagtctcagacgggaccttcgttgagtgctcccaagtattatcagtagccatgttttttttttctttttcttttttttttttttttttttggtaaaagggataaatagtgatgtcaggagatgctgcaaaatatattccagtgataagcatatggcaagcaattaatggatgaattcgcctctcttattgccatgttgtgacaaatactctaacttatttggcctttggctccctaaagggtgctcagaaatgctgtttagaaagtacttttcatgaagagctacaacaacaacaaaaacaaatacaattcaaatatctactaaacatatgaaggagtactcactctcattagtaatcagagaaatgcaatgatcccattatagagccctgtcatttgaaaaaaaagaaagaaaatccaagtgttttttattagaacgtggagcaacaggaattctcattaccttctcaaccactttgtcaaatgctttctgcttatctgctgaagttaaagatatgcatgacccatgaatccactcctaggtatattcccccacaaaaatgtacgcttatgtgcatcaagatacacgcacataagtgttcgaaatatctttattcataatatttccaaactggatatgttcaactgcataaagaaagaagattggacagtaaattgtggttcctttatacaacagaatgctatatatcatgatatatattatgatgtgcaatcctcagctacatacaacattgatgaattttacaactataatattgcacaaaaggagcaaaacacaggagtatctacaagatgagtccatttacataaaatgcaaaacaaactaaattgaactgttgttttggcatgcatacatacgtggtaaatcataaagaaaagtaggaaaagtaaaagtaaagtcaagatagtggtgacctatctggagaggatgaaacaggaaattatagggtctttctgaggggtgatcatagtaggtatttactttagaacaatttgttaaacttaaaatttaaattttacatactttcttaaattttgttatatttcacaatttaaaaatttataaaatgataattttacaaagcctaaaagatgaattatttgggggcttttacttctctttcatctgtacaactgctgatgaaaatcaccaggtgtgtataacatgaagcatctccttaaatgacatgcatttattgggaaaaaacacaaagtccaaatggtaaaatgttagcaaggtaaaacactgaagatttttctccccaaaactgccaaacaagtctggtttaactgaaattgacagcaaagacaacagagcacacttaattgaattttaatctcagtgatctctaagccatgtttgaaacataaacagacatgtcagagttctttatgatgttggacatgaattcattttcataattcaaaggcatactttgcttatgaatctctttaacaagctttggctgaatattcttttcttccagatgtttgctgttgtatacacacagcttccatctctttgcagatgatttaaaacatagttagaaagagtacatttatttaacaaaagagtaagagtacagaattcaaatagatcgtctgtgggtgtatataatgatgagtacataagtctcatgcagtcctcataaagacagcatctattaatctgaagaagtttctcttactaatttgcaaacctaaaagcattttacattactaagatattaataaataggtcaattaatacttttgatagagtagagagactcctaaataatggacatgaaaaatgattttgtaaaagtacggtttcattttaaatccctgcttaagcaatttgtaggaggcaagatagtgtggcagttgagaggatggtctctgaaatcagatctgaatttgaataccacctctaccatttactaacctaaacaagtcatattacttctctgtgtctcaatagctacttcctgaggtgttcttacaaaaacacaaataaataatccatgtaaagaactttgcacagtgcaaatacatagtgagcacgcattgagttttatttatcatcatcatcatcttgctgtacttttgtaaactcaccttctcccgtctttttctactctaaggtgctcttccaagctactttcctcctcagctatcgttcccctggatttccagtaagagagggtgaaatcatgcctgcttatcttctttctcttttactgatacttcactgaagtgaaagtaaaggaataaaaacacaacacacccacccacaaaggcacaaataataaaggaaacaagatcagcaaaggagagatttctactgattttttgaaatcagaaaatagctgaagtgccttagcataatcgaggaaatggttacggagagtaaattccaagagaaagtggactaatgtgttctcccgaatccagaaagacttactgcttggaggcagcagaattaaggaaggcaggagtttagcgaggggctgaaagtgtattaaaattatatggagcctttggatccaaactaactacttcccttacctactggaagcggagtctttcttttttggaggaaatcggctagagagatttgaaactgatgatactaggcactgtagcaaactaggagaggctgcaggttgcgaaataggtgcttatttgaaagcctatagagtttgcaataagaaacccaacttttttatttgtcatgctccccagacattagcagtcagttatatgccccaggcgcaaatctcgcaggcagaaagtggggtaccccctaatcatgaccttggggaaacatttcaaagaacacaccggctttgattgaacaacctatgatgcaacagtgcaaccctacagttgacgagccctatccatgatcacagaacttctgacattgtttcttgccatcattgtcattgttgctttgttttgtgtgtgtgtgcatatgcacctgtatatgtcttgcttttaactaagaatgaacagcctcttaaggaaactctccataatgaagaagagaaactagaagaagcaaacatcaactgaagaaagaaatctacaggaaagagagagacagaggaaaacctcaagaggataataatctgtgaccttagataaaacacacttctgacataagaacatataccattaaaaaggagaggatgaggctgggcatgttggctcatgcctgtaatcccagcactttgggaggctgaggtgggcggatcatgaggtcaagagatcgagatcaccctggccaacatggtgaaaccccatctctactaaaaatacaaaaattagctgggtgtggtggcatgctcctgtagtcccagttactcgggaggctgaggcaggagaattgcttgaacctgggaggcagaggttgcagtgagccaagattatgccactgcactccagcctggtgacagagcaagactccgtctcaaaaaaaaaaaaaaaaaaaaaaaaaaaaaggagagaatgagagtgctaaattatttttaaatcatgaccaaaataaacattttaatagtaaggttggaaaataaaaatgtgtgtgaacaaatcttctagaagaccaaaaaacaaaaagacaaaaaaggaagaaaacaattaagaaattaaaggatatgatctaggagatccaactaagataatgagaattcaaggaagaaagaacagagaaaatagagggcataaaattatcaatgaataagagcaaacatttcagaactgaaggactcatatctctggagtgaaaaggtctattgcgtgcccagggcaatggataaaaatgcagaccaagacaattgatcatgaaatgtgggaacttcagtaaagaaaagaaggtcacaaaaatttctacacagaaaaagatcaggatttcaccaatagaaaatactggagtgatgcctacaaaatgttcaaaaaaatacatttttaacatagaatccaattgcagttaatccatgcctgagacaaaaaaaggtttaaacaaagggctgcctctgaatagtatatagaaaagatttctgaacagaaaatcttaaaaactagcttttatccccaacttggatactaaatatagagacaggcaagaattaggggtcttcttgtcattcttctgagactctggagctcctgagacttctttttcactaacaccattgaatccgggaatcaacaagctgcacaaagttataaagattgccagacttcatgtttctggaaaaaaaaaagtactattttttcatacagctgagacctctgaaaagatggctcaatgggcaagatgccatgagaaatcaaagccaaatactcattctgaagtcagttttgctcagactttgtatactgccactcaatttttcaagtcatcagaaacataactaagaatgagtgactttttgctatcaactaatgacccaccattcaacgatcttgtatgacaaagtagaggagtatcttcttatttttaggcttattaaattacaatggaaaatattcattaacaatctcataatgaggcattctagatgcttattcttacctaaagggaatggaacaaaaaataaccaaaaactaaaaagatgaagacaaaagcctttcttggtattatagtattcttttacaaaggatatggtttatcatagtaattgattccctctgttacactagagatactattatattaaatgcctaaaggttaaacttaggtaacagtggagctatagttctttcagaaataaaataattaaatagctatgtatgccaagaaaccttactttgaacatttctattgtaccatctcattattgctggctgcctgattagcaagcagtaaacttgggtaatagctttcctctgatatcacttcaagtctactcgagttctagaattacccagactaccaggactttacttgcacaatatgctgaaatgtttataacattatgctttcccctcctaattctcaagaccattttgataactggctaagactggataatatcaacaaatatgaaataattataagaatcattctttcttaaaataagaagagtttccagaaacagaaactaaaacagaattcaggctaagctgctaaataggctatctcagggattctcagctcattcttgatgaggatagattgctttttatttcccttaagtgttccgtatttatttcacaaatattacttaactgtgtaccatgtacaaagccgtgtgctagttaagctggttactgtggaagaaataaagggagtgggagcatctagcttttttcttcaaaggagatgggggaatctgtgggagttagtggtaggggcacctacagaggaaatagctgaaaaggaggagctggggaagatgaggatgaggaactaagttgtgaataaaggaagggcagagcaatggtttttttaataatattggaatgggatttgtttttagcactgctcccctttcccttaacagtccccttgagctacaaataaatgtaactggcaaagtggataataagacttcagaatcttctagctaaccatgatcaatgtgtcatggagcccagtatacaaggagaggttctatttcatcaagaaatatgactgcacttttagtgggcaattggttgttatgaaggtccagcatttatttcttcttccttttgaaaaataacaccctgatttcctttggggaacatccccatggtcagatgggaccactgtgattgactgattggttcaggagaggggctatacccttaattatgtgggagctactagaaagagatgctctctttttttgttggacataaaaaacctggaaaggtatggcactagattgcagacattggtctgtctcatgtggatagagcagagaatgaagccaaaaatggagagttcttctgatatcaggcatcagggagaaaacaaaacaaaaaacaaacaaaagaataaaaatggagagttcagatacaggacccatagacagagaaactaaatcctcatgaagtgttctaattgaaacagtatctatggtctacctaaacctcatgggaaccacattaaatggcggataaagccattaatatactatacatagaagagatacatccacaaggacatcttaccaagtgtggacacaagtgtgtaacaaccacttattggtgtataatattataatccacaacatcagattttactctttaaattcactagggagtattctcaaaggaatggaagaaacaaagctggctatcagtgaggggcattatgtgggtaaatataagtagaaacttcaaaataaatttcttaaaagcaattttcactttctgaaagtttatatggaattggcaaatgacaaggattgtgatcattgatacatgcaagtcaacaagcaaaactaaccaaagagacaaacagacacatgaataatgaggcagttctgatgaccaaaaaacacaactttacaagactgtttgggtaatttattttgactggtaatacatcatgtcagtttattttatttaagccacagcaacgtttgtcttcctgacgatagttattgcattccagagaagtacaatacgaagtttcagactagtgctgggcttagtcacacagagaactgcagtaggttttctaagcccctgctcactgtatttcacaaaaatctcatcccttctaccctccactctctaaacacacatccaagcaaatcacaccaaggcataatcattgaagaacaccataacttgccaattaaaatttggcaaacagaaacattgaagcaaaactgaaaaaagaatcatgtaattaacttagaagaaagcttttttcttaaatattatttttcttcccattcagcatgcacaagaagcaaactttgagcactaacgtgttcctttttagcctttgcctgtttgtttcaaagacaagaggagaagagtctgcttaaaagccaaatacactgataaatgtttactgataaaatcttccagatgggactactttcaaggaaggtcaattacaagccttgtgtctctccttttaatgatatcctttaatgatccccttcctctcctagaaaattaagtcacaaaaacatcttaggctgagagtgacccagtaatcctcataatcacattgcaatgacagacaagaagatcaaagtacaggtgcagtgagaaatagggttttacatcctattataaaatgtgaacttgccattaaccaaagatcaaatgtacctttaactcccaaattcccaacttccaatattttttaaattctgtggttttctggattaataaactttctctaatataatattccccctcccaatttttgtactaaacattggtggttttttcttcacatatggtgattatgttttcatatatccaataactaaataattttagaaatttggtaaattgtgttgaaactctaatagcactaagaagttcccaagctagttggtaagctattgtctccaatactgcaaagagaaaacctagcaatggaaattacataaagataatctgatgctaatatgttagttagaaagtgaattaggcatctagtaatggcttcaataagaaagaggtttatttttatctcatattaagaaaatgtagcctgggcatgttggctcatgcctttaatcccagcactttgggaagccaaggcaagaggatcacttgagtacatgagtttgagaccagcctgggtaacatagtgagacctcatctctacaaaaaattaaaaaaaaaaaaattgctgggtatggtggcatgcacctgtggttccagctactcgtgaggctgaagtgggagaattgcttgagtgcaggaggctaaggctgcagtaagccctgatcacaccactacactccagcctgggtgacagagaaagactcaaaaaaaaaaaaaaaaaaaagaggaaaggaaaaagaaaagtaaagaaaataatctagaaacaggtcaaggttggaatggtgacaccatgtttatcagggacctaggttcctattatctttctgatccaccatccgtaacacatggcttccattctcaattctgccatttaggttacaagatggctactgatgctccagccagcaccagcaccaaatcactactacacaaacgggaggaggagtaaaagtgagtgcttctaggcaggagctccctctgctaacatgtagttggctgcatcaatctcttagaaagcctgagaaatgcaatcttttgactaggcagatgtcacccaatataattaagattcagtcagtcatctttattatattggttactaaatgaacaaatctgtaaggatattcagtcagcaccagcagtctttgtcacaccatagaatttctcaatcctggatggaatttggtctaatcccttacttacagaaagggaaatggagagcagaaagattaagaaatttcccccaaaggacacaactggttagccaaagaactaggtgcagaattcagatccttgatctatcagtaaagatccggttctttactggagcaaacttcagtgaggtcagcccaggaaattcagctaaccaacatgaacaaataacacatcttactacctgggtcagaccctgtgactcacacttcaggctttacagtcataactgctcatatgctgtaacatccaccctctttggttataaagtgagaatcaccatattcaccacaagtcatgtacatgtttacatggccactaaataaccaacaaaatgagagatgcgccgcaaaatgtgacagtacgagttactgtttgtaaaagagcagaatgttccacactcatgggtaaaaattggtacttgaacttcatgagtgactctagatcttttatggtggtggctttttaaatacagacaaacacatgattatggtatctcctgaaactgacattctcaaaataacatccactattatacaaaggaagtttgaatgttttgaggcttttttgcttttaagccattgctcttacctcttatctcttcttcgattatggccatcacttacttcctcagactccacccagctgcattctcaacaaaccacagtccaggatgagaacttctataatgcatatgcttccttcagcactttgagatacattattaggccctgctctcatgttttacttcttttatgttccaagcttcttgagggcagggccaatactttctttattttccataacacccctcatatgaaaaagattctagcattctttcacaatgtcatgcttagaacattccaatatttttccaacctatctcccaaactgcttcccatggttccactgattctcttctttcacccctactcacaacacagggtacccgagtgattgctccaaaatacagaacacagcaagccacatttctacatctttggcggtgcgccactgtctataaactttttaataaggtcgccctaacttgctttctcacatagtcttattccttgccatttcctctgtttgcgccctacatactgtaagttactccgaaacattcatctttttctacatgcctgtgactttgtacatgtagttccctttgtctgaaatgccctttcttctttcgtttatggagattccaaatggtctccaaggtatatgtcaattattatccatgaaaggttttgctatatatatccagtattttctgggggatggggaagcttaaacaaaaaaaacttgaacattactctacacacagtccattatgacatcttagtctatttggaaaactccactcgtgtagaaattgtgtttatttcagttgactgtgaatacaggttctgatgcacaggagctactcaatagtttgctgaatgaatgaatgtcagttttcctaaacagacttgaatgattttcttgagagtctaactgcttgtcatactacatcttgtctcatttgattctagatccacagaagctagcacagtacttagatgtaaaaattgttatatctcttttgtttttccagttaatcactggagaccagggctgccctttcaataggaaatctaatatctctctttttgaaaactacccctctttcaaataacccaagaacctcagggattattcagtctaaagcagagtcgtgcttctaaacttcaggtgtagagaggacggcaattggtatgaaggcttctgccactgccatgtggtatcacagtgaacaatggtcctgtccagacctgtgtccttgctggtttgggtctccatgcccagccttggactccaagagtttggctctttgatttaactcatttagtaaagatcagccctcactcaacaatctaagatgctcttcttgagcaggcagcttaggtttccccttcctctacacagatacattaatccctctagggcccgccgtatcagcattctctcccgacaatacaccatgggactgccctttttcatccattctcatgggtttcctcagtacttctaattgtgggacaaagtgagaaagtctcttttctcctggtagactcctgaattcttaggtagtttggtccacgctatcctcaaactgtaccaagaggaggggtagcttttaataagaagggggaaattttgtcacactctttctccaaagaaaaagatgacaggccttatgtttatatagctaagggaatccacttaatgatttttccaaaaataataaatacaaaaacccctagcaggttttccaatagtagagttagaagtggacagtcagatagaatttctgcctctccagtcaccctcttacataggcatggtaatatttattgaaattcactataaaggcaaaactggatgaggacaattgagaaactcttgtcctaaatatcttttcctgactggccaaggaaacagtgagtctaataatcaacttttttttttttttaagtgcatagccctaccagtccaataagacaaaaaagattcattccaaaggaaagatctggcatttcagggtcacatttaagtaggagaggatgcatacaataataagatatttcaattagacgacaaagtcagccataggacacagtaccagtagtgtcttttccactaagaattggggaagggaggcttaaaattcaccttatgtttgtttaacaaacataccagggaatccttccttcaactgtgcccatcgagttgagctacacacatacaacataatccaggggagactgccccaaactgaggctttatttactaatttgcagtacctctgaaactgttaattttttccctacttttttttttttttttttttttgagacagacttttgctcttgttgcccaggctggagtgcaatggtatgatctcggcttaccacaacctccgcctcttgggttcaagcgattctcctgcctcagcctcccaagtagctgggattacaggcatgtgccactactcctggctaattttttatttttagtagagatggggtttctccatgttggtcaggctggtctcaaactcccgacctcaggtgatctgcacgcctcggcctcccaaagtgctggggttacaggcatgagccatcgcgcctggcccctacatttttaatgcctctaaaatccagacatgtttttataatcaatggcaccttggacttgatgaaataaagtaatcaaatagttttaataaatcaaatacctttaaaaatataaacaatttaaaaattgttctaagacccaggttccaacctcaggatctggatatgaccataatgctatattagcatattaaagcagagacacagacaatagcggtaacccttcaaaggggaaaaagcctgtcagctgaagatgatagaggaacccagtgcttctcaaagggggttccccatccagcagttcatcagcatcagcatcacttgggaacttataagaaggaaaattctcaggacccaccccagaagtactgaatcagaatttgtggggcatagggctctgtaatctgtgttttaacaagggcatgggtttgagaaccactcatatggtagctaaataaagaagacacttggtcagtatatacttggcatgcctggggagggggagcataacacttaacagccgaatgttaagactaccataaaaggaggaagaatctcaaaacccaatgcaggaaagccctttaaagtctacagttcctagtttctgactccatatatgtcaaagcagcttctaattagaagtttgtttctcaaggggctgaactacaaggacagaatgaactgatctggccaatatggtatcctgtctacttgtcaatatatttctcactgtgaattccctaattcatgttcttgctcttgcataaagttcatgagttctgagtgtcagtgacagcacctgatctaattgggttctgagaaaatcaattctgaacctgaaaaactaaaggtcagtctttgaaatttgtatatattacaaagacccagtccaaaagggcccagaacatacctaatactcatttaaatggagtatttaccaggtcaagagaagtgaagaattaagggcaattaggtcaagattgcaaactggcaatcctcaggccagatctggtccacagatgtgacttgtttggcccacacacgttgttcaaaaatgggaagtttcgcattaaatattggatttcttccagtcttaaaaaagcaaaaaaaaaaaagatttgacaatagggagcccacatcctggcacttgagcactagcctggagctaggcagaagctgtctcctttaaacaggttgtagcttccaggtcaccccagtcccaggaatctttattgacttctggctggcaagcttctccctttatgtgaatatgatctgcctgacccctggtttgagacgagtttgaagacctttgagctacataatcatttttcatggaacagatcattagactgatttgaataaaatgaattgctcagaaaattagctttattttgtacctttagagctatttgtatgtgtgagcagggatgtagaggttagttacttttgaaaacagacagtgatgaaggcaaatgttgccaggcagagtataaagagaaccagcctgggctgtctagacttggatctgccacttactaaatgtaaaactatcccacagccgtggtttgcatatccactaatgggaatgataatatctactatacacagggtttatagtgataatcgaattagataatatatgttcgagactatatagaacctcaaaaatgttagctgaattaaattttgatggttttgttttctgaattttactttagaaattgttcctaacagattacaaacttttgaaaaaacaatcaaaattaaacctcaatagtcttacattgtgatcaaataatggaattaacatttattgactgtaaactatgaaccagatagtatgctgggtgctttaaatacattgtctcatggaacccataaagaattactgagttagtattatctatcttttacacattaaaatccaaggctagaaaagtttaggtaatttaccaaagtcacacagtaagcgttggataaccaaggtccatcttactccaaagcccttacatgtgtgattactgtagtgtttctcaaactaacatgattatacgaatcgcaggctagtagttaaaagcgtaagctctcctatttatttccaagcttactgaaccagaatctaaagggatacatagccttgaaatgtgccacattttaccacagccccatgtaattcacaacagcggcaaggaaactgcttaagaaagctgataagaatcaaagtaagtagaaaaagaattactttgcgttttattcaatagaagaaaggaaagaaagggggaactaggaagaaaaggagggaaggggagggaggaaagaaggaacaaaggaaagagggaaggagagaggaaaagaaagaaaggagggagggaaggagacaggcagaaaatgtcctggagctaaggcctatggcatttgaaggatgatgtgaatgcacttactagatggatgctttctttctaactgcacccagcctgtttactgcaaacataaggaatcagccaacaggaagctcagcttgccactgcagaggagtaaagcactttgaactacaggcattttgtacacccaaattacatactgtgatacacatagtatttgagctgttccgcaagacagaagccaattattcttggcacgtacttctgtcgtgctatccaaatcaccatccctcacatgtggaactgtgccacatcaaacgcaccaagtcacaaattccttaaactctttgagatgaaagtcaaattttggagaaaaaggatagtctggtatatacaccatatagccaaaaagatgtgtgcttaacttagaactgctgggtctattatgagaaaccggggcagcaaaattctgccttaggaacttttcagagttttgtaaactgaatttttccaatgtaattcagtattatcattgccttttctaatcttagttatttcatttatagtattcatcttaaaataattttccagcctctccctttaaatgtttttaagcacagtggaaaaacatagacactaaaacaaggagtagaggttgtaggtaccatcaaattctattgagaatcacagaaactatgcataagtcctgaatggtagcattatttgataatcagatcagttagttaacccactccccttaccccttacaaatcctgaggttaaaggatttaatcaaaactgtcagatgatatgaaaatagaaatcaaatgataattgttaatagtattataaagaatttaaaacataaatcctgcaagattaaaaagcagaaagtggggtattagatgcaccagctttgtgcttcttaagctttaaatatgctgtggaaactcctagaaatcttgttaaattgcagattctgatttagttccaagattctgatttctaacaagcaccgatgtgactggcccaggggtcagactcagtagcgagtgggtcaatttaagaaggcttgcattggtgaagttctagagatgtgatagagaatctccccataggagggagtgtgacctaacactagtaatacctagaaataaaatgtaaagatgaaagacagatggaagtgttcgtgtaagtgtccagttgctccagaagaaattggttacctatgaaatagaaatataatcttagttttaatgtgagaagaattctaagaaagtaaacagatttacaactaatatataattgggtttctcaaacttaagactctgatgaggatactggatcatccacccagaaaaatacagataatgtacatgcacatactgcacacacaattctttacacagtttcaggaagttcactgagcttcctttggaaaggtgtgaactacctaagggctcatatcacaatttaagactaccaatgcacatgtgtagctggtatagaggaacaacttgtagttttaagactaattgatagagagggcagattagaatctgcttatgtgtttgactgatgatgttattgcacaaaggcttatgatttctcagtcacttctgtaaaatataaactggttgaaatgtatatttttccaaggtaagacattaagtatcttcatattaggtaggaaaaaaaccaccatgttaggccgggcgtggtgactcatgcttgtaatcccagcactttgggaggccgaggcagttggatcatgaggtcaggagttcaagaccagcctgaccaacatggtgaaaccctgcctctgctaaaaatgcaaaatcagccgggcgtggtggcgcatgactgtaatcccagctactcaggaggctgaggaaggagaatcgcttgaacccgggaggcggagtttgcggtgagctgagatcgcgccattgcactccagcctggggtacaagaatgaaactccatctcaaaaacaacaacaaccaaaaaacaccacaccattttacaaagttaaatatatactactttggaaaaaacacaagacaaaaatccaggtttgaaaatgactgcacagtacaggggtttctgaagatgtaaagggcaattgttgttttatgctggtagcatacatcagctttttttctccaatagttttgaatatcccaccacctgcctttttaaactagtgagaaattataattatttagagctgtcatttaaaagtcatagaaaaccagttaatgttttttgaaaaaaacagttattgatcacccaatcttagataagcaacttaaaatctaaaagcaagctacatctgtgtgtgtgtgtgcttgtgtgtgtgtgtaaagttatatgtcaagacataatatgaaatatagacataatgctatgagagtgctgagggcatttttctttttcttttttcttttttttgtttgagctggagtcttgctctgtcatccaggctggagtgcagtggcacgatcttggctcgcaacatccgcctcccaggtgcaagtgattctcctgcctcagcctgccaagtaactaagattacaggcattcaccaccatgtctggctaatttttgcatttttagtagagacggggtttcatcatgttggccaggctggtctcgaactcccaaccttcagtgatctgcctgtctcagcctcccaaagtgctgggattacaggcatgagccactgcacctggcaggagtgattatttccaggatgagataatagagatgtatgaaggaaatcactgagttagctctgagctggattcaggatgagtaggatttcagtagaaggagaagtagaggggaggcatttcatataaaggaactcccaaaagcaaaacattatagagggtaagagtggagggaggaatatgctgtttggtctaagaagagaatgatatttcatcatacttgtaatattactacttgtgtaggctcttcttgactcggtttgctttaaccaacagaacacaaaaaattggccacatgccagttctgggcttaaacattaagaaagcctggcttttgtgttcttggcagccctgagttgccagggaagaaattctgactaccttgctggagagttcacatgaggaatccacatggagagagagaaaagccatgagactacatgaagaaagaaagaaagcaggtcatctcagctaagcccagcctccagtctactggagtgactgcagccatattggggaccatgggtaagaccagcaggactgcccggctgagcccagcacagactgcaaaatagaatggttgtgtttcaagacatcactttctggaatagtttgtttgcagcaatagaaaactgaaactgagtgtttatcaacattttaaatcactactgccttttgataaatacaaaatgcgtaaacccaactggagattcagatgtagcactgtccttctacactcactagtcaagacttattttgaattttattattttgtatcctaatcctaaattttgtttaggatacaaaactctaggtttcttctttttacaaataaaaactattataaaagtaaataaccatcaaaaaccattccctgaatcacctcttctattgctcctccttaacagtagcactttagatggattagtgtacatgtgtatgtgcacacatgtgtgtatgtgtgtgcatgtgtgcatggtaatatttggtcatagggaagattaagaaaaggattagggctaaaaggctgaacatagggtgatatcttcggttttagagggaacctaggacagtgtttctcaaaattcttaccttaaaaaatattggccaggtgcggtggctcacgcccgtagtcccagcattttgagaggccaaggcgggccgatcacttgaggtcaggagttctagaccagcctggccaacatggcaaaaccccatctctactaaaaatacaacaacgacaaaaaattagccaggcatggtggcaggtgcctgtaatctcagctactcgggagtctgaggcaggagaatcacttgaaccagggaggcagaggttgcagtagtgagtggagatcgcaccactgcactccagcctgggtgacagagtgagattccttctcaaaaaaaaaaaagaaagaaattaaaaaaaacaaattcataggaactcaatgtgtgtgtgtgtgtgtgtgtgtgtgtgtgtgtgtgtgtgtgtgtgtggtgtaggcctgcctatccatactgaaacagatttataaaagttattccctatgcgtgatacattctcatctttttctactctattccagttctttttttcttactgatagttgtgacccactatatcagtttcataatgcacatagaagttgaggcactcagatgaaaaacactatctaaaggggcattaatcattaaaaaaaattcgttaaatcctgtatgtgccatacattgttctagtcccttggataaaccagtgataaaacaaacacagttccttctttcatggacaaaatagtcattaaacagcaaccacaacaaaacatgcacaaagtatgatttgattacattcataataaatgctgagaaagaaaagtatgggtgctataagaagctctgataaggagacttcactgaatctggagcatttaagtggatcttttcatggatgccaagttaaggaaagcccaaagtaatagaggtcaatctttagaacatttctgatctgccaagggctagcagaggacaattgcaggaggtcgctgaataagccaagtggggtggaagctgggctgacactccgcccaatcctaaagctggctttaggggctggtgcatgctgtagcctattgggcccagctcatattaatcctttccaacaatttttggcttgtgggatctagagaggagaggtcaaggagcaagagtgaagtatcccccttagagtccagaagtaagagaagtaaaattatttaccatctttcaggggcaaattatgagatccatctagagttatgaaaaactgtgtccaagagactcccaggctggacgctgacagtaattacttgaaggtgttaacatatttggaaaaagaaagttcccattagaatgagggtggttggcaagtaaatcaaagacaaaggagacttgccttgtgctgcccatggagagagggagcgcctgtatgagcctcgagagtgtgcccatcctcctgtgatgatctccctactgctcacatgcatgtcctaggccctcaaaactatgaccactgagccttctgatcatatgtaaatctgtctattctaaatccatgttatgtactatttagcattctaaacctacccataagagggagaatgcgtatgttggcaaggccaaaacactttgtagcttttaaggaatcagctgatactctggctttaaggctcttgtgagcttttgagagtttgaatcagcttactcagaggctgtgacaagatcacctttctgagactgcttggttgaggacagattctggaatatagttaattctccagggaaaacactactctgtaaggacctgtctgggtaaccaactgtctttccctaggcgatacccctagtaactcctaacctccaactacacaccattttaaatttaaaatttctacaaggtagcagctccagcatgtacacagcacacagctaactgttgatgaacactgcctaggcattgtttcaagcactatgtagattatcttatttaatccttataccaagggaggtgctatcggtattcctattttaccattatgaaaactgaggttagttgagcaccgtggctcatgcctgtaatcccagcattttgggaggctgaagcaggtggatcacttgagcctaggagtttgagactagcctaagtgtcatggcgagacccgatctttacaaaagatacaaaaattagccaggcatggtggtgcatgcctgtagtcccagctacttgagaggcagaggtgggaagatcgcttgagtccaggaggcagaggctgcagtgagctgagatggtgccactacaccccagactgggcatcagagctagacccagtctcaaaaaagaaaagaaaagaaaactgaggttaggaagcacaaggtctcacagctagtaaatggcagggctgggattcagggcagcctgattccagactgcaacctttaaccaatttatgacattgctcctgtcaatgcctccacacccaggaggatttgaactatgtcaaaaagtccatttgttcctaaactgtggcttgcaaagctacttttctttaaagggagggagggaacaaatgacctctatccatatgctgtgataatctatacacttttcttggtgtctcatagaacttcaatgttttctcccttgggatattcaatgcttcatgcaaactagtgagaagtggctcgttctctaccccaaatcccaccttttcttcttctggcttttctgtggtctcactggggatagttcctgcagattttcaacttgtttcaatttgcctccttccaagctatgactatgcaagcatgatcctggaattgcagaatggtcaacaaaatgctggcttattctctggggaaattctacagttttctagggagatcatagaaagctatttaggatcccactttccaataggctcttgaggttatgattgttccctggatgctttctattgtgcaactgccctaatgtacaactggccatttatacaaattcagtttataactaagacattgttttgagaaaaaaaaagccatactttctttcttttaaaatactgataaagtgtgggatgtttgaatgtgttctccacctgcatttttctattctaaatcccaaggggaatgagacagagaccaaagccacagctttccaagaccacaaagcttgaggtctttgatgttccttatcttctgagtgaaactttcaattatttggcaaagaaaacaaggctcttaatgggaaaccaaagaagccaaatcatctgtgtaacagaactgagtacatcgataattcatttattcaagaatgtactgagcaacctagcatggctgaggcactgttgtgtatatatatctgtatcagtgaacaaaataggcgaagattgttccacatggtagtttccagtctagtacaggagagagataataaacaatagatatagtaaattatgtgttagaaggatagacatgctatgaaacaagcactcatacatacaatagagcagacattgggaatggtattaatgtgcgatgcatttaaaaaatgggatggtcatggatggcctaatggagatgaaacacaagcaaagacttaaagcaatggaattggccctaagataccgggggaaagagcacttcatgcagcaccaaggtcttaaaatggaagtgtgactgatgtgcttgaagatcagcaaggaggctaatgggctggagctgagtgaatgagagaaagaagagttaaaaagaagaccagagatgaaacaggggtcaaattgggctacacgttgtgggccacaataatcacttttaactctgagggaaatgggagccattgcaaggttatgagcagaggaatgacatgatttgcactgactgctgtcttttgaatagactgttatgcagcaagaggagatgcagggtctcctattagacagccactgcaatcatccaagccagagaagatggtggcttgcaataggatggtaaccatggagatggtgacaaggatgctgggctctgggtatattttgagagcagaggcttcaggagttctaatgtattagatacgagatgttctaaaaagagtagacacagggatattctcaagctttggcctgagcaactgagatgaagaatttatggttagagcacattgtgtgggaggcagttggggaaatctataattcaaccctccctcccttccttcctctcttctttctacccttcccttccttttttctttttctcttcctttttctttcttttttttttttttgagacagagtttcgctcttgttgcccaggctggagtgcagtggcgcgatctcagctcaccacaacctctgcctcccagatttaagcgattctcctgcctcagcctcctgagtagctgggattacaggcatgcaccaccacgcatggctaatttttgtatttttagtagcgatggggtttctccatgttggtcaggctggtctcaaactcccaacctcaggtgatccaaccgccttggcctcccaaagtgtctacccttcccttcttccctccttgttctcttccttccaccttccctcacttccttctttccttccttgcatgcacacctgcaaatgccagacattatacccagtgatacaacagatacaaggcatcttcactagcaagccaaatatgaatgataaaataggggtacagaagtagaattgatggtaggggacctactatattctattattcctttcttaaaaatttagattctgatatgagatttgaataattcacatttctgaaccataactctgaaaatacatcaacatttgcacattgattcttcttcaaaaatcatgttaaacctaaacttaggattccattattaaattgatggtatgttttttgcctactctgttatcaaaaacacatcaacaaatcaaaataatcaccgacatgaatgaaacattcattactacatcttagaaattgtgtcttttttgtttctctagacactatctatcaaaatttctgaaaacttagctaactaactgcactatttattggttttattctaagaaacataaagcgaagtggtacactctggtagaaaggatgccctagggtacaacaaaaggcagataagcattgtgttaggtgaccaatcttggaaacagactgccaaaggtggactcctggctctgtttcttactacttgtgtgaccctggcctagtatttcactcctccgggcctcagtttccacaactatgaaataagaacaataatgtatccaatctcacagatttgtggtgaggattatgcaaagtccttaaagagtgtggcacatagtaagctgtccataaatggcattacatattgagatattgagtgtaactaggccactgttactgctactaccatacactagaaaattctctcctccctttccaagagctaatttttatcactgatattatatacccttttgggggtcattttcaatagtcatttcttaagaaaaaagcaacaagagaaataaagttgcaaagatgatgtaaatgtttaacattattagttaaataactgctagaacatgagcaactacaaaaataattttgaagtatactttgatgcagaaaaattttttttttgttaaatgggaaaaatgtgttatagcagtaagtcaccaaatatgatccctttaaatatatacaagtatacaaacatttggaaggatttaaagtatatattaatggtggcaatccttacatggataaatttatagagttttgatgcttttatgacgtatttttattttattttctgaacatgatagctgggtagtgtcaccaactgagatatataaggaggcacaaatttagaggaaaagctaaatttggttttggatatgaagaattttataaacccatgggatactcagttgggaatttccaataaatattggggttccaagctttgcagaagaggttaagatggatttctatataaatttaggggctttcagcaaacaggtggtaattaaaataagaatgcacaagtcagtcttggaagacacacagagtgaggaaagcaggaatggagaatgggatcctgggaaccccaggtcaaaggaagggtggggggaaaggaaaagaaagagtgtacgacctcatgcaaagatggaaaggtttttgagagggatacactggcaattgacttagagaaacttgatgagaaatgaactgaaaaatatctacttggtttggcaattgggagagcagaggaactacagcagtagttgcaacagagtggtggggctgcaagctaacttcaagggggtagaggaataagtggggggaaaagaaaaagaaaatgataagtgtaaactttctagaagtttgggtgcgaaaatcaatagagatatgtggtaataactgatggaagatacaggatcaaagaggaagggaattttttccttaggaacttcaaccagttttgaaggagatgcagccatcaaagagtaggtcaaagaaagagggagaaggggcgatagatggagcaatgtccaggaggagacattgaaggggatggggattaaatttgggggtagtcttacttttaagtgcactaaacagaaatcttaccataatatagaagagcaatacagattgagcaaaatataattttgtattttttgatgatttggggtcatcagtttgaacaccaaaaattatactcagttgtccagacaggatgcgctcagtgtttccaaagatgggttgagcttattgcccctttcaaaaaggccccaaatagctatgtctgtggttttcaaatgattttgtagattttctttttctgttgttgttttcaggccatcagctgacatttggctaatatcagttgtgactttccctgaaatctcctacccagcctttcttaatttgcttcatccaattatagaaggtttagaaccacatgaccaagcttgtatgaatcatcactaaaatatgaacatacatttctctggctaatgacctacattatcttcagtgagtgaacattgtgaacatctattttgagtgcttagagacctcctttgcttccttccttatgctgatctatgttctagaagaaaggggacactattagggttgcaggctaagttcttaatagttaggatgtatattgttattaataattgaggtataatagatatcatgcttatcaacacataatgtacatatagagaaaaggttaatggaccactctgagcttacttatcaaagtctactgctcttccacaaaacctacatggtttgttgaacaatttcttcagtcttctgcaagccataatctatgattacataaataattaataatagttttaaaataactttgcaatgattttggttgtttagatccccaacaatgtaaatctcacaatcttctggcagatttataattattaatggaaaacacatttcttatctcagtcgatgaattagcgtttgctgtagtcctaataaatatatatagtaaatataatatacagccaaaaaatgtgtaaacgtacaggaaataaaatgggaatctttgtccaaattcattagcaacctgttttcagcatatatagtactgaaccacattataatgttttttgagcacatatattcaagaaattaaaattgtataaagcatacaattccccattatataatcagagtaaacaagaaggaatgatttccaggaagctcatcccttggattgttttctatgtatatgctacatgtaatttatattgtatgacgatgatacaaacgaattttttttgccttctgaccctgatttcccaaactttcacagctcagacctgcagagacaggttttaaaaacaacatttggcaagaacatgtgcaaacgtgatcaatgagcatcgaggtacacgtatattttactacctttcctttcttactcagagtgcttttaaaaatcagcataactgcaataaaaagaacccacaactgccctattattgaattacaaagcaatgtgtgtcggaaacacccctcagcattttaagagggtcaaaaggaagatgctctgcacgtactccacggctgcaggaattctggtgaaaggagataccaacccagagctgtttaaatgatgacgctgcagccaggcaagaagtagagaaagtgactggaaagctggattgcaggcagaacaaggaatggtgggggtggtgacaaagtggactgcgaaaggacagaaatgacagcaggaatgagaaggatttcagatgtgctactatgatagacgtcccattccaagtctccatgtttcaagcaagtttttaaaaagtttcaagaaagatgactttctgcaagatgagaggttgctttaggcacctaatttcaaataactaacaacagctggtaattattcaatacaatcattagcaacaataacagcaagactaaataccaataaaaatactttatagtacacagtggctccatgtgccagttccttcatcttaatttctctacgtttagccactaatttctttggcttcacagtggctttacccaacatcccaggatacaatttctcaccacagaagttacaaatttccaagattactgctgaattgaattactctcacttacatgaggcaggtctcttattctattctggggtctcactgctatcaataattcaactttttataaaaacaaaatcttccttaaaaattgcttttgtcaaaacattgctatgaccatctgtttttaaaaaccattaatggctgtctactaactttaatgtaacaaaatgtattagtttgacagaccaaggctttcatggcctaaattttacctggaccctccactacagacggccacacttgtcacacacatacatgatccaatatttgtgcatcacggtgggagtgtttgttcctttttatttacatttcttatctataagtcccaactcaagccttacttccccctggagcatttcctggctaagctggctctcaactctctcttcttctttgtagtacttatatgactttttggttctattatttgacattgagaactgcagaatcgctgttgcaggaatatgctggaactggatcttgttaagtgttaaagattcaagaattctgcaaaagaactgttgaaccagtggtagcttggaaccagccatgggaggagtatttgcaccatggccatagacaaacactgcagatcaggtttttaactttttttttttttttgtgaggggtggtgggatggtgagaaaaggaggaaggagaactggcttgctagcataccacacaatagattgtcaaattcttcttactacatttaaaatattttgtcaactctctactatagctttccagtataaattcaaatgcttccgggactaagtaattcatgacctctcaaggagttaaattccaacatggacatgtatctatgtacacacattaaagtgtaggctccataatagctagctattttgtattcttcatggtgcccggcacagtgtgtggtaaaaagagatccttctacctttctagcctcagtttccagggcttacattgccctttaacttctggccttattgaaccttggaattgtttcttgaacgtatcaggtatgtcttaccttggtaactttccaaaggccacttacttgccatggctggcccaggctgactgaatccctcctgccactgagtgaccctgtggctttaacaggcctttcaacacgttgtattttaattgtctatcaattcaaccacctctctgctatacaataagctgcttaagtgttattttttccacctgcgtatctcatggctgaggtccccagcatatagaaggtactccaataaatatttattcatagtgaatagagcaattcaaacaaattaatttatataaggtaggtctgctctagcacttttccacaatattgattactcaaaaaaaataggcctcatggactttatgacactgttgcaactacacagcaaccatcgaacataaatttcaaagaggagagagtttatttacaattctatgagcactttaagttttgctttcttcccaggcactgagggagtatccctgaggttgttctcctctctttgtgtttagatgtctgtacttgctggtatgcctctgtcctctttctgccctgcttccacaccaatggcagacgcaccacaattcaagtgaaacctggtttatccccaagaagtcttcacagttgttctgttggtctctgcttaataccacacaaataaaacttaggccagaggacttgggagagtgaatgaatgaaacaaggaagaatggaggaaaaaatataaaagtaaagtaaggcatgagagaattgtataaagtggggtggggaggatacaatttaaactgtttttaagaaaagatataaaagtaaagtgaggcatgagagaattgtataaactggcgtggagaagatgaaattaaaaaaagcttctgagaaccaaatgaggttgtaatactccaaaattcttaattcaaatgttcttcctgcctcctttaaggttcaaaagatagctggcgtgaccatattcacgaaagtgaatttctctttaaattgccaaaatcttattatcattattattactattatttttggtttacagatccaggaatctttctaatgatggagaagcaaaataagaataaaatgcattttataaaaatcctaattttaaataccaagagagaagaggaaatttatgctctctatatattgtataggggctaccagcatatggcctctgtccacagaagtacatttatctgggaaattgaaataattatttagtgagctcaggcaaaagtaagttctaacaccagagcagaggacatagcctaatttcatgaaagctgatttattattgtttataaaacaccaaattgtcattacattttctaccctacgtataacttgtgtttttccagtggtgctaatatgacaaaggaaataatggaagactatcataaagaaagcttaaaatatggtgacttttacatcagtaacactatttttcaatcattgagtcctgctgtgcatcttgacattagctcttcaatcatactccaaatggagtaaaaattatcagtagaggaaacattctatgatccatttcaattccactacctttcccactgttcatattcagagaaatggatatgaagtgctagagacaagagcagaacaaattaaaattctgctttttctgtgtgtcattgctttttgagatggggtcttgttctgctgcataggccagtgtgcagtggtgggatcatggctcattgtaacctcaaactcctgggctcaagggatcctccaggctcagcctcccaagtagttgggactgcagacatgcactactctgcttggctaatttttttattcttagtagagtctgttccccaggctggtctcaaactcctggccttaagtgatcctcctacatcggcctcccgaagcaccaggattacaggtgtgagccaccaagctcaatcaaaagtcctacctataaactaaagttccacagagactgatggttaaaaatgcaaattgaaatcaaatcagcaacactctaaaatctgaaaagattcattatttctccaccagaacactttttataaacaagctgaaggttactttaattttgttcaaggttgtgtcctacctttctttgatctatcccacagcatatagtcaagtggtagccccatgacgtgcacttcactaagaggaggtcagagttatccattcattcattgattaaatacatatgaatcaagtctatgtgtcaggcactttgagtatcaacaattccaaaatcaacaagacacaatgtaagctctcaagaacatcacagtttatggtagccaagaccatttttaaaaaaattgataaacatctactctgatgtacttagtgcccaattctttctccctttctctttaaaaaaaaaaattattgtactgctcaaagcaatctacagattcaatgcaatccctatcaaaaccaatgtcatttttcacagaaataaaaaaaaacttaaaatttctatggaaccaaaaaaaaagcacaactaaccaaagcaatcctgagcaaaaagaacaaagctgaatatatcacactacctgacttcaagatatgttacaacgctatagtaacaaaagcaacatggtataaaaacagacacatagaccaatggaataatacagagagcctggaaacaaatccacatttttacagagtggactgatagatttagagtagacagagagcataatgatagatacatttgattttctataaaggcaccaagaatatacattagggaaaggagatctcttcaataaatgatgctggaaaaactggacacccataagcagaagaatgaaagtagacccctatctctcaccatacaaaaatcaactcaagatggattaaagacttaaacataaaactgctagaagaaaacacagaagaaacacttcaggacattggtctaggcaaagattttatggctaaaacctcaaaagcacaggccacacgaccaaaaatagataaatggggctgtattgaactaaaaatttctgtatagcacagcaaagcaaacaatcaagagagtgaagagacaatctattaaatgggagaaaatatttgcaaactactcatctgacaagggaataatattcagaatatattaggaactcaaacgtctcaatagtaaaaaagcacacaatcccattaaaagtggacaaaggacataaataggcatttctcaaaagaagacatacaaatgtccaatatgaaaaaatgctcaacatcactaataatcaaggaaatgcaaattgataccacaatgagatatcatcttaccccagttagagggctattattaaaaatgcaaaaaataataaaaaataaaaaaaaaataacagatgctggctaggatgcagagaaaagggaactcttacatatcaccagtgggaatgtaaattagtacagccactatgaaaaccagcatggagatttctcaaaaaactaaaaatagaactaaccactatgtccggcaatctcactactgggtatttatccaaaggaaaagaaattggtgtatcaaagagatacctacatccccaagtttattgcagcactatacagaatagcaaagatggagaatcaacctaagggtccctcaacagatgaatggataaagaaaatgtggtatacggccaggcacagtggcttatgcctgcaatcccagcacttttggaggccgagacgggcggatcacgtggtcaggagatccagaccagcctggccaatatggtgaaaccccatctcttcttaaaatacaaaaattagccgggcatggtggcactcgcctgtagtcccagctacttgggaggctgaggcagaagaattgcttgaacccgggaggcggaggttgcagtgagctgagatggcaccattgcactccagcctggatgacagagcaagactctatctcaaaaaaaaaaaaaaaaaaaaaaaaagcaagaaagaaaggaagaaagaaagaaaacatggtatacacaatggaatatgattcagccataaaaaagaataaaatcgtcatttacagcaacatggatggaactggagatctttatgttaagtgaaataaactgggcacagaaagataaatatcacatgttctcacatatgcaggggctaaaaaacttgaactcatgaaggtagaccgatagataccagagcctgggaggagtgtgtaggtgggaggggaggggatgaagagattgattaatgggtgcaaacacacagatagaataagctctaatgttccatagcagattaggtgactagagttaacaacaggtattgcatatttcaaaatagctagaaagaggacacacaggcatgataaatacttgaggtgatggataccgtaaataccccgattccatcattatacatattgtgtatgtaacaaaacatcacatgaaccccataaatatatacagtaattatgcaccaacaaagataatttactgaagtgaaattcatatcacataaacttaaaaatagtaaagtcaagaattcagtggcatttagcacatttacaatgttgtgcaaccaccacctctatctagttccaaacattttcaacattccaaagtaaaaccccttacctattaagaagttcttttctcaagaccacttttaacttcaatgtatgggaagccttcatttcgaaacaggttttgaaaaaaattctatgcccacaatcacttaacttaaatattagaattgagactaatggagtcaaagagtcctgtaacatcagacacagcctcttagggtttttaaaatggcattctgcattctctgttttttttgtttttttttttctttggttttggttttttcagtctgtcaattttccagattcctatctcccaaagccggtagatgtctcctttgatccagtagctaaggcatggttgaactgatcatatttataccgaatttccaaagatcaatcaacgagaattctcgggtctatgtgcttgtttatttagccctgcctctatgcctgaacttcatctggaagtcacacatagtcttctttctgtcttcagccatgagcaatagtgtatttgcactaaaaacgtttccatggcatcttcttctttatttaattttctatcagcagacccttctttgatacttcctttttctgcccattctggtaattcagttgactaaaacacaaaactcttcccaggtaatctttgtttccctttcataatctgccgtttatacatctacttaattcataattttgctaaacatctccaattatttgttcctacattgttatcttgccatcaaaatattgattttaatacctgtgacccctccagtccatttaaaatattaattaccaagtttcctgccttggatattggagttcttaatactaacatcaaaccaaatgttttatcctcatttctaaagctctactccattgcagacaccgtgacatctaacacttagcagatagaaaaaaagtatgccattgtaaatctgaaaacttctgggcttgcatgtcagagactggaagtggtttgtttgaaaggagcttatactgaggcagcatagcataacacagtggttaaaagcaagtctgtgaaagtgagaaagactggggtccaaatcttggctctaacacttctaagctacgtgactctgggcaagttgcttaaattccctgagcaccagctttctcatctgtatgatgtaaaaaaaagagcagcactgtttagtaaacatggtcttggctttataccacttcctaatatttctacaactgtcaagtcaatcaacatgttaccttagaaactgtggaaaaggtataacctttggaaaatgtaatcaggggggaacaacttttcctagcccaagtccagcttctggttctgccctgacaggtatctgtaagttataatgttttactaggtcttcatttccttacttataaactgagggaggttgagtgaggagttctatttgtttgcattttggctctgcaattcaggggttttatttgacacgtgaggaccaaggagtagaaaggagcaatcaagtgcagtggtttggtcaagatcacataaaaagtcttgctgtaaaaccaggagctagtcctaaactgctcaccagcaagcttgatttatactcgagtagaccatattctcttgctcctccagctgcagctccactcctcatttatcttagcccaggctgactctaagctgctttcacttctacctcactgcatttcgccctgataattttgtagcttacctagcctccctctttgagatcccttcttaaaagggtcattctattaacctacccatatcagttactttactactgctgatctatcgctacctgtcaattcatgggaattacagggtgcactgggacaagagtaaaatgatccaacaaacataatgttgcatttaaaaaaataagctaaaagatactgatgactttttataactacaacatattcgtttgtgaataagaacatatatagtaaaaagatgaaaatgtgaacaggttgactatttcctaaatttatggcagaggttgttctggagaggatggaagaaaaatgaggctggcagtgatggtggggaaatgcaacctccaaaattatctatctatatatttttattaaaaacacccacagtaattatggcaaatgttaatgtttgtttgttctaggttttggatacatttaagatctcttgctttctgggtacatttcttttcttttcttttctttttttttcaaattaattccaaaagacttatatctgctacatgaagaacgaagcaagttcagctctcttgctgaaatgttcaaatgctgaggcaaggcctgtactacaaatttgtgtaaccaaaaccacagtgctctcaatgctcctagtgttgcattacagcagttagaagagattgagctattttgtttccatggctcattaagctagagttagactggtgtccataatcaaatttactgcacttacccttgcttcttccctatgaagtacagccagaccttagggaaaatctcaactattccaggtccatggtaatttggtccacgaaagaaattaacacacctgaaaaggattaaattatttttccttttcaaaatgatcctcttccttaagcttcctctgtcaattgactgccaaccttatttgctaattcccatccctcatcgggcttcctagcacttcctgctgcaaattagtgtgcagtgaacctgagcctgctctccaaaacacatccagactcttggggctttctgggcttccgctagggtgcctggtgcaaagggggcctaaatcaatcaattaaggcctgggaagattccaggcaagaggaagggatatcttgggggacaaaaggaatgtgtaggtgggaagaagggagaaagtctttcttcgtttttcactgcaggaaatgatctggacagagagcaattcgaatcatagacagggagggttgggcaggatgcgatgggggagcgaatgacagacacaagtgacaggaacaacttagggagacaggtcagaaaacatctaatctaggcacatagcagaaatagtgaagggaattgaaacagttgttctgtattttgttcacagtgttaaagtcaaagtcagtgctttttaacctcatgggatggagcgggggagggggcacaaggagccttgtgtgaaggctctggctctgcttattgatcccccaaatacaataatacatcctcacaatcataaatttgagagcaaggggctctgatcctgtgatatacaatctaggcccttattggatcctggaactgattttcagaatcctttattcttttaagtacaattgtaaaaaaaaaaaaagagagagagagagagagagagaaagcaaggaagaaaggaaaaaaggaagggaagaaggaaggaaggaaaaaaggaagaaaggaaagaagggttccatttataaacctcagacaaaacaaaaatgaaagcaaaagagaacaaaaaatagccaatacgacccaagttacaaatttacttgtatcctttcagaggataacccaaattcctgcaagacaattagccatctttctttcgattattacagtaagcaagacgggttaagagtatatagtaaatgtgctttgctaaactccttctccctttattgactctatcacaagaagcacacttaatataatttttacaattttttaaagaacaaataggaaagaggagaaggttgtactttagctacctttgtgtatttgaaaggaatgctgttcagggcttcttccttttcaaaaagaaacaggtctttgaaaacgaagaatcattactgtgcatatctctcgagggctgctcctctagtatcagtccatttgaaataggagtttcacataattcaatttattaaacccacatttcctgccagattttgctttatgtgcctatgtccttttgtttcccggctaacatttccacatctcggaaatcattctttctagtataactgaagaatatggatattaaaatcagatcagcaaaagatttttatggacttggaaagctgcccattaatgccgtaaaataaagcgtgttatacagctgatatcatcagttctactctatgttgttttcatattcctggcggtgggtggagagttagagtggaacaattaggagtgggaaagagaatgaaaggattcgatcaattgtggaatttcaaagcggagacaatttacactaaagaattcaaagacttcgtaacctccaagacattttccagtccaggtaaccgttgaattatagctggaggtgatgttcttggagctgcctgtgaaagctgaaatcacaacatgcctgcagtgttcccttcctaaaccaactttgccattttctcaggcagacacacaaacatgcaagcgtccacagtaatgtgcgtgtgtgagggatgggggaagagtgattgttgctttgtagtagctcctttgaagtgtttaattcctcccttgtaatctcttcatcaacacacatttaaagcatatcagttttacctcagcaatttgattctcagaggcttatgtggctcagggcctctgtccagcacctgggtggcacagtttgttttatgtgcatgcagaagtgttaacagaattaatttttttccttctttctctctttcttcttcccccacctcccccaatttaggttaatgagcccaggcagcagtgtgtgtgagtgagcgggcgtgtgcacaggagggccgtgagcctgcctttttaaaatacaggaaacgcatagaagaaagaagagttcagctggagccacgacttccctctttgcttctttccctccccacccccccaccccccacctcaccccccacactccagcaccggcttttaattttcaaaagcactgcaattgcttggtgtggtttcaagagctggggtgccattctccctgatgatgactctgctgacgtcaatggcattcttatcatgcctagtgcgacatcagaaaccagtcctcagaggctcctcttattcacagtgcctgggctctcagcaaaatgtggaccggattctgaaacgcaaaggactccccgttcctaatcagcgctgcaatccaccagacagtctccttctgccggcagcttgccagttaagactttgttccttagcgttctgtcctgcaaggaccccctgaaggagaagagagggctaagtggatcacagcgtgtcctccgtgtctgagctttcagagccgtgtgtgtgtgtgtgtgtgtgtgtgtgtgtgtgtgtgtccctcaaccaaggttagagactagtcaatgctgcttctgattattcttcaggttttactaaaaggcttcagtctttgatataaggctattcccccgacacagtggctaagaccctcttgtgtaagtgctcctagctcactctctggatcagaaccagcgcccaggtccccacgtgaagcccatattcaccccagatggcagcatgcacctcctctcctttttttaataaagaaaaagaaataggaggttgggaggagaaggaaaataatcatagctgaataataatagcagaataggaaaatagtatcactaagaattaaatatttcactctaaatactcatgacttgttaagaggtctgctctcaaaagctgaattcacaagggagttaatacatactaaacccagtatgcattcctacctagcagtttgggggcaattattatggggatgatgaactttctccatttacagtggagtgtattatggtccaaatctaccctaaagcatttgggaaatgtctacagttcaaattaagatgtttagagtcaaggtcatttcgcttgatgatggaatgatacatgtctagttagatttcatctgaccaatctttgacacaaacacatcagaattgtcttggtatccaccaaccaaataatgtttgtttctcttgaagattgctgagtgacccatagtaagcttattaggagattaggagcaactgttccagagagaagctgtttaacaacatatgaaatgtgcaacataattccatctagaactatttagaatcataacatggaagaacagcagcttacacctggttcaacccttctacctttaagtgaggaaactgatgcccaaaggctgcgtcatgctttactcaaggtcatccacctattaagaggcaggactgacaaactaaagctgtctctctctaaatggtatgcttttcctactacaacacatagctcctgattattcaaaacctaatgaccaaacctcaaacccacttgccaagggagtttccatttttcttttaaatctgagcaatatttcttaattttttgattaaagtgatatttcaggaatgtttagatgaattataatgagtttctcctttgttttcagtgagtttcacaactagtgtaaaggttattaagtagaatggaacaaaataatatatgttggaatgcatgaaattcagatggttttgttctttgttattttttgtagagacagcatctccctatgttgcccaggctggtctcaaactcctgggctcaagtaatcctcctgccttgcctcccaaagtgctgagattacagatgtaagccactgagcccagcaaagacgtgtttttaaaaagtgatgatgggctctgggaagaaggagcaaagatttatctgggttccaaatgtatgagctccctgagcccagccatcattctgcttcatctactacatagctctcaccatggtttgtaacattgcttgctaatatattttatttgccacctaattcaagccattaagttaatattcgattatataaatatgatctttatagttactttttccctatccccaatagttttgccttctcttcagaggactgtaactgcttctataaatcaccttttgctactctctttttggtagacgtgcatcacattctggtcgcgaatggtgaggagatggggcagatgctggttttagagtcagacaaacctgtgttggaaacctggcttaaccacttgctactatataatttcaagacataacttctctgagcctcagtttccttatctataaaatatgaccctaccttgcagggttattgaaagggttagagatgatgtttactaaagtcctatcacaatgcctagcacataggagaaactcaatcaaggataattttattaatgatttttaaaaaataaatggggaaaatcataaaattaataaagattagtaagattgaacaaaggacatatagtatttccccccttataaccagagctgttcctcagtaccactaaaattggaaggacaatatttctttaaagaatttttctagtgaaaagctaagccaaatatatgatcattggcctgcattatgaatgcatgtttcactgagtatctgattataattggatgtcaaatagctacaaaacctaattgtggtctcaaaaattgtctcttctccctgagacaaacatccaatatttcctaggtgataactaagctttgtgtacactgagataagacgccaaatcaattccttaaacttaaaggcacaaaggtttcggaaagcctcattgtccatttgagagacaagccacggcatctcgtaaagcacattttcactgtatactatgttactacaaaattgagttaatttcattaataacaaaatttatcaaaataaaaatgctttctcctttgcaggaatccataaataacataaaataataatagcattttaactcagaagcaaattacagccatgactgtttaagttggctaacccaaatttcgtaagtgaaactggagtggtctgcgtaagtcctagattgcatatgattcagggaaacccagatgtcaaaagggtgtgtgaatcaaaagaaggtattcatcttggtgatttagccctgaaccaatcaattcttcccagagcactggagaaaaagttcttgtttctaatggaatcatcctgcccttacctacctagtaaaaattttgtacccaatcaataccttagtcaactttaaattcctgaatagcccttctgcctcattcaagtgaatggaaagaaaaggtttaatcatatttaaatactccagactattgagtaaagttaaatgcaaatttggtcatgttattcccttctttaaaaccatccattcattagtgatgatccattcacctaactatgccctcagcaggcagggctgttagcctgaggaaggggtgcccttttctatttcatccagctagaagatggccctttggaatctatctgctcaatgatattgtatttctagaatataaaaaagatgccttaaatatacaaaaggcacagggggagtcctttttaggtctcagtttaaggctgatttctgagttggttatatgctctcacagcaatttgtatgttgccttcatggtgcttaaggcagttcaatcatacattttgtttttctttcccctactagagtataaggtagaaattgtgactatatttttcactttcgtatccccaactccatcccagtgcctagtacacaagtaccaggtactttattgactgatacacaagtactagtgaattaaaaaattgttatataaagttgggttgttgtcttgtccaatagtagctgtgtttcgcactgcaagtcatttttgagagcatatgaaataactctatgtcctcatgaatgactttatcataatcattcctgaacagcacgggcgtgtggtattccaaaagggagttttactggcccttggttaaatttaaagaaataataaggccaatttaaaacacacacacacacacacacacacacacacacacacacacacacacacattaatgagagatttctaagccccccatgggagatgactgccctttttgtccttgttttgcatattaaaagtatatagaatgtggaaaataaatgtcataatatgaaatcatggttccagtatatgttagtgtgttctgttgaaaatagttttgtttggcaaaaatgaagagttggtaattgtatgttgggcctcacagttttttgttttgaaattccaaagtctgggaaccattgacttagcagggttttcccatcagaacacagatttgagggtttttaaggatacatgtcttagtttctagtcgcgtatggctccaacctacaatccttccttctttcgggtcccacctttattttttacttttctgatagttcccacaactttgcccacaaagttgccaattcctaaatattattatcaaagtgcaattttgtataccccaaagctaatatataattaattttactataagagaaatcagttaaaatgtaaaaagtttaataatatacattataataatggccctggtacactcccccaccgttctttggaataagcaaaggtataacccttgaaagtaaaattaacttttctttgcacatattagacttctcaatggtgtgccaaagagtggagatgacaggtgagccaagctattgatttcccttggctcttgtcgctagtgggtgggagactgaacacaagccacatcctttatttactgcagttttcgtagaaatatagttatcagcgtatgtcatgaaggaacaaatgtggggaagtactgacctaaataacttttacgtgattcagtatacatgtaaattgaaataaagaatattaaatctcaaaactatccagaggaccttattcaatggtataatatttcaaatttaattttttattacagtatattttcaggtacagttttaaaaatggggagcatgcaattaacgaatacataaaaataacactagtttaatcttccctttaagaaaagttcctgtttgctattcctgttacatatacaggcataggacttcatggcctttaagacatgttgataatattaacatttccacttgattgtgggaagtagcattcattttcagctttgcttagagcttattaacctgatgtcaacaagatatactagaaatgtccttgtcagtccaaacccacaagtagaaatgatcatgttgttgaatgtgttcagtctgatttgacaacggtaacaagtcaacactgttctgctaaaggaaggtcaatcatcccattgcaccagggatttctttatttcttttgctaacattagcattatgaccagtgtatgtcaaagaatacattgggataaaaaattctgcttgtccatttctgtttttccattctcttatgacttagagaattgaaaaattaatctcaatttttttctgtctgtaaatatacaatatatatatacacacactcttacacaaaatctctgaaaatgctgtcacatgcatgaaacacaaaatgaaaaaggtagagattttttcataaacatgaaacagaaaaaactttcctcctcactacaattcatagctaggattcatgattttctagtaagagtagcaaaatggatgccgattctatggcatagaagaccaatggctttagacctggattcaaattttaactctgccacttcctagcttggtgaagataagcaagttaagtcttagttttctcatttgtaaattggagtccatagagtcgtgaggatttcacaaggtaatttatttgaagcatttggcacaacacctggtacaaattaggaactcaagcaacagaagacacagcattaaaatacagtgcactacatcaggacattacaaaagcttaatttaataaatctcttgtctgattcattctaattctgctagtatactgtagaaaagtacactaggtcctgtttgtggcctccccaggtcagctctgcccaccctaccccttgggcataagccactctcccagtttcccaggcatgccacagcagccccagtaaagcagcggttatcactgcaattgcctcatgttttccacctccccatccttgcgggcttagcgtgggcaatggcctctgacttgacaggaaccatccagctacacgtgagatggacaaaggctctgtattccccagggactctgggagggccaagggtaccatggagcaaactttgaccaatgagagacaaaagacctatgcacagaaaaattgctcaccctttcttctccatgtggaatgttttacgacacagcctcacaggcaatgtcccttgtaacttagcaactagttttgttgttgttgttgttgttgttgttgttgggaagctctgacaagcttagtaatgcattaccttgtacatggtttctcttcttccctactgctgttcctttcaccccctcaactccacttttgctttcttgggattgcatgactcacctccctcataaagctagcatgtaagctgtccctagggaatttgatcaaaaactgtgagatttagaaaaaaagatgaggcaactagatacagtacaagaatgaaagagaaaaagtcataatatttgacatcaatttacttatctatgattccttggattctctcagtagtggaagctcttaagaccacattaccaccttattaacaaagaataactgataaaatcaacgggacaatgggcctttgagaacaaaccatcattaattttgttccacagagtccaatttcaattataacctaagatatgtttggaaccacttaatgctattttatgagagagagacagttttctctttgaaaagtcatgttcctttgaatttaactaaaacgtaacaggatgttaaaacgaaaccctggcatttttctttccttcagaaatatgcccacattttatagagaaagctatatattgaggttctgcaaacaacaaaatgcaattttcacattaaacatggattctaacatctggcatttctcctagtgcttgcacataattatccaaaattgcagtttttccaacaggggacccacagtggtagctctgattcattccacattatatatatgaccctttctcatagtgagggtggtcttcaacaccaatgctcctgactgctatcttccttcaacttacatggaatacttttcctcatggctccaaatgtatgagctctaggttgttattcagggttctttcatcctcattttttgtaccttttatgactactttctgaaaaggcacatttgctgagttggcgcctcacaggtggtttggtttgtggcatattttaatagctatgaaaccatgagttcagctattgggttgcaatgagttacataatgcatgtgcaattcagtgcgcaccaacaagaagattttcctaagaccccaaatgacccaggaaacggacacattgaaggggttgcacctcaccaaatgtccctgacaaggatgcacttatttggaaggatgtgcccttactctgaaggctggtggtctgaggagagtagatgtggtaatcatccaactacattaaggcacatttatttctgttgctttttggttcattttattttgatttggtttgttttctgttcttagcaatcagtccattttatgagtactttggcaagtagtagcaaaagctgttttctctaggaaatttttaacctttcaaacacagcagagatgttagggacattataaattcaattaaatgtggtccctgtttctggggttgatggtcataaccatttttctttttcttaccactccagtttaatttacttggaatgaaaaaagtaaatctgagcttctgaggattatcagttgagattctgggcctttaaacacaatcctctctggtctggacttatttgcaacccagcacttccagaaatgcccatcattagctcaggaggatgaactccaaataatccacgttctatttatctcattattctctatatttatgtattcattcaatacgtatatctcccatacgccagcactatgcagatgatagggacatcattttgaacaaaacagaaaaaccactgcctgaagatactgggccatgaaattctgttcaaagatatgttttggcattcattttgcaaatctctacatagcatgaggaggaatgaaaagaataaattatatccttcacttattcatgcattcgttgtccatttatttaaaaaacatttattgagaatctattttgtgataggtactgcaccgaatgccaggaaaaacaagcataaaagatacagggtgtccagaaaccatctgaaaggatgaatttgactactcaaatattttaaaagactaaatgataaaaaaaaaaaaccctaaacaaattaaaattttttgaaaagtttacacaaatgaggagagttcattttcttaatatactcaaaacattaacatatccataaaaaataaactcctcaagataattgattcaatgagtctttggaggtaggagggaactggcccataaatgtatgaaaggtgactaattttctttgcaattaaattagatggggaaaatatgttttttgtgaatctcagggtcagtgtgtatagaaatacaagcatttcttgtgatgatggtgggattgtaacttaatatattctttttagaagacagcttggcaatatttatgaaaattttaaattcagtttcacagctaagactttattcaatgggtaaactcacaaagatgttcaggcacaaggatgcctgcagtgttatttgtattaattgtagtaaaaactggaaatgacccacaagactatcaatagagttaaatgggtttttagacataacataatgcaatactatgtgtcaaataagaatgatcattatctctagatcatgatctgtataagtccatacaaaagggccccaagatacactattaaattacaaagagcttggtgcagaatagtatttgtaatactctcttggaggatatgcaagaaactattaacactttactcccgacagtcatgaccaagcaattagagttgccccaggtaacatctatttgctatcctgctctgtcacataacatttactgtaagtagagctctctctgagaaatgtgctggtccaagctctttgaatatttgtatacagttaaaatcacgaagaactgaagatcactgcaattttcaaaggaatgaggactttaaaaggacagcagcagcaagggaaaggtagggtgaccaacttgtcctaatttgtccaagacttccccagttttagcactgaatgccccacatcccaggaaatccctcagtgccaggcaaactggaacagctgatcaccctcacctgccttggggctgctgcagaggcctaagcatgaaccgtagacacaagagaaactgagaaactttctttctgcccccatcctggcttccctgtacctctgcccagatgccaaagagtcctcctcactttcccacagccacaactcccgacttcccttgcacctctgtcctttggtacaaagatttctacgtttgcgttagtgatgtgacctcttggattaggatttccaaaactagaaatgtttttggagtttatgtagggttttacaggagaaaagaagctattgtgaaagaactgtgagggaaggaattggatataggaacaaaagttattttgggggctagaaatcataaatctaaatgggttttcaaggcaaagaaaaacttcatggtatagataggaaaggatacagtattattcattagaaaaatggaaatggtatctatgaaattaatttagatttaaacaagaatattttaagagggaaagtttcttttttttttttttttcttgagatggagtctcgctctgtcgcccaggctggagtgcagtggcgagatctcagctcgctgcaagctccgcctcccgggttcacgccattctcctgcctcagcctccctagtagctgggactacaggcgcccgccaccacgcgtggctaattttttgtatttttagtagagacagggtttcaccgtattaaccaggatggtctggatctcctgacttcttgatctgcctgcctcggcctcccaaagtgctgggattacaggcgtaagccaccacgcccagccttaagggggaaactttcaagagagaaaaacgccaaccctgagggaatatgggattaaaaaatgtatcagtaatttatatgcttctgacactttctatgtgactcagaatactctgctgggaatagctaatggcagaaaatttcaattattcccagttgcaggtgctgtgttgtgaaaggcacaatagcccctagcaaccctaacgaggttaaaggaacagtccctgaggaatctcactgttagtatccatggcaagagaaaagctaaacactggggatacatattacttcacttttgtccctgaaattgggcaaagtttcagatttgagaatggcatcagaagtatagctgtttagtgcatgtgtttctcatcatagtattgatattcatttcacatatattcccacagtaaccatttactgaaggaaagccaaagccattttagcttgattacattttctttttttggtttgttttttttagacggaatctcgctgtgttgcccaggctggagtgcagtggcacgagctcagctcactgcaacctctgcctcctgggctcaagtgattctcctgcctcagcctcctgagtagctgggactacaggtgcatgccaccacacctggctatttttgtattttgagtagagatggggtttcaccatattagtcaggctagtctcgaactcctgaccttgtgatccacccgcctcccaagattacattgtctaagacttcctacagaaagacaacttcatttgatattattcacaagccatctagtctcttgccttcaacatttttggccatgtagtgggtgggtgtgctcctttttgcactgatagatcagcagccatgccacttttctaaaaccatatttattttgccccctgtatcatccattcagtcatttaaccaatatttgctaggaaatgagtgagccattttagcttgattacattttctggggtttcatagatgactaagatgtagcgtccactctcaggagttaaggatacattaaggaagacagataaaaccaactaatattatgacattgtaggatgaaagaggtgtgtgaaagatttatgaaagtatagaggaggaatgcttaaattcgggagaaattcaggaatagctatctcaaggggcaagtaggtaccctgcagtttctataaaaggtgaaggtagggaagacttacagggagactgaacaatatacgcaaaagttacagaggtgtgggagagcttggcttgatcaggaaactatacactgcaggctagaatcaatgagtgctttggaaggaaggggatgcacatgggagaaaggaacctagaaaggtaagtcgcagacaatgagggaaaggcaaaagacaggacatttacatttactgagcttttattttgtgccaggctttttatgtttggtatctcacacaattactccagtaacttcctgacaatgtttgttactccattatgcagatgaggaaacagaagatggggaaggttatacctgggctgacccattttttgaggccaggtgtatctaataccaaagaccctggtcattttaccgcagaacattgtttctagaaggaagtttaaactttaccctgaaggcattgcagactctgatggacatcaacaggagagaggtatgatcataattggattttattttgagacagggtctcactgtcgcctaggctggagtgcagtggagcaatcacggctcactgcagtctcaacctcccaggctctgcctcccaagtagctgggactactggaacctactgccatgccaatttttttattttttttatttttatttttggtagagatggggttttgccatgttgtccaggctggtctcaaactcctgggctcaagcaatctgcccatctcagcctcccaaaatactaggattacaggtgtgagctattgcacctggacttaactccattttagaaaaaaactaaaaaactaaaaaaactaaaaaactgtcgtgtggaggaggaggaactgagaaactgggggcttttcctaggatgacagagaaacattttcctgcaacaaacttcaatgtctaccatcacatacatacaagtctaagtttcataggccttgatgttgtcattcttgcatttatgcctagaaacatgtaagtctgagatgtaaattgcagaactaaagatgatggattccagaaactctgatccacctaagagaggagtaggattgtggaaggcacataagggtaaaatagtatcacatttctaaacttgaaaaactcaattcaaatatgtgcagattcagtcccatatgaacagccatgttggctagaggacatcatacttctcaagggcaacagagatgctgggagcagattaagtagttataacttgcacctgtgtaattactatagcgagtcacacttctgtcaaatgatcctattgctttaaaagtttgagatgatgcctggtctaagagctttctttagctgcatgtctcaatgtggctataaatttcagtcaagtcatgtcctgcacattgggtctaattaaagaacacaagagtgagaagggcagggtatacactcagggatggtggagttagtttatttcttggatggaaaatttaacggtcattataatgcctctttgggttggaaatacagattcttatgtacacattcattttgcacaaatgaaaatggtaaaccaaaatcagagagtgttgaagttcttaaactaaagactaccttatagtgagctctagtaaagaaggttagaaacaatttttaagaaaatttaataacaatatttcagagaaaaatttgttactgaatattttccagaaatagtaacaagacatctgtattcaagtagatacaagtgattgtaccagagggtcaatattttgagatggcaagcacacattcttatcataaagatatggtacaggaactagaagagatgtaatattccttgacgtgattctgtcataaaaggttaacaatgttacatcttagggccaaggagacaatcctttgaaggttgcaaaggactggctagagtcaggaatcatcagcgtattcctttaaagataaaaattatatatatgcatacaagtgctacttttaaaatcaggaatgatcttctatttttaggggccaaagagaagagttaaaaactataaatggatatttgacttatgtggcagaagaaaagttcagaggtttcaggatctgcaggtgagaagaaaatgtaaactaaatggcaatctgttcagtgattttaaaattcctaacaaaatgcatttcctacaaatgttgctacctgaaaagtaacaattagacatccatttatttgtacttacataataaaaatatttcagagtaatgtataccactgtctaagtctttctgttctttatctgtagccaaacctacttgcccaaattagttgtactaagagttttcaggctgtttacaactgaaaccatcttacaaagtattttaggccacatttgttttgttgatgaggccaagagaagtgaaatagtttttccaggggcatgcagtctgttattaacaaagttaagactatggacaatttcaggatcttgttccttggtgttttggaggttctgaggaagttggtgaaaggcttctcctggaaagtaaatgtggttaagagccaaccaggtgaggctccaggcctactgcctcacttcacctaaagcagatgggctgtgttacagagacttatagaccgggctttttttgaagactatttatttgaaacatctcttctgtcaaatgaatttttaaatgctaaatgaaattttttaaattttaaatgagtggcccacgctaatgtattaggcatgtgaaagggacgatgttgtggacatcggcaggcagcctacatgttcctgaaggtcagacccgtaacccattcatcttggaattttcctcacttggtgccttttaaaaggggatttaaaggcaatagggtctggaggttcttgcagttatagcttcaggggctcccttctgatcttgcacagttttctaattattcccttgttttcttccactgacccatgggatgtggttaacttgtgtcttctaaggccagctgtgactttttccttacccacgttacttccaagttgggaacacaatcttgcaacctggccccaccctgttgtctctgcacaagcctgaaaactcaggtaaatgaatgaatgaatgaatattaggctgataataactacagggaaaaagataagaggtaagaaaaataacagtgatgaaattagcaggcaatagagcccctaaatatcaaaggaaggtaaatgagttcattctagcattccactagccctcttaggctttgtcatgattgctttctcttttttctgtttacgttaatattttgtttctgaaatgcatctcatcctttcctccctatagagtctcctaaattgctttcttttctccccaaccttcattttttcctccttcactttcccactttcaattctaatttccaattagatcacttaggtttacaataatccccaacactacgtattattcccatctcaaagcaaactttagattgtaaccttcaaattcaaagtcccttatacagttttattctggaaaagttgacttcaagcaattattgattggcttgacttcttgctaaattttgcctaaaggcgagcctttttgaaatcacacaaagggtggaaaccacacaaaagtagtggttctcaaactaggtgggaattcataatggttataaagaatgaaatgggctggtcacagtggctcatgcctgtaatcccagcactttgggaggcccaggcgggcggatcatgaggttaggagatcgagtgaaaccccatctctactaaaaatacaacaaattagccaggcgtggtggcacacgcctgtagtcccagctactcgggaggctgaggcaggagaatcgcttgaaagcaggaggcagaggtttcagtgagccgagatcgtgccactgcactccagcctgggtgacagagcgagactccatctcaaaaaaagaaatgtaagtaatggattatttgggagttaggtaaggagcactgaaaaatatgttctaaaatttatattcatgaaaaataactgtatttttatttttaaaaaataacatttattaatagagattctatagaggaatgaagttactttttatttcctttcttttcctttactgtttccttctttccttccttccttccttcccttacttcctgcctccatcccttcctccttcccttcctccctccttccctccctcccttcctccttccctccctcttttccttctttcttccttccctccctcccttctcatcttggaatgagaatacacaaatcctcagttaactctacacttttattcaaacacaaacttcagttgccttgactagttttacagtaagaatttaattttgaagaaaacaaaaattaaatgtcactatcaataaatcaacctaaagatcaagtagatgtatagcatgggcagatatatcaatttaatatagggattaagaggttgtggagtcagcctgacccagtctggacttcagctgcaccgcttactgtgcatgtccttgagcgagttaactaaaatataccacacatccatctgcaagcatagcagtgaaggttaaataataatatgtacatgaaaaacttggactgtgcatgggacatagtaagtactcaataaatattataattaatacagttttgcaaaacatagtatctcatactgctcacatcactgcaaagtgataaagcaaaggacatcccaatatcctacctaagaaaattagtgttcaggcaatatttaattcatgtgcttctagtgctatttataattatctcattcaaatgtcattttgtaacaagtatttgatgtcccagctgacttgattctagacctagaacttggaaccaataataaattggtgggctttgaacttggaaaagcttgtgatagagtctaaagttttaattccacagggttgatgttggttcactgcttgtcacgatgtgcaattgaagctggctatcaaagcagaataaggcaaaggtactttaactccttcacaatcacatgttttcactttaatccaattatagctgctagtcacatgctttaaagatcacagatccaaataaagaaaccatcgggggtttctctatggcttataaaggagcaacatcttttatgactttaattagtctaattttctattgttaaagagaaaagaattatctgtccttaactaaggcagtcagttgtgcacaaagccaaacgtgctgtgggtcaggagatgtgagttctgacctctgaccaaccatgacctctctgagtactgagactagtcactggctgtctctggtttcactttccttgtttctaaaatcaatccttgcactgatgatcagtgagatcctttctagccatcatagcctattatttcatacaaagtgatttttccagaataactaaaaagctgtaaatggtatgttcagagatgacaaaatgagacagtaaataaagggtaaacgtatgtctccagaaagcaaaaataaataaataatactcaatgagaaaaaagatgagtggtgttttgaatattaacctctatgatatttcagttattaaaattagcttcatagttaattggctgatataacaggactttgtgtttcttaagcaagtatttgttaaacactgatgaagtctgtagtttatatctaagccccatgaagtttacaacatttgagttcaacaaagtttatcttgcaggagcttgcaatcaagtagatgagtaaaaagtacggatttaatatacattgcttaaaaggttacatataaatcacatcaagccaaaatatcagcctagttaagttgcttgacccagggttataactcgaatacacaggtctctggatttcccttttagagaccgtattccctttaatagggtttaatgggggggggggggggaaccatccagaagctgattgttgttattgttttataaatgtctttgttcttttaaaggtatgtttaatatgctgtttttattacagactatgtatccatgaaaagtaagtttgaaaatgcagaacatagattttttttctcaaagaaaataaagggtgaatttaatggaatgatcattttcaactggaaaggtgtatttgttgaatgctttttgtgagcactcaataatttagcttttggagcattctccatacagtctaatttaatatttgtaatgatccatagtgttatcactatcccacatgacagtaatggaaatgaggttcctggaggtccagtgatttttctgaatttaccaagtaaatatttgggaaagtgaaattaaacccaggctggcaggctggaaaatgtgtgctcttccgaatctttcatcttcttctggttcttggtgcttctctggaattttgcatacagagagaaggggacaggttcttttcacttttgatgtacagaggttatgagaaaataatcttaagaaatttactgaacagctcggttactaaaaatgtacatctatctttccgcatgatttttaagaagtgagattcccaatgaatggatttaaaatgcaattttacattcacctagaatgaatgtgcagatctttcctaaagatataagaaatcgactgaagtaagcaagaaaaacactattccggaattgcaaagggtatccctgaagagtatgtgtgaatgccataaaagttatactatatctaatattatcgagccctaattgaaagccgctgatttcacctacataattccatgtctgcgaaatcatgtggtgtttctagtgaacataaacacatttacagttaaggaaaacttaaaatatgtatccaaagataagttcaataggtttaaaaacccaaaatctggctgggcgcagtggctcatgcctgtaatcccagcactttgtgaggctgaggtgggtggatcacccgagttcaggagtttgaaaccagcctggccaacatggtgaaaccctgtccctactaaaaatacaaaaattagctgggcgtgatgacatacgcctgtagtcccagctactcgggaggctaaggcaggagaatcgcttgaacctgggaggtggaggttgcagtgagctgagatcctgccactgcactccagcctgggtgacagagcaagattccgtctccaataaataaatagatacatatatacatacacacccaatatcttgttcttattctttttaaactaaaaaaaaatatacacataactgtaggaagctttccttttcctttctgatagacacctttgaaatattaacttggtcagattcaacccttcctatgtttttaagagtgctagccaatatgtattttgcttgtatatgcataagatttgtttacataatacacaagaagctgttaataatcgatcctttctagggcacgttttgaattttgaagcatacgaatcaattatcttttaaaatattttcaattaaaaaaagttctagggtggtactacaggcaaggtatgatggaagtgccacattctcaaagccactgaagagagccagttgaaagttagcaaatgagttagttgtttcatcaagaaatggaagtggtctgatttttttttttttccaaatcaaataatgcagtacagtgcaaattcttgaaagatacttttattttcaaattgtacttggaagttcttcttattctgattctgttgagcagtgcaataggattacattggtagtataattgaataaggctctgtacagaaaaactataaaaaacaattgcctattgctttatttcctgagaaaaaaaattaccttttgataaaataagtagaaatgctgaaaagaatgtattcaagttagaagtatactccccactgaacacctctttcacatttctggcccatatagcagggatccccaacctccaagccacagactgcttccggtccatggcctgttaggaacctggtggcacagcaggaagtgagcagcaggcaagcgagcattaccacctgagctttatctcctgtcagatcagtgggactgtgaatcctattgtgaactgtgcatgcgaggcatctaggttgtgcactccttatgagaatctaatgcctgatgatctgaggtggtttcatcccaaaaccaacccctctccccaccatccatggaaaaattgtcttccatgaagccagtccctggtgccaaaaaggttggggaccactgctgtatagctacaacactcaagaatacatggcagttccatttaaattttaaaaattgaatgtctttggtttaaaatattgaatggttttaaatattccttataatgcaagaccacatcttaagctacaatggagggtaaaggacaaaggctatatttgaaaagtagaaaggaaatacaagagttttcagttaaattggaagattttttttaaaaaaaacctcaaacattttctaaaccctcaaattattcctaagatgcattcaactttgaatacattgataaaattcattgcttgacaaagttgcctatatttttcattgaattgggcagtggtgtgattgaattggccaaatcagaacctagagtgagcattctataaactcacctttactttgatccttgaagatcacaagttttgatactgttgaaatctctactctttcaacactttaattaaatggcatttagaatttcatatacttctgttgttgtttccacaatcttaaactggatttagaaatacttataatgtaaatgcaagagctttaacttagtaactgtatttcctattttttgttgtttttcttttgccagaatttctgtttgtctacaataaagtccagcgaaatacagtatttggttaggttacttgttaacataaaattttatcatttgtagagtttttacttaaccttcctattctctagtctctataatctttcaatgaagataaccagttacgaatatctcctataccatattaggcctgccagaatgtgatttcttggtataaagtgattttcaaatgttttcctaactcagtagccacttccatcatttatatctgagttatttcctctttttcttaatagagaaatgaattgatattcaagccaataattgatattcaagtgacatagttatgtcactaatgaaggtaacccatcctcagctaggaaaaaaaaaatatgtattttccaaaactgctgacttttactttgttgtcagtgaccttggagtcctggttctatactgtataggctgtgtgaccttatttcagttgagggtagaagagaaaaattatattgcaaaagtgggaaagaaacacacttataagattttcagtggaacttgagaggacttttcatttttctttttactataactcctcaaacagtatctaaaccttcaagttgttgtttctctccttctctaagcttcagtgctctcatttgtttcatggagataataaaaaacatctgtgcctcatctcatttatagcatggagacaatgacaatagatccacacctcaaacagtgtggagagggtgaaatgatgatgtagagagaaagcgtatcccagcacctgcatggtaaccactcagcacaagttatttgttattgttttaattggttacgaattgtattttacatataacctgtcctgtctggaataaatccattaccaatgaaaacttttaaataggaactccgtagatgataggttattcaataaagatctactggaaataaaactgttttccaaaataaaatatatagcggtgtgtgtgtgtgtgtgtgtgtgtgtgtgtgtgtgtgtatctgtgtgtgtacatacacattttaaaaaattgattctgttctcaatagcagaaaaaagtctttccactaccttaaacccacatttgactcaaatacactaacgatatgtaaccactgttcaaaggaaaagctgacggacattaggctgcggaatcctgcaatgcttgtgctcagcttgggcctgggtgtcaggataggaataggagatgccagacctgtttggtagtagtggtagtagtcattgcctaacctaggcaatcatcagctcatgggatttggtgctttaagcaaaggtgttaattattcccctcctcccttttagtaccattttctcttaaactaacacccatctttgggcttaactaagcagaaaagcaaacagggaagaaccaggtggttaaggaccagtgtcttaaagtaaatactctgtatttgagtccaaaatgaatttcaaactcaggttagatgtttcttcttaatcacttaggagccagtaagactctctaagccttccttcctacgctctttcactaaaggaccaggttctttcaggtgctatcctatttggaatttaatttgccctaacatttctccaagagccattacagcacaccacattgctgtatcccatttaactcccaaaccgcagagaagctggctgcagcatcaaacactattaaaaataccacaagggaaccttagagtgggatttcaggcacaagttacagcctaaggacaaacagcggttgtaaagagcttgaatgatactggaatggagatttaggagaattttcagagtctgaaaaaacagtccttaagattttagtgttggttcctagggctggttctccgtggttatatgggttagttaaaacattagagtaactttgcctttctccctctctcctcgagttttttttttttttttttttttttcggtcaacagatttggtaccaagagtgactacaagtgagaatggcttaacaaatatttccaagaagaggttcctatcactaggccttgcaaaggaacaacagactcattagatttttttttaacctgaatatctttattgtgccatctaagcacttatttgaaagtcttcaggtgtaatcctgattcagggtgtttaaaatgcaaatgcagaaattagcccagccatggctacacaagaggccccaggcatttcaaatttgaatgaatattttggaaatggagcagaaacttaatggattagtcattatttagagtcctgtcatgtgggaggtccaaattcagagccttagagcggggaggaatatgttatagtgtggtggtggcagcctcaaaataggtagtagtggtggtgaaggtggaggaggaatatgaggataaggatggtttttctgggtggaagaacaagaggaagagaagccagtacttgcctttcaagctctgcagtagtatcactgcaaactgagcacaacaatggaagaaatggcttctggcatccacttgctcattttctcttattggccaacatacttctggaatcttctcaaaagatccattctgacagactttttattttcccataaaattccaggagcatgtgtagactggacttctgggcttccattcttatagaatgtttccttcatataaaatgcttcagtttggaattttacattcagtacagattatttcattaatacagtgcatatctcccctgtcctggaccctagattataaggagtaagaatggggataatgcttctttttggtcatcaatgtatctcaagagctttgattagggcctggcacatggaagactctcaaaaaagtattgtttaaaaaaatgtctgaattgttaaatggacctggtctgaatatctaatccaaaggcaggcaattcatgggtttaccagcagccaataatctataatatttaaccacagtggaaagttacctcattgtatttgtaaatttgtaggctcaagttgcaattataaatgggaaattgcaactaaggtaattggtgtcaagagaaaaaaaaatttttaaatctactgatggcctaaaattgggcctagagaagctatggcaagccatgtacaaactcaggcaatgagaaagcagacactatggagagtagagaactatctctagaaaacaaaaaccagaccagatatataaataaacaaagggcagagtcctgagaaagacaccatatttactacaagcaaaagaagaagtttcaggtgcctagaactgtgatggttcccaaaacttctaaaccctagtccacctgtgtccatgtgagaatgacatttattttgatctagttatttctggtaaccgagctgatccagtgaggatattgtcatatggtgatgagggacgtttgtgaattactatgtaaagaaaagatgcttactctgtgccagtagcttgggaatctggaatcccttcctgtaagcctcagagtgtttccaggaaaagtcaccaaatagctttgattcaaggaaatgaatctcttctgtcctgtactggctgcttgaaaacatagtcacctgagtaatatgagtccaaagtactacattacatctcagtgtttcttgcaattgactaacatgtagaaattgtgcttggctgggatctcacagttatctggttggtttctgtctgctgcatggagctcacttcctggtagtgaccatagaaggaggcattatctttttccagtcactaaaaactatatgaacatcaacaataacctaatttgtgagctctctggcaggaatgaaattcctctttataatcactgatggtactccctgtgtatggcagcagagtgacacacgctgtcctagtggaacataccctcactttgccttgtgtttaaagctgggcaccacttctaccttagggagagagatggtgcgaaagcagaagtgaggaatcacagatgggacagagttggactgggtgatgctgcagtgaggaatgagggagcatgatgaaggaagaatgatataattttagggagctgggaatgaatagggtgaagagggagagaaaagaggagatttagacaaagaatgggaaacaagacaaataagggaaggagtgagggaagagactggaaaaagaagaggcagatataaggaaaggaaaaaggcaagagaatagagtagagaacatgtgaaaaggagaagatcggagaaaacaaatgaactgagataaaatttgagggaggcagcagagtgttgactgcagggtgtggaatctgaaatataactgccaagttttgaagcctggctccacagctttccagaataatgaccatgggacatatccctaaattctctgagcctcagtttcttcttctgtaaaatgggaataataattttacctaccttatgtgatcatgcatgcccagtcttagcacagtgtttggcacacagaattgttattattgaggttaaaagagagaaacaaagcaaagaaaataataaaatggaggaagtaggaaagagagatgttcagacagtggaaggatggaaaagaaatgtatttctgctaataattttaaccttagtttttccacattataatcaagatttctatgcctactatattgtttctacctgctttaataacagctggaaaaacatgttgagtatgaacataccttttttaaaggtatttttgtattaaaccagcctgtaatagtttgcaaaacagatgttcacatttccttgagttgaaattattccctagaaatgagtaagacgaaggatacatgaagctaaaccggtcatccaaaaaacggtttgtttatttgccctacctctttactgtattgactaggtcgtttgatgggattaactaaattgaccggttattttgaaatgtgttaacccaactgtaggctttagggaaaataaagcccctagtgttcttggtggtgtttctttccaagtttctctccacaacacaaaccacttccttttacttgaagtcattttgcttttctcattagtctcacagtccaggggctggtgttgagtgctgaggcagctctcagttcaagaccataaaacaacacaacaaaattagcccaaaacataaaaggaaagcactgtggagttgttcttctcctctcaagaaaaggaaagtggaagttagggcagataaagtatgagaaagagatcagagatctattcttgcataggggtggggaggtagaatgaatgaaaccacagcccaagtcagagggaaagaaaatggaaggagcaaaaacaacaaaaatcccccaccacctctctcgacattcatcacaacaactctctgtgcacctggcatggtgctgcacagttgtcagatcccaggcatgactccctagtgtttccatgaggctgaataaatagtgttctcacagactctccagtagcagcgggtgaaaggccaaccttcattgaccactataaggcttttcttaaatgctactcggacacaccaaaagaaatgttgtccttttcacaaaaacatgtccttgttcaggaccatgtaagttatttaaaataatggtcaatgaaacaaatatagcaatggtatcgcttctcacattttcctcattctgctcagagggctgacagagtggagaagatcatccatcatccacttctttcaagttactcccttctgccaaagggattaagagacacattttcatcccactttctcaaataggagaaaaagttttccatgctggtttctactgttccatgttttgctcttatattgcacccaagaatcatttcaagatgttctgagaagagatgtaaaagagtcagctgatcttccctacttcaggtctattgaacacaggtaagttggcatgacagtgccccagaaccacacactagtactatgtgtggttataacaaaagaattgctatactggtgggcagggtttttttttttgttgttgttgtttttttttaataaagaggcatagaccataatttttagagcaatttcattaggttatgctagaggtaggtttgggagaagagcctgactcggcctgaggaaggggactgggcttgaattttaggtgtcctctaaaatgagataaagtgaaccaggcaattatgagagagaagcgagttttagatggtgagaagagtacaagtaaatgaagacagttgtgaaacatggtgcacgtgggtggaaaaagtttgctgctgaaagagtcagccaggggctgggctggagaggaggtacaatacatatctggataggggctttgggtaccacacgaaagagatctgattttatcatggatgatgggaaggcttgaaaaggttttaagaagagtgacatttgcagattaatttttcaactacataaatttgctggcatcatggaaggccagagctaagaagaggtgcaacagagatcgaccatttaagaaagtagttctctaattttaaaaattatagtaagaaatacattttcatggcaaaatgtctgtgtgtgtttgcatgtctgtgggtgtatcaataattttataaaaccatatttatctttgatattatagatgtggttttatactcttattttttacgcaattctgtatcatatttttaaaataaaatgctaaatgcaactgacagtttcaaaaacactatttcaggtactagtactataattcaggggagagttggtgagtgcttgaactagggaaatattagcaggttagagaagagagcatggatttgatcaatagttataaaataaaataaaaattgtattcatttggggccgagcatggtggctcacacctgtaacctcagcactttggaggccaaggcaggaggatcacttgaggccaagaattcgagaccagcctggccaacatagtgaaacgctgtctctactaaaaatacaaaaattagctgggtgtgatggtgtacacctgtaataccagctacttgggaggctgaggcacaagaattgcttgaacccaggaggtggaggttacagtgagcttaaatcttgccactgcactccatcctgggcaacagagtgagacaactctgtttcaaaaatatatatagacagacagatagatttggtagaaggattcatgatttataagtttcgatcttggctaaaagtgtttcactaactgagataggaagaacagatttgcaaagaaatatgtgagtccagctctggacatattggatttgaagagttggatatcaatggacattgggcttttgtgtgaataaatttggaaattggggaagtgcctactctgagtagagacagagttttgggacccactttcataagatggaaaatacaactatgaggtacatgaaaacatctacagagtacacagagtgagaaaaccaattaatcaaaaagaacattctagaatactcacatttaagaggtaaagtggggaggaagagagaccatgaagaatagtgaaaagaagtattcagagcagcaagaagagtgtggaaacatctggaacaaaatggctcccaacaaaaacatgttgaataaatatttactcagtaaatgaacaaagaaagagtttaagaagaagaagcctctaagaactaagaagacaattaggagttcattggcaaccaagggagggcagctggaacagaggtgttgtgagaaagtcgtactacagtggactgcagactgaatagggatgaggaggtagagcaacttgactgaaaagagaagatcaagaactagctaaaggatcaataaagagttggctgaactttgctgtggtttgctgtgtattgtttttaagattgtgagagacatgaatggggaaagagccagaataaaagtaaagattgaagatgtgagagatagaaaggaaaacagacgaagcaaggacttgtgggagctgggaggagagaggatcaagggcccagatgcaggggttgacttagagcaggagggagaagggaaacgtcatccgctgagaccagaagggaggaagggattatggatgtcagtaagagacctatggataacatctatggcaagaggatgtaggagctgaggaagttcatgccttgacacagactttcttcaaaaagcaacaagttatttgctgaaaggagatgaagagctgctggtttgggaggcttaagagagaggacaggtttggaattagcatgaagaggactgagagaggggcacagcaggaactaactgtcaagtgctctgagagtccgatgaggtgacaggtcttgactttgttggaattccagcttgaagtgatgtgggattatttttcccaggaattcaggtaaggaagtggaaaaggcagactgtaaaactgacagagctggattttcccaaagtgagtaaggaggacaggatggcaagagattcgagagagactgggcaggccagagggagaggttaggagaagactcatttgcttaaaggagattgaaatccctgaactagagacttgccagaaaaaaaaaaaatatatatatatgtgtgtgtgtgtgtgtgtgtgtgtgtgtgtgtgtgtgtgtgtgtcttattctcttttgtggcagacactaaatttgagccaaggagatgtaagtagaagcattatgtgggatttctcagaagccttttctaaaaggagtgggtgtactattccttcttttttcctccttcttgctgctggccacttagttgtgatggctagggctcttgtagtcatctcagaccatgaagacaaagcctataatctagaaatgttaaaaaaattatctgaaagaagctctgggcccttggtgattttagagcagccacagcagccctggactgctcactctgaatttctggaaaaagaaatcaacttctgtcttgattgaagcacaattttaaaaaattgaaataaaaatattttatatatttatggtatacaacatgttttggtatatacagcgaaattttcaggactcatttactaaccatattctagctaaaagagaatatatacacagcaactagagaacgaatagagatttcttggaacagaatgctatctttctaccatgtaatgcctaagcagggcacatactttatagtaagcaaaaagctttgatctttgcaggagattatagactgcttttgatttgggtagagaagaaacaaaagtcaaatcttggatttcttcattaattaaaaaaaaaaaaaggcaaaataaagccacatgtatgttgttttttcccgtaaggtcaagcaaagacttctttatactttttgtgagaaaatgtattgaaaattaatgacattaatacccaggatggtacatttccattgcttcacaatttttttttctttctgaagggttagaatttccaccagtcagcataaaatggttaaaactgaagcctagtaaatcacttgtattgcattgttttcaaagtgactaaacagctgtagttttcaaggtcagccaaatcatctgccagggtcacacgtgtttcacatgtcaagtaacgtatatgggttcaattccatccaggatcctaaggaaaaagacatttgcaaacaagtgatccgaagacatttttctaaacaggtgctgtggttactgggataagagttactattgtaaaccacttgaatttacgactaagtttccaatcatttaaaaagaatattcatttcaaattataatgtccaaaccaagaggaccagctcctgatcataatgacattcaatgaggacagaaagtaatattgtataattgttattattaccataatgacattgttcatgtacaaatgagaagaatgtatattgggtatcaaaataaaaccaaccaaacacataattaggatggaacctagttaaacagttgaagagaggagacttaaagcaacaagacttggctaatacttctccctccaattcttgctccaggaaacattgcatagaaacaaaagacatgactaccatatgccaataactgctttaacaagctggagtaattggtatcatggagccagactgatggaacaaagaaaggatgacctcaggatttaaagagtttagggacagaaaaacattttaaaaatccagtttaattcagaggatagttagagatgtctggctccaactgagagaaggaaagggtattgatttgcgtgagtggctctccattgggctcttctaactcaaaagagataattggccttgaatagtagcttttatattgaatttatattgagttctcttgatgttcttggtatgtgctcttcaaagcccaagaccactccctgatcttgtttatatttgctagtcctaatgatctttcatgtgtcagacgtgctgaatgaagacgattgccttctgatcatttaactcttctctgccagtttcaaggttggcttccatattttagcaagcaaaataataggcatctccaagtcacagtatgcagacaggaatagacaaatacccactttagctaagtatgggctgcagtcaagctggaaaaggtctctcagctctgagtcacttatacaatcgagtccctgaacatgtttctgtccctaatattttgttgctctgggcaaccatcaagtccacatgaagacttctgccaactggagaggatgactagataggagtgccagaattttcttttaactctttgttgaaaactcaaaatagcaaatggtgtcaaggatatcccctaaacatccagattggaaaaagtggaattcacacattgccttggtatcttttattcacttcttagggaaatatgactaaagaagataaaggcaattcatcagaggcatgcatttttttataataataaaatattaggaaaaagttagatgattaggtactatttaatccaatatcatcattttacagaacacaacccaggttaaattactgaccaaaaattacacagagagctaggcagagctgggattatacccctggtcttaaaaccctgaggtcattgctctttcctggactttcagaagcccagtgccagaggcaaagtgaagaaatgttaagaaatcacaagtgatcacctctcttttgtaatagcaaacggttctagttgaaaagggctgctttgctgggatactggaagcaatcctaaagctctggagtagttatcacccattaacactcccaatacagaaagtgtgactatggcacattaaactaaagcatctaaagagtgttcaaggcccaacaaaaataccatgtttgctggaagccttcattgcttattattctaatttggtctttgcctcctctgaattcttacgatactctgtggtacagtcctgagactacttaagattttttgcccaggctggagtgctgtgatcatagctcattgcagcctagacctcttgggctcaagcaaccctcctatctcaactcccccagtagctaggactacaggcatgtgccaccatgcctggctaatttttgtattttttttttgtagagaaaaggtttcatcatgttgcccaggctggtctgaaattcctaggctcaagtgatcctcctgcctcagcctcccaaagtgctgcgattagaggtgtgagccaccacacctagacagtttcttttgcacatgtacaattatattgtgtcaagtccttgggggtaggactatatcttattcatttttgttttcttgaaacccagagcacagaattaaacatattttggttgattttattttctctagaggtacagtgacgacttacttatccagattaattatccaggaatttatactattcaaaatcagtaagtaggtgaaaagaacccagaaaagtcaagtaaacacttgtaggatcttgttcactttatgcatctcatatcctaaaggtctacctcagaaatgaattgccctcaaccttcacttttattttgaattaatttacctttattttatgctcaatgcaatagcttggtaatcaggtttgccaaggaaaaagcagcagcagctcacaaaagatgccaataaagccaagcttagtaacatcatgaactgaccaccagacaatatgggacagcagatgagaaattaaagtgcagccagatttgctgctcgttactgtaggggaaaaaaaagtcctcatagatcattagctcctaagtgcatttgtgaatgacagggaagtacaaaagcagatgttcatgaggaaccagagccagcaaaaatgatttaattacattcagtgtacacctttaagaggttaagaataagcataacacctttcagagattttcatgaatattcaatatacaggacattttctcttaaatgaaatgtaggaaatctaaggatggagataaactagccttaaattcagccttagaatccaggtcttaacctatgtttatcctacatataatacgaaggattataaattttcacacattatcagaagcattttacacctactcagtaaaatcatatgattagcagttatgaaatcctatacatttatcctccttatattttttgtaactatctcttcctttttattctggctatctagctatctagtgtacaacctttattacatcttatgcttgaatatcgctgttgtctttgagttggtttcaaaacctcggatttttttttccttcattagctgcattaaaaaaaagaaatttccaggtgattattattatcttctgtagaaacaggatctcactgcgctgcccaggctagtctggaactcttggcctcaagtgatcctctggccttgacctgctaaagtgctgggattacaggtgtgaggcaccacgcctgccccccaaggtgattttaaggaacagacaaatttgtgaaccactatccctaagtgcttagcacaccattcatttcactcttaattatatccttcaatggaactaactcccttagtggcaggcgtaatatgcctgtgatttctgagcttagatgctctttaaaaatagttgtttttggccgggtgtggtggctcacgcctgtaatcccagcactttgggaggccgagatgggtggatcatgaggtcaggagttcaagaccagcctgaccaacatggtgaaaccctgtctctactaaaaatgcaaaaattagccaggcatggtgacgtgtgcctgtaatcccagctactcaggaggctgaggcaggagaatcacttgaatccaggaggtggaggttgcagtgagccgaattgcgccattgcactccagcctgggcaacagagagagactccgtcccacctcccacccccgccaacaaaaaagttttttcatattcattgtgttagcccaaaatatctgagacaggtctcaatcagtttagaaagtgtattttgccaaagttaaggatgcacgtgtgacactgcctcaggtggtcctgaagacatgtgcccaaggtggtcaggctacagcttgtttttgtacattttaggaagaaataatacatcaatcaatacatgtaagatttacactggttctatctggaaagctggaaagcgggaaaactcaaagttgggggagggcttcgaggtcacaggtagatttcaacatattctgattagcaattggttgaaagagttattatcagtagaaaggaatgtctgggttaagataaaagttgtggagaccaaaggtttattaggcagatgaagcctccaggtagcaggcttccaagaaaagagatcctaaatgtttcttatcagacttaaggtctgtggtgatgttaatactggaggggtaaaataaggcatgtctgacttcctttgcggcctaaatcagtctttcaggttaaattttaaagtgccctggccaaggaggaagtccattcaggtgagggtgcaggcgtgcttcaaattttatttttagtttacaactgttagcgaaaagtacgtcctctcaatttccgttttccccctgtatttacttaagaactattttccagttccttctatatcttgctttgcatctccagcaaagagatactaaagttttctcttggtcttcttttcagaggtgcggtttgatgattacgcacaaagagacaaagataatgagtgggggtagacctgctagcttaactttttcttttagagaagcacctaaggggatctgtcacatggatgaatctacccttctttgaaggtctgatttgaaagcagattggactacattctgcacaaaggcattttaaacatgcaggtgtgaatgccccaaataacaatactttgaacttttacagaacctttcatccagtgataccaaaacaattcagtttattaaaggcctaggaagctggggacaaaacatccaattgatctatatatggaaatttattgcattaacttggttggtgattcctttcaagtctcccaacgctggggcatataagcagagaaaactgtacggtttctgcaagctacctctccaaattgtaatattttccatttccaactcctcaagaagagctaatcctcttcttttcacatttatgcttaattagagagttaccagttcacagacagttatttatgttcagaacctaataaattcttgtttctgccttaatttgaccaaggattgccttctatgtcatgttctaaagaagcccattgaacaaataaataaaaacagacttcacctgtagtgagggagaactattatctaatcaatttttcattttaaaaattaaatacttcaaaattggctgggtgtgatggcccacacctgtaatcccagcactttgggaggccaaggcaggagaatcacttgagcccaggagtgcaagactagcctgggcaacatcgtgagatcctgtctctaaaaaaaaaaaaaaaaattaaaaattagccaggtatggtggtgcagtgctatgtgcctgtagtcccaggtagacaggaggatgaggtgggaggattgcttgagcccaggaggtcgaggctgcagtgagctgtgattgtgccaccgcaatctagcctgagcaaaaagtgagaccctgcatcaaaaaaaaaaaaaattgtaattaaatcttatttttaatctgagagcatagatttaagttgccctgaatatacactctcacttatctaattgattttttttttttcttcgaggcagagtcttgctctgtcacccaggttggagtacagtggcatgatctcacctctgcctcccgggttcaagccattttcgtgcctcagcttcccaagtagctgggattacaggcatgtgccaccatgcctccatgcctggctacttttttttttttttttcagtagagacgggggtttcaccatgttgcccaggctgatcttgaactcctggcctcaatcgatccgcctgcctcggccacccaaagtgctgtgggattacaggtgtgagccaccgtgcctggccaatcgaattgatttttaaatgaacaatctttttttttttttttttgagacagtttcactttttgcctaggctgaagtgcaatggcgcgatctcagctcaccacaacctctgcctcccaggttcaagcgattctcctgcctcagtctcccgagtagccgggattacaggcatgtgccaccacgcctggctaattttgtatttttaatagagacggggtttctccatgttggccaggctggtctcgaactcctgacctcaggtgatccgcccctccttggcctcccaaaatgctggataacaggcgtgagccaccgctcctggtccttaaatgaacaatctatcgtacaaatctgttggatacctctactttttaccatatatctttcaaaaaacttacaaatttaatcttttcctcttttccaccttctgacttccttattatatacattgcagtgaactcaggacagctaagattcagagtggcaactggggtatattcctattttcccatattttaaatctgctgtaaaggaaatagttgttatgagcaaaatgtgtctgaggaatgtttatcagactatcgtttttatttggcattgtcccagcatattagtttttaatttttttgccccatttcaatggtgactttgatgttttgttttgaccagctgctgagctttttgtggctgtccatttacatcactttaaaaaatggtacataaatgaaatttgaacaaaatgaacagtactttaacattgtttcaaaatcaaatatcttcctaaggaatctgatttgtggcagatggagaacaaaaccttccagagggagggctgttaaatgagtcttaattgcttgcacatgaaaatattgtgactaagattgtgtgcacaattaggaatttaaacatgtagaaaagaactggccatagaaacaggcagacatttttgcagtcagagctagtttcttgtgaacacagacaataaagacaagtcagtaaaggaaaataatttcaagagaaattcagttgttttctttacttcattgttgcttacattgagcttccaattctaaagatgattcatttgccttggaaactcactgatggaagtatcacagtacagtcaagaaaaaaatgtttattcaagaactagtatttcttttttagttcctactatgcgtcagatgctaggtttcgtgcttaattcacttcatttaattcttacttaatgctctgagataggtttgctattattcccgtcttctaatgagaaatcaaggctcagagaataactttcccaaagtcaaatagctaacaaatagtgcagccaggattctctgtattgatttaatgaatccaccctctgacaatgcctcactgctcccctgggaaaaagcacatatcttttttttaaaaaaatgatttaataaacttattctaagagcgcctatactttgttctgagtcaataatgccttccttctgttggatggcatgatgtaggttgctaggctggacttgttaaacgttgggtaaggaaggcatgattgcacccaggcgaagtgaatggctacgcagagggcacagataatctgaataggggttgggctgagatgacagatttagagacagaggccaggacttcctacaggggccacacgtcacggcgtcttgtatagaaccaagcataaaagaggcatcaataaatgtgtgtggatcaaatgatgagatggtcaaattatttttgtgccttcagaggaactgagttctcaggatacattaatgacaggtaccatctggatctctaaaaaaaatgagtatcataaaaagaaattcagtgagaaataaattaataaaataaatagtgcattgaaaccaatcctactagcatttatttcccctatctaagagcaccctaatttctttcaggaatatactttgtatccctattagataatcttaataatagttaaccagcaatgatcaagtgcttactgtgagccatgcattttgcttcatttttcataaatatctttttttttcctaagacagagtcttcctctgttatccaggctggagtgcagtggcacgatctcagcttactgcaacctctgcctcccaggttcaagtgattctcctacctcagcctcccaaggagctgggattacaggtgtgcaacaccatgtctggctaatttttttgtgtttttagtagagacagggtttcaccatgttggccaggctggtctcaaactcctgacctcaggtgatctgcccgcctcagcctcccaaaatgctggaattacaggcgtgagcaaccatgcccagcctttcataaatatctcctcaaataattttcatgaactccctatgagataaatattattattgtgcttacttcaaaagtgaggaatttcaggctctggaaggttaaatgaattgtttgagcacaagcatctgtaagtcgtagtgctagaatatgaacccacaaaatctggtcccatcattcagctcttactaccacattttataacatagtttggtagaactgaagccacctgcctgttctcttttagccaaggcccaggacgcaaacaagacaaattagatcccttcactgctgtttgactcttgaaataatgacaaagaaactaagaacagttgtggggatctcactcgactactcctgccatgagactttccccttgatttgtagccttctagcactgtaaagatgcactgattccttcaaacctcgtcctccagcacccccaccaccacctgtcgccccactaattctcagggaattcagaattcttcctatattcttccactaagaattttgcattaatgagcagagttggtttttttgtattgcaagcaaaggatcattgctgagacaccattttctaaggggaggtgataagccagccaaggggagaattgtatggaatccccaaagaacaagatgcagacaacactgtttagtgtgccacaataatttaatagactcactgagaaataatagcatgacaaaaggccaggttaatttcctctgctgccctttctgtggaaatgatgaaggttcttgggctcctctctgatccactggtcttagatacattggccttctcctttatttccagtaccctcaacagtttccagtaaagagaaacagcaagggagggtctgtagaaagacagactgtcttgaggttggctgaggggtaaaagaaatttcccagaaattgctccttttccttcacaaactgcctagaattcagattttgtctccttcaaagttgcatctgggaaaatgtgtttatatgcttattccacacattgccatcattgtaatgattttagggctccctgtcttggaattgccttaaaagtccatgtgatacttcttaaaaaactctttaaaatcccttgagaatggtttcatttctggagttagccccatctaagctaatttgacattctgtctggtgaatagggttggtaatcatattggaaataatatttttggtcataagtgaagtgttactataaaccagtgagattgcttattgctttttggtatgtgtgtgtcttatatggtctgtaaatggtctctaaagccacttccaaaatgctttcagcaatggcatcagggctcaaataattgcacagtttccagagatggctgttttgaggatcaacagtaattgaataatataataatatttattggtagtttataatacttttcaacatattaagcactttccacatgcttttaaataagacctgacatttactatgtcccagacaccgtgctaatttttttacacagattatctcatgtaattcctcaaaattaggaaggtataattattacccaccacattttaacagaaaagatctaacacatcggcgtgacttttctaaggtcacacgtaaagtgggtgagcaggacagccagccacgaaaccccaattttctgacccctgagtcttgttcctcctccttcacatagattttgacttgtatgtcaaaacacaaaaacaaaacctaccaatgtttgagatttttttctatgggaggataaaacctaggtctgtctctgtagaagcaatattagtcaaataacagtcagtccactgtcagtgacttcagaggtatcttacttgtcattcaactctgaggtctcggtttcacgaccagttcttttctattttccttttggctattttgaaacatgtcttcttttaccaatctcagccctccactttctcatgctgtgaagtattccctaaatttctgaattattttcccaaaccattttcagtctctaagctaacactgtaggcagcttcttagctctttagaaaaacaatctcacctgcatctgctccattcttcctctctcccttcctttctctcttctttattttacttattcatttatccattcacttataagccctctgttttctattaacttaatgctttttgtcattcaacagaacacattttagctttttaagttccacaaacctctagagtaatggtcctgaagcttactggaggtattttattcatccttgggtccttggagcctaagcatagcctttcacatactagggactaaatgagtaaaagcaaagccaggaagaggcagaaatcaagttctctatgtggacagttctgtgttcaatatgcaaacatcagaaacatatccagaaaagaatgtcataaacacccatctgttttgtgtggcatatagaatacagtcaattagaaatacttccacaggaccaacagtgctgaaaaggaaccacaaaaaaacaaaacaaaacaaaacaaaaatacagaaggaagacggcacactagaaagcactggatatttaagcatcagaaatatctcaaggaagtgcattcaggacatggtgagctaggaaacttttgcctagcaatggtagctaagagatgataatggcatgaagagacttcacccaaagagaagattaatattcccagtagttggggcctgccctttcaggccttcgtggtaagtggtcccagaagcaaggtgagtgctaacgctgaagcactgcgttaccctggttcctccgaaacaccccatctgcctgacttctcacacacacctgggcctttccttgtcaatgctctgcccctgggcactctggtgacaacgggcacttcagaagagtcaggaagagaagtgtgggaattgaagaatcctataccccctggcaggaatcctttccttagcttatataactatagagagtttttagggtttcccaaagagtttctgtgcatccacagatcttatccctcctcttgtcctaccctccactcatatacattcaggaatagatggtatagatttgttttctgttctcaaaagaaaaaagaaaaagaaagagagagagagagggagggaaggagagagaaaaaaaagaagagagatgtccctagggaataacttttgaggaccagcacatccagcagcttgtgtatgtgtgtacatgccagtacattttaggagaggacttgacattctccctctgagtcaatccgtactttgtaattttctacctatgtatcttaatcaaattattcaacttgtctagcccagttttgcatctatgaagcaggaatagcaacggtgtctacctctttggatatcataaggtttaaaaagattactcatctagagtgtttggtacatttcaaatgtcagtaaatgttaacttttattaatattagtattaataatatatccaactgatttttaaagcattttttgagagaggctttttgatataacaaaagaaacgacgctgtgagtgcactccctatttatttagagttaaataattcagtgtaacatccaactagtaaaatttgggaaatgagcctcaaaggaattttcaacattttgccccaccacagtcactgtatttctgagtatgcctagaatattttttaaggctgaaatgggtgggaagcactttgtggagaaagggagtgactgaagaatgcagtttgtgtggttcttttattttttttttttcttttattagtttaaggagacttggtactgtgtccaagaagacaaaaagaatgcaattactaaacatttcccaaattccctccctcccacatccacaaaggtagatgtgatacttgattttcttctcagagacgagcaagctgctctacttaaaatcttgtatgtattttgagagataacagatgatgaccctgacgctgatgcccaggatgacgaagtcagcacagataataatatcaccttgtatcttctttcactaatcgtggagcactttgcacatatgatcgtgcttatcctgggctgcactgtttgttagatgagggtgtgggtgtcactatatatactttccagaaagacaggtattttccaacaagctatcatcaactcaatgacaacactgtacacaggcagccctctcacctgctttcttcagtattccattattctcccaaatttggccaatcaagcccattcacctgggagtatttgttaataatttagatcctgagccttatcctagacattcagttctggaaagtctgggaatcagtcattttgtggttgttctcaggaagcccttggggattcctttgatcagagacaggtttgggaagtattgctctttttaaactcagggcagcggggaagggatgctggcaggagtggactttggtgacactgagatcttttattcatgtggtagcttttcttactctgagacagagttttgctctgtagcccaggctagagtgcagtggcatgatcatggttcactgcagcatcaacttcctgggcataaatgatcctcctgaatagctgggattacaggtgtgcaccaccatgtctagctaatttttaaaattttttgtagagatggaggtctcactgtgtttcaggcttgcctcaaactcctggcctcaagccatcttcctcccttgcctcccaaagtgctggaattacaggtgtgagccactgcacccagccctaagggtagtttttctgatcatctgaaggataatacaacatttttgtcataggctcaataatccataaaatgctgccctatgtgagagatattattattttaaaatacagttaatgctggactgtggaaccataatattgaaatattgttagggcgggtctcaccagtgccctttctaggcaaggagaggcaaactaacaactgggacctgagaaataacatgtttgtcactagattcaatgtaaaatggtaaacctatctacctttgctaactactggtcaacaactaaaagtaacttaagttcaattcaatatacataattaaagtgcattaaatgtgtgcctattgcccacatggcactttattatgtattccttaaaatacaaacatttttccatattattaaaattttctcaaaaataaattatttaaaatcattttattatgggaattttttaacccctacctaaatagaattcacacattatttagaatttggattgtttttaaccctttatgcacattcacagtgctgtaatgaacatgtgtatatatactttcactttttttttttttttttgagatgaagtttctctcttgttgcccaggctagagtgcaatggtgccatctcggctcactgtaacctctgcctcctgggttcaagcaattctcctgcctcagcctccagagtagctgggattacaagcacgtgccaccacgcctggctaatttttgtatttttagtagagatggggtttcaccatgttggccaggctggtcttgaactcctgacctcaggtgatccacccgcctcagcctcccaaactgctgggattacaggcgtgagccaccacacctggctcatactttcactttaaaattgttcatcctcagtctctgctctaatcaacccccaagtcccttcaatcctatctctgaagagttgtgaacccattccctcatctccacagccccacttccaccccagttcagagctgcattatcttgatcctgtacaaggcctgtgacagccccctgaagagtatggggctgcccctagtctttcttcttttcaatctctttctacactgcttccaattactgtcattctgaaatgtgtatttgttcctacgattggaaatgctcaatgattttccactgtccataaaataaagtccactgttatttatgtaggcctcaaatattatttccttaatctacctctggagcatcctgttcagttgctcctatacacctttaactcaatttgtcctttactgttcccagtcccctgatatggacaggcattccatgcttccataccttattcttgctggtcttttgttgtgaggtaatcctcaatcctcccctaaccacatggaaagcattatgttcttcaaatttatcagggagcatttcctaggtagagccactggctctctctctctctatatatgaatacatattcatatatattatatattaaatatataatataattatttaatatatattttatatatttattttataataaacatatatatttatatgagaaatatatttattatataataagcatatatatgagaaatacattatataataaatattatatttatttatatgagaattatatttatatattatatatttatataataaatatatattatatatataataaatatatattatatatataataaatatatattatatatataatatatatatattatatatataataaatatatattatatatataataaatatatattatatatataataaatatatattatatatataataaatatataatattatatatatttatataatatatgtatataatatataatacatatataataaatatgtatataatatataataaatatataataaatatgtatataatatataataaatatatatttatacaatttataagaaatatatatttatataagaaatatatataattttataaaatatataatatataatatattatatattatatattttgtatatattatatataatatatatttatataaatatatatatttaaagaggtttcagtccaggctctgtggctcatgcctataatcccagcactttgggaggccaaggtgggcagattgcttgagcctaggagttccagatcagcctgggcaacacggcaaaacgccgcctctacaaaaaatacaaaaaataaaataaaaaattatgcacacgtggtggtgcatgcctgtagtcccagctactcaggaggctgaggtgggaggattgctggagactgggaggcggaggttgcaatgagacaagatcgtaccacttcactccagcctgggcaacagagtgaggccctatttctaaaaattaattaattaattaaaataaaaaatataaaggcttcaatcatggcatttagctagtacttaactatttataattccttctcccttactttgtaaatttcttgaaccagtagtcacattttacctccagagcgtatgcatgccatatataaggtgcatggaaaatactgttgaccaagcagataataataataataatattatagcaataatgataagtaacatttgttgaatacattctgagtaccaagtactatgttaagcactgaattagaatttactgataaagaatacccccaaaacttggagaatttaagtacattgaccaaaattagacaactactaagaggaaagctgggtttttaacatatatgctagctcatcacctttttgctaggctaaatgaacatgagccccatttaattatttcaattaaagttataacaaagcatccaaatcagatattcagacaagagagacacaattaaattatttcccctcataattaggacatagcccttgttttcactattcttaaaacaagtctaacttcaatcaattcctggtcaaaaagccacggtgtcagatctgatctttttatatattaataggtatggctctactcattaaataaaagcataaaaggccaaaacaaattcatttgtaagaaagagaactgacttttactgctctaaaagatcataagtttaactaataaatagtaatactccatgcatttatgcaaatctttcagttcaatgtttttaccggaagattctttttcaatgaggatttttgtaaaagtaaactccttcagcttaaaagatttaggaaatccgacagtcattagatgtattagatgctttatcagttttttattaaagctattaaacacaatgtatcatcagcatttttcgatcacatttcttaaaaagcttaatgaacacatatttctggcaattattaaagtgtggccacaatctttattctattaaaggaaaaaaagaactacagcatgaagctgctgcctgctggtggttgatgaggaagtagggcttctctggcaatggctgggtctcttgtcttccctatacactgacacaacacatgttttacttcagtatctcctgaggacttacatatttctctcatgtagatcccttttgccttctttatatggttcttgctcccatctattagatctctctatatttctttttaaaaaactatatatactacttgcttttatcacacacacacagatttaaaaggcagatctaagtaagtagccagcatccttattgtcaccatgaaatagttgcttagtttctttcattcgataagctcaaagcattaagtgattagcccagataacaaaaaaataattgtcccaattaaatatcattattgtttttcccccttattaattcttagaaactgcttgtgctttagaacaacaaacatataagattaaatttcttctcattgtgttttgacagactagcattatttggatagtttactttttaattttctacgtgccaattgactaaattctatttagaatgcacttactgtttttaatgaagccatgaatcttcagggtaaaaaaatacaaaaaggaatgaagacttagaccaatttacttatttatttattttctggactaaaaccacttctgtgctgttctatgcttgtcactgcatcatgtgtctccccctacaggtaaagagcaggcagctgtactagtttcaccgctcctgtagaagaatttgtattttccaaagtcaaaatccagaagtcttttgctttagggtgctggtctctatgcctctggggtataagcagtagatataatcaaaatagctataactacagagatatgtccagtgagaggttgggatgagaaattttcaagctcatatacaaataatacaatgccacatctattactcaggagttagtattaatacttcatttactttctctaaagcatatacttccacggtgggtataaaggccacccgaatctaatggtttattttactttataaaggtgtaagaaggaccatggactcgaaaaaggaaccacatgtttattcctggcattgtcactaagcagcaccctctctcactaggtctcagttttttcatctttaaaataaagatatttaaatacgttttctttagagttgtgtccttgcatgaaaatcctctaattgaggatgattaaataaacatattggaaatatggaaattcagaagcattgaaaatggtattgtgaagatgtaacatttaatgagatggctgcagaatgcttgccttgagctaaggttgttcgaaaatgaaatgcttacaaggaaggactgtgctccaagctacatggctgtacttcaaaaatgggatcactgtcccagtgcaggtatggcttgggcatctctgactctttgccaccctctcatgttccaatgcactctttacttctggtgtgcaccacacattaaggacgtatgtaggtgagccttactctaaatgataaaaggattactaaaaatgtcatgccatgactgtgtgaaaacaaaatcataaatgaaatgtaccaaagaagctgacataccaatattctctgttacctctattctaccagtttttaaattagctttaggaacaaaaaaatgtcaggcattgggacagggttataggaagaaacacttggtgagttcctcatcacattcggaactctatccatttttctttcttttttttttttttttttttttttttttgagacggtgtctcactctgtcacccaggccgaagagcagtggcctgatctcggctcactgcaacctccgccctcagagttcaagcgatttcctgtctcagcctcccgagtagctgggattacaggcacctgccaccacgcctggctaatttttgtattttaatagagacggggtttcaccatcttggccaggctggtcttgaactcctgacctggtgatccacccgccttggcctcccaaagtgctgggattacaggcatgagccaccatgcccggcctccatttttttttttttttttttttttttactttaggagacagggtctcattacattgcccaggctggtcttgaattcctgagctcaagcagtcctcccaccttggtctcctgagtagccgggattataggggtgtgccaccatgcccaacttgaactctatccttttatataacttatctccttgaattcttgcaacagtcctaagtgttaggtactcaaatctccaaaatgaggaaatgaagcaaaaaggagagactgggttcacattcaggctccaaatgccacacatcatctttgtcatatcacactaaagagcaaaagagctatttaagtctcttttataaatgcaaacttcaaagccttacttttaaggaattgttagatcattttagacctgtatgtttacctactatatattgaaataaaaactggccagtgacctacctttaaaacctagctttaaaaccctaatgctataaaatcaaactctcggccaggtgtggtggctcatgcctgtaatcccagcattttgggaggccaaggtgggtggatcacctgaggtcaggagttcaagaccatcctggctaacacagtgaaaccctgtctctactaaaaacacaaaaagttagccgggcgtggtggtgggcatctgtaatcccagctacttgggaggctgaggcaggagaattgcttgaacccaggaggcggaggttgcagtgagcctcagatcgcgccactgcactccagcctgggcgataagagcaaaactctatctcaagaaaaaaaaaaaaaaatcaaattctcctggctttaatacatgtcaaatgcaataaccttgaaaagaggaagagggtattgtaaattctatgtgacaactccttagaaagcatggtatgtgatatgtagactgctgaagttcttaactcttcttttttaaaaattagagttggtttacagaaaagtgatagagaattaatatttctccttcaaacaactatgactcaaaagtgagttcttagacttagaaattcatcctgaacaacagtgtatcatctctatcacaaagctaccagcgtctgtgaattgtgatgagaataaaggagacagtgctgggagcaggaggagaccccattttgatgggcacaaagcaagcgcatccattttggccaatttaaggacccacaagttttcctctcatgatcttgcaagcttgcctttctctcactgttccctttccttcgtttgtgtctttgtcctattctttccattacccccttgttacggaatgagtgcttgtgtgcccctaaaattcatttcaatatcctaacccaatatgtgttggtatttggaggccgggcctgtgggaggtgattaggtcgtgagggtggagcactcaacactcacaaatgagactagtgcctttacaaagggcactgatgcaacctagaagaagactctcaccagaccccaaccatgctggcatcctgatctcagacttccagcctccagaattgtgagaaataaatttgtgttgtctataagccacccagtctatggtactttgttatggcagcctgaattgatgaagaaacccctagttctatgtatacagtgggccctagaaacaaaaccaagtaataacaacaaaatggaatttaaaaagatgtattaagtgctggttctgtgaggcactatgctaagggcatcatgcgtgttcactcattcaagccagcaacaactgcaggaagcagtgtcactattttataggtagggaaactgagcagagaaagggtatgcaacctgcccagggccacaaagctctcatgatagagcatgatttgagtgctgggtaggcagagcaaccacgtggtataattctaggggcaccatgttgtgatgttctgtggagttgccctccggaggcacttggagctgtgtgctctagcagccttttggatcagccatgaacttaactgttaggctacactgttactctagaccttattcctatgttgagggatagacaggcatacatttgcgaacctgtacctggggcctctagtgagagaagccacatggaagctggtcctcatgctgctccaggcactaggtctgacccctatcaacagggacccattcatcttaagggtgcctcactgactctttttaatacttctttgcccttcccaggactactgccacagtacagccaggttccaacttcagggggagtgagcctagagggtggggcctgagtggtcagctgcagagggaggaaaggcacaagcactgccttttctgagtgtctcaaatcttactaatgtcaaaatctcaaccatcattattattactagcactgaggttttaagggcccactttttcaaaatgggctcagaaaggggaaccttcccctgctactgccctcatccctccatccctatgccatgttcccaccttggtttgctatgcttgggcaagaaaaacgacttcccagttttagtcagttcatttcctgttgtgctttgtgaggagcccagcagcactaagtggtaacaacagttaattagtttccctttctagataaggtatttctgtgtcccccttgtccctaggcctcaggtcaggagcttgtgggtacgaatgaggccatattcaccttaatttcttaatttctgtggctcataattccctctggtattgctccaggacccccttactatgtatacatttctaggagcttctatgaggtctgtcacatatgcttaagatcaagtgtgtgccctttgagtgtagctactctctcctgttaatctgtgcctggcatctgctgggatggctgggcagctgccctgaccactgagcacccaaccatctgttgtcagccacaacaatttccactggtacctgatgctgctcttctgggagaatgctgctccacctgtgaggccagctcatatgtgacctcaagctaaaaaagcttccagggaccaaaatagcactgcattctgcccaaatagcaatgtcagttcttgcttattgcaaaattgggggttgagggtagttcctcttgataggggtcagatttagtgcctggagcagcgtgaagaccagcttccatgtggcttctctcactagaggcctcaggtacaggttcataaatgtaggcctgtccattcctcaacttaggaaagtgcatagaaacagagggatccggttccacacctccaactcagtttagactcatttatgttgaatttgaattttggcagaagaaatcagttactcaaagtatttattttagcatataggaattgttattgttcatctctctttctctttattttttggagacagtcttactctgttgcccaggctggagtgcagtggcgcgatctcggctcactgcaacctctgcctcctgggttcaagcgattctcctgcctcagattcccgagtagcttggattacaggtgctcgccaccatgctaagttttgtatttttagtagagatggggtttcgccatgttggccaggctggtcttgaactcctggcctcaagtgatccacccaccttggcctcccaaagtgctgagattacaagcgtgagccaccactcctggccctattgttcatctcttgatcaatatcaagaacaaaactggttaaccatatatgtactataaaatgataattggaagtcatcaccaataatatgttgaaagagaaacatgaagaagagatcaataatttaacattcattgaaatacaagtttcacttgatgacattcagaaaagatgacattaacaatgattccagaatcaactctaatgtggtgaccacaaacacagacagacgtctggacatgataaagttaaatttcaagcaaagtgtactcactaataacttaataagagctcctcagcacattatgggttggagctcaaggaagacacttgaatccaatgacgaattgttttagtttggagaatatgctaattttcttctggtaataattttagaaaacataggttttcttttccaggcaattattttaatgaatcaattggggtttcaagaaatagtcaaaagagttcaatttggtttcaggttcagcaaaatgagatcatgcattctgtttttggttcagctggggtcaagtcctgtgcctaaaacagactaataggaattgagataattttatttttatgcacttggctcctctcatctttcctcctatttttctttcccaaacatctatagatcccaacgttttgatctcattgaactttttctgcattgtatattaacttctctcccctcccaaactgagtttattctcagctctctcagtcctttattggactactggtacaatgttgcttcctacacacaagtgggatattgatgaaccaacacgttactccttttatttatgccttcactcttattaaactaaatgatgacatattatatcatgctaataacacatgtgtggaaccagaatgggaagtgacttgaaagtaacatcatctctcaaaatacaaatgcccagagcaatgctcaaatgagtataagcacatagttaaatggttaaaaataatgtacatcagtaaaaaacgtaaatcggtaaaaatgttccaaataacagcttagacaatttgtgagatcaatgatagaaatgataatgtagagaagaaagaatttctttaacattttcaaattgcagcatgaaattggtgttggtgttatattgactcttggcagaaatggtttcttcctagacacatgaagaataagctccagatctttcttacctgttatggtggctttgttgatggatggttggttgcacatgggtgatcttctgacaaagacagaaaaacacaaagcagtaaatatgtggggcttattgatttgatcactctctgagtcatttcagatatagcattttactttaaagaattatttttaagtttggacacgcaaatgatttctttcagactagccagacaagtccctaggcgttctttgtattatggctcagatcacacatgtccaaaaagaaaactggtaaatctcacagtgattgatttggggtaaataaagctgatgtaagtgtcactgggacatgagagaagaggaaattcttacagactttattcgctgaagccagagcttatagactctgaatttgaaaaagcagtcaatttataattgtcttccctaatacagggttaagaaatttttattgttggcctaaattctcgtgattgcctgtacattatcagaagtgaatgatttgttgtaaactatcttataattagagaagctatttgaactttttcctttcttttcttatattgaaaaacacctctgatatatttgttagagaggtatattaatgacttgtccaaatagatactatagaagctttagaaatactctaagccaaaggtacttaaataaattatatcttgtgttctctaagttttcagatgtttgccaagttccacaaaatgactataaaccccttgaagtaaaaaaaaaaagcatgctgtctgattaacttatattccctacagagcctagcacaatgcatccagtattccgtcagtgcttaataaattatgttgaaaagaatatcatttataaagtatccatcaacatttttgaaatataactttataaagttattacttgtaactgacagcttttaaaatataatgattaaaaaacacttttagatacattcaaagatgtctgatatatatatatatatatatatatatattaggtatataataattatatatatattgcctctaccaagggtgaacacttaataaacacttcttgtggatcagacattgctaaataagtactttaaatgaattatctcattgaatccttacaataagccttaaggaagtaagtttcattgttctcattttaccaatgagaaaaacaaaactttgagaatttgaagaacttgttttaagtaacgaagctgagatttgaactaaacgaatgtgatcctagggtctatgctctgctttgctgccttagtttgagatgtttttgtggaacctgcatgcacagcctcacatatgtgccaatggcatcaatctcttcaaatatgccttgctgagatgatgaatttcttagcagggtgggggaaagttggggaaagcagcctgggattttgtaaattctcactggttccactcagcctctggctccctttcattgctcctaaggttattggtatcgatttgggattaaaattttgtgtttgattgaaaatgcaccaaattttacttctgaattattttagttttttttagttataaaataaaatggttgggggaaaaatggggagaatttaaactcgataaaccaaaatattaatattttaagcagctgctctgaaatagctctggtctatataccagtaattatcttcttcttcttaaatttttttttttttaaagttttgagatagggtctcactctgttgctcaggctggagtgcagtggtgtgatcatagctcactacagcctagaactcctgagctctagtgattccccccaccacctcagcctctcaagtagctgggactacaggtgcatgccaccatgcttggctaattaatttttttttttttagagatggggtcttgctgtgtgtaacagggtgttatctgttaccttctggctaagagtttatcattcaaataattgatatcctgattactcctttttagtccttgctctgtgaaaatttagaaaccattgattttgtctgggaatggtattaaataaatattttcacactcttctacagttttggaaaaccaaatggttgactcaattctaattatctccttttactatcaatcctacaattaactggtactcaggaacttgatatctgaacaagtaatggcaagcagaaaatattaatactttgatccatggttgcctcgatacctcctctaatgacagatgagccagaactcacttctggaataaaaaatctcaagggcaaaacaaaaacaaaaaacccaaggtgacaagaagcagtaatgtgttaacaagtcagcaatgtgcatctgaatacccacccaggggctgggtttggaatgcattcttcctagactccttttctgcagcaaataaaaagggtggcttgtgcaaaggagcacatgccttccataaaatccaaggatgagcttggaaatgttctagtggctctgtgagtgcccagcaggaaaggttctgattctcccagggtcatcatgtgatgaggcagagttacagcactttgttctcactgaacagaatcgagtttagccgtgaatagattgaatcctactattctgatacccaaagaagccgatttggtttgaatcagtaatggaggcacaaatttgcattgaccaaaaggaagaccacagtggcctttacttagagtctgccagataatactgtttggttagatgtcaccctgggcattgacaaggcagagaggaagttcaggctcaagctatgattttctgttttcttctagctcctcctttccatttcaatctgttccatccctgtatgtcagctgaaaacttctgtcttgcatagaaacaggcctcagatcgtctctggagcctgactgatcaactatttacctgccacagatttaaatgctggtacccaggtgaccacatgtaaaggaagcataaagggagtttcttgttcactttttaaagacaaaaatctcagtttcctgggtaaaattcgagactaaaaagtttgggagtgacaaccagttaacttcatttcttctgcagagctgagactttctaagggggaggtgattgaccttacaagctaccaaatccccaaagcccaagggggccgctgaggtcagtatgacattgcacggccacgttacatagaaaacgtgattggtaatgaacaggtacctcaaagcatgccctcagattttacatgctgagttactactttgccctttcagcgaacaggcctttgcagactgatagactctgcattatgctaggcacagggaatacaaatgtgaaccgactacattcctactcactgggaactgacagtgttcaggagcatcccaacagacaaacaggcaacaggagcacagagagctacgtgctaacataggaatcaagtacaaggtacaatcagacagagatggaaaggcacatcactttgattagggcttgtgggtgtgtgtctatgttgggtatcatcagggacaatgctccaagagaaattttatttaagctgcaaccaaaagaatgaatgacaattatcccagtagatgaggagaggaagaagaagatgagaagtattcaggctgagagaataggactgcaaaaattcattacctggaaaaacagaacctaatgggttccattccaatagcttgcattgttacatttatattgatttttaaaaacttttttctatcacaagaagtacttgaataacggccagagctatttttgataatgaaaaacgtgaatctgggaggtcaattttattactatgaaatgtaaagttcagatttctcattgtttttaagaagtagtaactactatgaaatgttatgcacttaggtaagttatagttcctaatacacttatatttactatcctcttaatatgatttaaatgttttttttccttctggaaaattatttgaagttggcattttaatattttatttcatattaatagcagattttttttaaaaaaatggacattgaaataacagcaaaccagttttccatttaatattgaaaaattacttttatctttttagatttttttgcctttatcaagaacctgaaatgataatcctttcccatctttcaaatgctttccctgttgtcatataaaccacaattctattaattgctccatgaatgctgctgatctgaaagtcagtaacagcaggagaatcaaagatctttgctatgatatggcgcttctccaaatcatcgttgtcttgagaggatgactttcagctgatcttaaggtgtgatgagattattcacccacggttaatttatgaagtaagccgaaactataaagttaccctgagtgtaaataactgggcggaggactgatcatgccaggtgatttctgacagatggaatcaccatatttatttgtcatactgcttcatttctgatattagaaccatcaccacgaagtatttatagaaaattaacaggacatcatatgacttagtatacacagacaacatggcaacaacacagagaagtctaacatattgccttgggctcaatcaagttgagaaaacttatttaaaagttcagcaaaaaagaggggggaaaaaaggatatcttacttgctaggtgctcgatcttgcaaattagttaatgcagcaaagttgtttcgtacagttcgcagactggccaagacctacaacaagaaaggattcttgaaacttcttgagctaaggccattttaaatacacttgaaaatggtttgttaagagaaaacttgatattgcttgcaacttagtttcatataccactaaagaatctcccaacacttagtgcagtttgtaggtatccacacgaaatccagagaggccagactgcagaaattttccagaaatccctccacattgtctatgcacatggtgacagtagcagcagtttccacagtatttctgggttccttagtcaccaagacaatattccaggcaatacacagataacatgattgcatttttgcacatttcaaatagtataatataaaatgctaataaagctcactttagggataaaaaattccctactcccaaatctcttcaaaaattgatgaagaatctcataataataagttggcaagtgaagtgaattttaaactgtttttctacctttgccacatggctactctagctagtaagcagacattgttttcttttgttaaggttatctgaattgtgcattgtaagaagctctcagggatgcgtttcttatgtaaaatgctacgccctgtacatgcacaatgcttggcacacagaagatactcaataaaaatttgttgactaaatgaatacatagacacaacatgcccacacacataacaaggcaggaccaataggtgtcactatctctaacagtcgctttttctaattccagttggaactagaaagtagccaacggactggaagtgagcctaggagaaggttcctagagccttatctccttcttccctcctctctttctcctgaaatgggcaagtttccccagggtcaaacccatattagatgggattataggtgatttgggtgacagctagagtgctaagtttatgtaaaacacagattccaaatgtctgagtaggtattacctaacaacccagactgtctggctctgttatgtagtaaatgtgtgaacttggactagatatgcaacctctttgtacctcagcttcctaacctggaaaactgggatagtgatacctacctcgtagaattgttgtgaggagtatatggaatgacaggtttggtgccaagaacagtgcctggcaaatagaaagcattcagccaatattagcccatgatggcagcgttacctttgacttaatgacttggcatgcacttgggaaatttacttaatgcctagcattggtaattcaagagtctccaaagttttaattgcttcaaagtttccagagttgttttcagaaatgtttcatctggcacagacctagactaaaatcagtctaattttttttctaagacaaaaatgtcccagactctgttttgttgttgctgtttatgaaattgacattcatttgtgtaagtcaatggagagctgtgtacgccttgggacagtgacttagagaattttcccctaaaggagttaatgctgcttcctaagaagccaaccgtgattaactcagtcactggaaaaacctggctcattatctcatataaacaacccacggctctgaaaggtcacgctgcctatgatggagtattcaaatggccgactgctgacatcagaccacgatgtctttcattaggcatgaaatcttgaatgatgcagaagtaaatcggataaatgatccactgtcgttaaatcatgcaggcttaatttatgttttaagaagtgaatatcaaacatactaatggaaactttaagataaaatcattgcaccagctaattgatccccttcctaggcaaaatttttaaccctagaattctgagatttttattccaatacataatagttaagttcattgcagttgacagctgggtaaatagacatagaaatgcaggcaacttattttctatgatcatttgaagggaaacatcagtcatgaaaagaaaaattagttcatcaaagaaaaaatttctgtagaggagtttttgcctctattataataaacttctaatttaataagtaatctaatttaatattattttgtctttgtttttagtttaaaatttatgtatttttgtataatttatatcttcacatgcttcagaatttaaacaaaagagtataaagcaaaaagtctccccttcaatgattaagataaaaatcaaaattattattacttctgaaaagacgcaatagaaacagattaacctggggagggacactcaggggacattaaaatactgataactgttctatttcttaaactgttcattttagtattattctttatattttacataattacaagctatattcccttatatatatgaaatacttcaaaataaaaagtgaaaaaaggaatctgtcttccggtctctccttcagacaatcagctgcctggccactagcaatcaacttttaggttttctatcttaaagttgtttttgtacaaacactgttgcaataaataatcttgtagagaaattatttcctaggcatgccagtattagattatttattgtgtgtgtgtgggtttttttttcttttgcagcaggacaaactattttataaattttatgtttggtgttaactattatcttctacagtatgacatgtatgctattggcagaagtgtaaataacatttctagacaaatcttataagggggtgttgtcttgggcctcgctgactgactcttggtgtcgtcatcactgttatcactgtgttagtcttttaagctttcactttgcattgcagggcacaaagagggagcatctgttactgcaggctgtggggagaactataaacagttttactgaagcccctaagttaaagttccattgttctttgcttttgttcagggcagccctcacttcccctgaattcgactctttaagaactgtagtcaaagctttaaggctccttttacagttgtccttactccttaatgcttgctaaccaaaaagatccctgacgtttcttccacagagctcaatggttagaaaattaaggtcatttctttctcttctgccccaccaagcagaagtatagccagtcaatgtcaaaattacattgggaatgatgagaaatatatattccttaggaaggaaatactggtagttttacagaaaaattttagacaaagatggttcatgtattagcccatggggaaggattcaatgttatttacgtacactactctcggatcttcttaggtgcttctaaacatttattaaacaataagaatcactgaaaatagcaggaaaatacggttatcatttaacacttaaacagctgaacatcatagcctaaaaaaaaagaggaaaataaatggtttcgaggattgtttttcataaccatatacacttgttaccactagatggcggtaaaacacagaccatgaggttgaggtgccactggcggcggaggaagcggcgacccgcactgggagagattcattacttcggttttacctccggaaaaagctggagtcaagttatgcttatttacaaaatagaaaggtcatttttatgaaaagaaaacctctttccaggttatgttttgtttaaaccctatgaaattgctggtttgtacaccagaaaaggttgatagacaattttatatggttcgctcttaaaaagaacttagatgtccagaagatagtagttgtaatttaaattaattaaggctaaagaaaagctaaaaatttagcaccgactgaaacgaggtgactatcttctttcatagcctggcagggagggcctagcacagtctgcaagcttgaggatggtgatgaggccacaagatcgttgctgctgggtgaagtggctgagggacaggcaggaatatgagaatattggttatattttattaccaactaaatggtaatattctatagtattaataactactgcatttttatcctagaagtatcccaggtgctgtattttggttagagtaaaggtaaagagatgtagttgttcctaccccgtttttttttttgttttttttgtttttttttttttgagacggagttttgctcttgttgcccaggatggagtgcaatggcgcgatctcggctcactgcaacctctgcctcctgggttcaagttattctcccgcctctgtattttcaaatcagggatatctccttagtctgaatgaagtgagggtttctccagggatccagcataatgcttgggttttcctgttttctctttctttcatcagagtctacttcatttaacattacacacttccacatgaaaattctagtcaacttagagttttactacagggtagttgtgtcacaaatcctgggatcactgagcccggaggcagctgacagcagagaagagtttcctacagtttatcagcattgtgcctccttagtgctccttggcccccaagaactctggccaagaaaaaaaggtcagttgccgcgtgcactccagtgggattcctctctagccttcgtgctaaggaaacacccacaccaaaagatttcaacacaaacacaagagaatactttaacaattgaaataagaaaaatatttaaagctgtcactttttctgaggaccaaagggattctgagcttacaggggaaagcataagaaatcagaggtggaaaagagtttaggttaaacaccagcaagaatttctagccctgacagtgttttagacaatgggataaactatggagagatactataggatcctttctgaaaattactatccaagatgtttcaggctttagcctggccaaaaaagtgcaatctatctttgcacggcttcctaaattctcctctaatttaggattttgctcttttcacgtcaaaggaaaccatgatttggaaaccatgattcgtgttttggagatggactcaggcataaagaaatgagttctcaagaagaggcagaagatgagatggatttgggaggggatctttgaacaccttagacaggggaaggccatttttaggagccatgggacagaaaatatgcacagaaaaataaatctgaagggatataaaataaaatgtcagtagcagttattttggggtttggaattttagaaaattttccttttctttttcttattatttttctaaacttttatgcaaaaagtttttgttttgttttgtctttttgagaagcatagctttttcactggaatttagtgtgaaattccaattttcaaagcatgctgagaaaagagggtaattctttggcctacttggctaaatatttttctgagtgacttttctaaaatccattgttttctgtcctttggtgaaagcaattatggtatatcaggacaaattagattggtatcacttcaagtgacataagtatcttatatttttagttttaaatagttaatgctaaaatagcacttaccattaagtggtaagtgctttactttgtattaaagaaaatttgagaagttagtgattgggtcagcaaaacatgccaatcatgtccaacagggtttaagagaaggccactcaaacatactcactgggacttctctcttaacccctccccacagatgctctatgaagagtggtgaaactcttcagggcttaacagttttttgttttgttttgtttttaattctagtggggctttccaggtcttatactccagtaaaaggccatttgtgaaaaccatgatgaagccccttaaaaaaaatcggcagcctctcaagtaatgaccactctctacaaggtgttatgagtcacttagctaatcataagcaaagacttaatatactatgggattatttttaggcatcagatatgcctataaattatacagctgatttatattccaagttctaatttcaagtatattaagtacacatcttttttatttaaatagcttactaacatggactaaattacatatatgtgtgtatttcccaatatcttgaaattccattagttttttttccttggagattataggtacactacagaaaatatctaatcaggtaaaagactagatttccttggaatttaagagcactgatggcagggttcaagtccaatttactaatctatttgttgcagcttaataaatattacttgatgtaaaagaccatatatcatacacagaccttttttcatttgttattaaatatttatatatattttttcttataataatacctagatcatttggttagaaacaagaatagctacttgaatgaactcaaattggaatgattggttctatgtttgatgatgttacttacattgttatgccatattttgtctgttcacctctctctgaggtcttagatatagaattataagttttctttctttcctttttttttcttgacagagtcttgctctgtcacccaggctggagtgcagtggcatgatcttggctcactgcaacctccacctcccgggttcaagcaattatcctgcctcagcctcccaagtagctgggattacaggcacccgtcaccatgcctggctaatttttttgtatttttagtagagacagggtttcatcaagttggccaggctggtctcgaactcctgacctcaggtgatccacccacctcagcttcccaaagtgctgggattacaggtacgagccaccgcacccggccataagttttcaatagtaatcaattaaaaaccctcagctttataagattttgctatcacatcatattattaaatcatacaagtgtaaattttttggacacagaaatacaggtactagaaagaattcataatctccagcaaaaccttcagcaaacaagatattaaccatctgaaaaggatggtgattgtattttatttttaattgcctgcattaatttaaaaagttactattatacattatgttacttatgaattgattatattataggtctaagttacagtaataaaagtttggaaagttttaaaaagtagaactatacataatcctactatctaaaccctattatccatttaaaaaataatacttatgacattttagaaatgaaagaacattttcagctctatacatttaaaccaatcacaaagtttttataatattatattttcaagcaattgtgcctagcattttataagcgtggtattatttcagtgtcttagcaatcttatgaggtgggtactcttggaactgttatttaacagaggaagagaccaggcttggaaaagttcagtgactcgctcaagtccattgagttggcaagaggcggtgaaagggttttaactagatctgactgtctttcatccagctcagtcccctaactctaccagttgaaaaaaaagaggacccagaaaatttaagtgagttgtccaaggtgcaagagcaccttgatgtatgatataggcctgattataatttttacaacctctcaggattacttgcattttaatatttaacatttcttactcatcagtgttggttttaaacctgcttcatgccccaggttaaatcagttttatctcattccgcccttagttgtctataccagagactctcaacttctcctgcacactagaaaaatactaaggcctttaacaaatacagatgcttgtaacagatctccaaatttttggatttaattgaccagggctgcagcctgggcactgggataagaggtctctaggttaatctaacgtgcaggtagggttgagaagtattggtctatacatagaacatctggtcatcaactctttcatatttatattcccaaacattttagatcatgttatcacctgcttgcacatatgtcatgtggttaaagtattttcatgatttgtatgcctagaaggaagaagtaaacatcaacacatcactcagctaaatctctgcacaaatggcatatgtaaaaaagagataaataaggtattgggttgaattggaatattgaatttcaagcactgatcatgtacctaattatactaaacataacttaagccatgatatagccttctgcttctagtgcttatgtcagtatgagcccaattaagtatatcccttagctaatttattatttgaagcaaagacactctttggtactatgggtttataggaaacagattaatatagccaaagtcactttctctagcattgcttttgaattgcttgaatgaaccaagaatttgtatttgtacttgtgcttgatttaaaattaaattaaattaataacccgaactaattccccaaattaaatttttacatctgtgagaaacctgcccattcaccaagctgtgcttacctgagcaaatggagtcacaatcaagtcatctccgtgtctgaaaaataaaccaaatcccgcattagaaatcatcaataactctgtgctcagtgtcgttcaatattaaacggcaagttccactttcatgagttcccatagagaattacagtgattccatccttatacttcagcacatgttcttcccagcaactgggttaaaaatatgtcttctgggatgttaacaattgtccaactccctgggtaaaaagaggggcttcttgatcatcagccagggtcactgttgctttttaggcacacaggatatgcaatagtagaaatggtgttccagcagtggggcctgagttttacttttggcctcttactgtagatattagtaaggggtgctgtggaaggaaccagcaatgcagtgacttcagtgagagaacccttgaccatctaatatttgaaggtgattagcatggagtgttccacatcatcccgtgtaagtcttggacaggctaggaactgtagatgacatgggactgcatcatacactaataaaaacccagtgaaatgttcaactgactcatcccagccactgtagtcactgggaaatgttactccttgtgtgctgttgctgcagcaaccccagctacaccgtgcctggggtatgggagcaaggtgtcagcatgacgtgtcttggagggacagggaagggcaaggaaagttgtgcaacattccagttagaggaaagtgagaaactggggcccagggttcttttgtggtatttcttagcatgaataatttgagacaaggatttccagagtcaccatcagctatttcttgatctagctagataaaattcttaaatcaaaagtgaatgctgttattcaacacagacagctccctggacatggccctgagaacagtgcaaataaacttttcgctcactcatgaacaatctgaaaacaacctgagtgacccaaaacaacacccatgaaacatgctggggcacagggagcatatggatgatgttactcaataaattgttaccaatagctagaataggtgctgtggtcgtcatcaaaccatgtggagatcttgaaaataaaaatgtgggaaataaaagcagaagaaggaaaaaacaatgtaaaggaagcatgtgttattttacacccccttagttccagaatcatgtttttcaaggggcacctgctctttgtagagattattcatagaactctagaactctaagaaggtaggacattgggttttatgatcattttatagaagaggcaactgaggttcagagagggcataaggtctaaaaactaataagtggtagaggcaggatgtcaattgaaaaaggtattttcccatgttgatgtttaattgccattgcaacagtattaagaggtgggggcctgtgagaagtaattaggtcaggagggcttcacactcatgaatgaattaatgctgttatggtgggagggggttagttatcataagagtgggttgttataaagtgagcccagcccctcatgttttctcttttgcatgtgctcacttgcccttccatttttccattgtttgggatgatgcatcccaaatatcctaatcagatgctgatgccatgtccttgaactacccagcctctagaactgtaagatataaacttcttttctatataaattaccctgtctatgctattctgttatagcaacagaaactggactaagatagtgttcttctgtcatcaataaataatttacataatttaccttgactctcaaaaaaaaaaggtcttctgaggtcaagcccagaaaggctctttcctagaacaatggcccagggtaggagcaggcctggtgcactgaagtggcaaggaggccattgagcccgtgggagccagcagagagggatgaagccaaggaggcagagcagctgcctagatgagaaagaagcagatacagagctgcaacgagaagctcggtgattctagagaatgccatggaaggcaggaaattcagaatcatgggtggtaacgagccaggcagcagatcacagagcccttgtatgaaatgtacaagaacttggattttactctctgatggaagtttgggttggaatttcagctctgccacatactaggtgtgtgaaattgtgcaagttattaaacttcactttcccttggcctcttcatctgtaaaatggagataacagcacatacatagagtgatgttttgggattcaataaattaataatgttaagtgctgaaaaatgtgcttaccacacagtaaatgttcaataaacatttctataataataattagcagcagtagtaaaaccttttaaatcataatgatttttgctttcctatgcagtcaggaaattgcaaagactcagaaaactgatacttcgctaagaaggactcttgagaccctgtgacaggtctataaaagattgagggctttaaaggggcaaaaatggaagcagggagaccagtgtagagaaaagaagagatgaggacctaaactaaatcagtggtagttgagagagagagagagagggacgatgacagcattaaaagctctgggggaaagaaaaagttctggggaaaaaaagatatgaaaatttcaagcatttacaaaagtaaaaagaatgttatcacagcaagtgtattttatatacaatcatcagctgttacaacaatgttgcaaggtaggtgacattactcccatttttcagatgagaaaattgtagctcaaattgattaagagatttaacacaaagacacgcaggtagtaagctgcacagccatacctggaatggtccccttttgtgatatgcattggctgattcctatggaacagcttaaaaagattaaaaataaagctctaggaaaatggcccaataaatgcaaattacaaagtgatgccagggttggccagctacatttcttccttggcccatcattctgactttcccttctggctgtgtcatataggtaaatatagggctgcaatttctcttatgtacttattttgaaacagtagcctaactctcacaaaacaactgagaaatatttacagatacaccagtgtttaaaaagcatgaagacaaaatccagagctaaacacttcagcatttgacaaatttctacacacataaaggcacctttagagttcatttgaagccaaacattcttgggagtggtggacaaatcagtaaactgtgtagtgtgttagaagtccgaagacaaaaaacattttcaataggtgtatatactacatatattgcattcaagatagttcaatggtttctgacattaaaaaatgttattaaaaattccataatgggaggtatattacacaaggagaaaagacatgccacctatgccgacttgatttgccagtctgataaactattcatctgcttcagtgcatggccaagctgaagacattgtattgtaaaatggatgagaggcagttcagataaccaaaattaaaataatatgacatcttcttattgtcccaagctatagtctcttctttcattttattctttataattgacctactataaagtttatttttttcaggactaagtcatcttgacaaggcacatcatcaatctgaaatgaatccatggaaatatgtctcctaattttttatatagattgcagtggatttgaatctttcaaaactcaaaagggttgcatatttattaaaacatttaattttctctttggttgtatctcctttataagtattataagtaatacactttacaatatttatgataatttaccagccttttttccctatgaaagcataaagacagttatcattttagtgaaggaaatatattactttttaataaattgcccagaaattgtttctgccaaatatctcaagatggtctcattttagtaacagtaaaatgatacctagcatttcagtggcagatgtcctcgataaacggcaggttatagcctatccatttattttcaaaagtatgtcatgcttaaattatctttgaatatatacctaacatataattttaaaatctttgtctaagtcctcaactcaatattaaaacagatcttttcagacatactgtcactaggagaataaggcaagtaaaacctatttttatttgtggttagaagaaaataaatataatacaaacatatctttgaattgtgtcttacactttgcttataatcatttaaaaacagatctggtagttaagatcaacagaagattcactttgtgaatatgatttggtttaaagtatgtgtgggttttaatgaactgaataatcacatatgctcaaaaaaatcctatgaaataaaataattctgaaatcttgcacctgaacaactttacccacagaagctttttaaagcgccttgccacgtaaagtggggctgggagggattacaatacaatgtaataaattggggcttcctaggcctacttggctaaatatttttctgagtctcttctgagatgggaagagactattagggtctctataaagtgactgaaaagctagattcaaagtcacacagtgaatatcgcctggacattttgaaattgtaccgcctggtaatgtgaattttgggtgaggatgatgcaatactgtctttcatttaaataaaaacaattataacaacaacaacccttaacaaaaaacagctgtgatctgttttaaggaaaatacagctcttttaaaaaaaagaactggagtgttcatggaggacaggcggagaatgaatgagggataggaaggctcagaaaaaaagtcattttgacactgcgtgtctatatgtatgtatgtatgcacacatgtatacatgtatgtatgtatgcacatatgtatgtatgtgagagatgagattggtaccaaggtaacagtcacagcagaatgcaagtgcagaaacttctagaacagccaggatgagccactgtaggtcactgtgggagtcagtgtcacattggttttaaatttcatgatgtccaaggaggtgccacatgctctgtcaccttccctggttaccaggaagtgaaccagagtcatcttcactagtcctggcgagccttgtctctcccaaagagaaagacttgctgagtcctgagccagcgctgttgaaagcaggagaatacagggctcaacagtatactattgtctttttttttctcacaagagaaatgacagtagagtcaggaacttctattctctattccccctcccatccttcttctacttctgtattatttatcacgttattttctaccctttttctttctgtaataaggaaacagaaacaagcaagaaactaaaagcaagaaatccaaatgcccacactcttatggtgactttgttgagatccatatatggttcaagtacttaaaaatgaaaaagcctgttgtcatcttaaaaaaataagttcaaccaacatcagcacctgaaaatataatttcctatagaagttcatttcatgattggttgaaatcttaaacacactaggtggcaatctttatctgttttactattacgaaatcataaggaaaaggagatacagttaattagaagaaagtttttactttatggagcaaagacccctaatcctactatatttaaagcattagtggccatgtaagacccactgcttttgaatatcacacattgcaaattttagcatgacaaatgaatgcatgaactagcactgtgaaggagtcacaggctggggcttacgtttgaatctaatcctttttttttttttttcaatggcatggaggtttgctatgttgcccagactggccttgaactcctgggctgaagtgatcttcctgtctcagtctatggggtgcctaggattacaggtgtgcaccaccgcgctggccgaatggaatcttgtgcaaacttttttcatcttctgtgcttcactcactcttactagaaagatattctcctctgaagtttgtcaataggattaggaaattgataaacatatagaaaattaaaataatatttttgaaatatattttaaagtccaagattttgataattttgaaatcttagtatctttctttcctcagcctaaaaactatcatccatctatcaattcacccttgacaacttcttttagaattatagagaaacaagtatgttctaattttaaaatgaatataaaaatatttctgggagcctagactatttgacaacacccaaggattagctataggaggaccacgtctactcacaactctctagacccatcttcatagaagtatggacatataaaacaaacatataatgtaacctacttgatctttatgtgtgtgtatgtgtatatgtatatatacatacatgtacatatatacatacatctatatacacatgtacatatatacatatatgcatgtatatatacacacaggcacatatatacatatatacatacatgtatacatacaggcacatacatacatatatacacatgcatacatgcatgcaacatacatacatgcacatatacatacatgcacacacacgtatgtacacacatgcatgtacacacacgtatgcacacatacatgtatgtagacatacatgtatgcacacacatacatgcatgtagacatacatgtatgtacacgtatatgtatatataagtatacacgtgtatgtatatatgtatacatacacgtgtatgtatagatacacgtgtatgtatacatacatatgtgtatgtacagctacacgtatacatacatatgtgtatgtacagctacaagtatacatacatatgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagatacacgtatacatacacgtgtatgtacagatacacgtatacatacatatgtgtatgtatagatacacgtatacatacatatgtgtatgtatagatacacgtatacatacatatgtgtatgtatatatatacatacacacatatgaagtacatgcatacatatacatactttgggagatatagaacaacttaaagaaccattcaaagataactattgataacattttcccactgcatgtatgtgagcacatgtatgcaatatagtatgtgactattatggactacatacttccttatagaattagagtcatagtgtatattcaactgtatatcttgcttttagcattaaacattaatgaaccataaaaattatacatgcctttattcttttaaaatattgttaatgattccaatctatattcggtaatctctaaaatttttcaagttatgtgaatccaaatgtattaaaatgtaagcattgattctatttttaaataaattaaaaaataatcatatgggtttttcagacgaatttcagttcatttatcattcattcatttttaaaaagctacttattaaaggaaacatgcttattttaattaaatatacataagacaaaggtaaatattaaaatgctacatgagaaactgggctgcacaggtaattcatgggaatgttaagtattttatattgctacctgcttaaattaaaatcatgaaactctaatttcagacaacaaaaattctgtaaaatgtgactaccaagaaaattttgcaaaaccaaattattttttccatatagcgtttaaaagagatgatttgtttttccaaaaataatgttcactctgacaaattataaatttaagaatataatgaatgatttaaaattacttataaaggaggcattagatttttttataaactctaagtaatctatatagtaaataaaacaataccaaaaatacataaaaactgtttccttggtattagacatacttgaggatatggatcctctgtattgcttggccttttaatttgaaactagctccatttaagtcaaaataaattaagcagtacatctatttatgaaaccctagggaataaagttcctaatataataaagccaacttcagttacaagtgaatgtgcttttcctctttgaagctattgccacttagaattaaaataatctatttaacacaaaaacttgtattaaaaatcacaactaccaaaactttcaatttggcaagaatgtccagcaaccttttactgagaatcaaagaaaatgtaaattaatatatgagtaacattaaagctgtctagtattgtgtgaggtaacatcttccaaattgaaacttttcaacgccaaactcaggccacctgtttgtatatctgtgtatgcagcttttctggtgttttgatcatttttttttttttttttttttctgagatggagtctcactctgtcgcccaggctggaatgcagtggctgcaatctcggctcactgcaagctccgcctcccgggttcacgccattctcctgcctcagcctctggagtagctgggactacaggcgcctgccaccatgcccagctaatttttttgtatttttagtagagacaggatttcaccgtgttagccaggatggtctcgatctcctgacgtcgtgatccacctgcctcggcctcccaaagtgctgggattacaggcatgatccacagcgcctcgcccgttttgatcattttaaatattttgaaaaaattttaaagagatgtggggtctcactctgttgcccaggctagagtgcagtggcacaattcacagctgactgcagcctcaagctcctggactcaagtgatcctctcacttcagcctcccaagcagttggaattacaagtgcaaaccactatttttatttcttaaagcaggttagaattttttttttttgagatggggttctcatcttgaattttaactccgacaacttccacatgtcctgagaggagcctggtgggagatgactgaattagggggtctggtctttcctgcgttgttctcatagtagtgaatgagtcttatgagatctaattttttaaaaagaggaggtcccctgctcaagctctctctctttgcctgttgccatccacataagatgtgaattgctcctcctcgccttccaccatgattgtgaggcctccccagccacgtggaactctgagtccagttaaacctcttccttttgtaaattgcccagtctcagatatgtctttatcagcagcatgagaacagactagtacagtgaccttcaaagatatttagttttctgaaatttaaactgtttgctcacatcttattaatattttaagaattaagaaacaactcaatggcaaaaaaacaaataacctgattttaaaatgggcaaaaaacctgaataggtctttctcaaaacaatggcctgacacagtggcttacacctgtaatcccagcaccttaggaggctgaggtagcaggatagcttaagcccaggagtttgaaaccagcttgggcaacatcgtgagacaccttctctacaaaaaaattaaaatcaaaacaagacctacaaaaaaaggtcaacaggtatatgtaaaagtgctcaacatcactaatcttaagtgaaatgcaaattaaaaccatgatgagatatcacctgacacctataatagtttttttttaatcaaaaaaaggtaacaaatgttggtgaagacatggagaaaaggaagcctttttacactgttggtgggaatgtaaactagtacagtcactatggaaaacagtatgaagggtcttcaaaaaattaaggataaaactaccatatgatccagcaattctacttctgggtatatatccaaagaaaatgaaatcagtatgtcaaagagatacctgcactcccatgtttggtgcagcattaatcacaatagccaaaatatggaatcaacttaagtgtctaacaacagatgaataaagaaaatgttatatacacacacacacacacacactagaatcctactcaggcttaaaaaggggatatccttccatttatgacaatatggatgttcctagaatacattatgcttagtgaaataagccaggcaagaaagataaataccatgtgatctcacacatatgtggaatctaaaaacaaaatcaaacttatagaagcagagagtagaacagttgttcccagggactggagcagggcctgggggagaatgggaggatgtggaatgggagatgttggtgaaagggtacaaagtttcagttagaaggagaaacaatttcaagagatctactgtacaggctggtgactataattaataatcatgcatagtatacctgaaaattgctgagagtagattttaaatgtactcatcacaaaaaatgataaattgttaggtgatggacctgttaattgcttgatttaatcattccacaatgtatacatatatcaaaatattaccttgtatataataaatgcatataatttgttatttgttgatgaaaaataaatttaaaacaagaattagagcccggccccatctttgaccaaaaaaaaaaaaaaaatctttcaaccaaaaatccttaatttttggctcatgtgtgctcatatcacttgtggaggacaggcactgatgataaagcagatgggactgaagtttacgcaacataagcaaaaaataatctagtctaaaatggaatctctttatttgtcatgagaaaacaatttaggactcattagagaaaatacatgatgccaatgaatgccttcaaatttgttagttatatgatggcacaaagactatctctgttagaaatgatacaccaaaattttccaagttaaataattaaacaaatgtttagcacatgtgtgtagacatattcactaagcatattaggttattttgtttaataaaaaccaatacaatagagagacttttctaggacggctgatgtcccaaattatcaccagaaggtttgagtacaaagctgagagtctgacttccatggagggaagaaagacagcgaaagagttgagtacatgggcagggattcacaagtgctctcactttgtgttctaggaacgggatcttctttcacagtttatcttattggcaggcttgttcttaatgccagtggccctgcccttttggtttttcaccagaatgggatcctagggaaaagatttttggtcaactagtgcaacaattttaaaggtctgcatgtggtgaaaagattcaatagattaaaaggaagcccttgatcaaacagagaggagagcaatgtgttttatgaatgcctactaggcaccagacacggtgttctaccaacatgctgaatttaatcctgacaactctgcattaaatggatgctcatattcccattctaacataaggaactaggccctgacaacttaagttactcattggcagtcatgcccttgacaagctgacagaactcagtggtttccaaatgccactctaagatctggtacttgcccaacagaatgctcagtggtccttgtcaaagtcagagtgtacatggaccatgcagtgagattttttttttaaactatacgtattcctttggaaaattcttttattctgagattatgctctttctttttcactgaagtgaaaatgtctttaaaaaataaaattaacatatatattgatgggtaattccttgttaatgttctttacctggcaaaataaggagttagtaaccctaggtcagtgtcccagaaattttactgggtcataaaatcccaaggcatggaaatgttcagtgtagctggatttgagcccaggccttcaaatactgttttgtttttaccatgccgctttctgtatgctcaaatggatttagactattctgaaggcacatagaagtaaatgttttagactctagaacagcactgtccaatagaatatttctgcaacattctatttctgcaacagaatattctgcaagactctcggtgctgtctaatatgctatccactagctaaacacacacacacacacacacacacacacacacacacacacacacaccaatccacaaaaacaaaactgatcttggtggttataacaaattcaatttgaagttctgtaagcaccaaagaaaaaatgaattttgaaacatggaaatatgagatctgcatgtagctttgttctcccttgggagtgaaacaatgagttaaaaaattttggacttgggatcattcatgacatttattgggagacaacatcatttactgaactggtgaaatgatttcttgtcacatcacaaccttccacatttgttgaggggtgagcagttattctttttctttctgctctgaagttccctgcgtcttaaagagagggttgcaggaattgacacattatatatgtttagatacaactttccagtattcaatgtcagcaaatttttcttgacccaaggttaggaaaaaccataaagtctcaaggcaattaaccgtaggtggacacaaagcctaggagatgctgcagtaggcagacggaataattggggttgtttcctctgtgaacctggtgtgaatcataccacagattaccaggaatctgaaagcaaagcccagtggttgatattccttacttggttttctaaagaaaaaccatgggtctgcttgatgctttctttctgtttatttatagaagcacatctttagatgattcatattgcaagggcttagacagtatgatttagtaatactccctggaatatcttatctcaagaaacacatcacataaatgttccagcagtgtgactgtttttccttatatggctcagaaaacagtaaaggagacattgagaacaattcattaagaagctaagactgacaagcaaaagtaaatatttaaaatgattgatgtgtaagtgaaaacaagtattcatatgggaatctcagtgttggctggaaacatctccttttgtatcaagaatttttaaaaattaaataaagacaagaatgcatgctccaaacaatttttttgtcttactttcatggatctatggtgtcttcaaatgataccctggcatggagtaggtgctactgttattttccaaacgagtaaaacagtgatactcattcaaaaatgcacatcaattaatacacacctttatttagaatgtggtggaaaacacgtattggtcatctccaatagaagtcaactttcttcttcttcccagcctgccaccatatgccccaccgtcaagacttaaagttcaggctgtgcatagtggctcttgcctgtaatttcagcactttgggaagccaaagcaggagtattgcttgagctcaggaattcgagaccaacctgggcaacatagcaagacctcatttctgctaaaaattaaaaaaaattagccgggtgtggtagcatacccctgtgtttgggctactagggagactgaggtgggagaatcacttgagcccaagagctcaaggctgcagtgagctgtgattacactgctgcactccagcctgggcaataatagagtgagactctgtctcaaaagaaaagaaaaaaaaattaaagttcaaaatatttctattttacaatacactggagcatggttttgattttagtcttctttaatatacagagggaagagggttgagataaagtgagagtacactagtgtacctctaggtacaatatccacaactgggtgaaccaatatctctcctgtaatggccatttgcctcttggaatttcaagaggcaggaagaatcagtaattttcaactatgggtccttcatctaggggccgtgtttcattgagagcactatccaggttactggactagtttttttctttcaaaatgttcttcaaactttccttattttagtttatttcacacataatgtgctcttagagattgcattcttttggtatgcactgaaaaataggctaatcttccttgactgaggccaattctgagtttactttcttctggcaggaattcagtgtctcataggattgtggaataattgctcttgttattaaactaccacttctccctgcatttttttttaaagaaagtagatattatcctttgaaatgtattaaatctgatgtataagcataattatataatcattatttataagtttaaataattcaccttcacactctttctcttttatacaggagtgagaaaaactcacatgatttttagagttttttttttcacatttaaaagatttaaaagtgagttcagtctgtaatcccagcactttgggaggccaaggtgggaggatcacttgaggtcaggagttcgagcccagcctggtcaacatggtgaaaccccatctctactaaaagtaaaaaaaaaaacacaatcagccaggcacggtggcaggtacctgtaatcccagctactcaggaggctgaggcaggagaatcgcttgaacctgggaggcggaggatgcagtgagctgagattgtgccactgcactccaacctgcgcaacagagtgagactctatctcaaaacaaacaaacaaaagaagtgagtgcaaatactgaggaacatagtgagtataaaggaaatctagaaaataaaatggtatgctaaatattagcacaaagtcctagagttcgaattgcagcaggcttgtcatagaaacaatgaattacgtatatgtttggtcagttttcacttctttttccctctgctttaacaactttttataactaacatttatccctctatctctcctaagacttcagtatatatctattactttggcagtaatagccaagatatattactacatataactcaattaattcgttattttaaaggttagagcactggcaatgatacttagaggtgctggcaccatctcactgtagcagtgcattaaaatcaatgctttatttttatactgtggcattaaaaacattaccatttaaaatgtctaaacatcaggatttcatttttatgatttttttgaaagtatgagattaggaatataaaatgcctattcagctaatattttaaatcccccagttcaaggattgaagaaacttgtttagctaatttataagacttattttacaattcatgaaactcccatttttttaaatcagaaataaaatgacttaagtgattgaataaatggcaccaaataaagcagaatttttaaacaaaaagatagtaaaaaggtattctagtagcagatgaccttagcatattttgccaataaacttcttgagatttaatagctagtattaatgcctgcatcaacactccgaataatactagtaacagtggccagcacacagcaatggaagaaaaagcctggtctatctaggtcattaccaaaataatatcacattttataaaaaaagattttggctacctgggatcctaacagaattaagaaaaagataaattctctactctagagcacatcagatacttcacagcttggaaactgttatttttttaactcctaacaaaattctctcaaatagtctcacatagagatctgatttatctttaatcatttttttttgtcttgaggcagggtctcactctgtcatccaggctggagtgcagtggctcaatcgtggctcactacaacctcaacatcctgggttcaagtgatcctcctgcttcagcctcccaagtagctgagactacaggcgcccaccaccatgcccagcaaatttttgtattttttgtagagacagggtttcaccatgttgcccaagttggtctcaaactcctcagctcaagccatctgcctgccttggcctcccaaattgccaggattacagatgtgagccaccatgcctagcctgatttagctctaattcttcagatatgaataaacaactaatccaaatattttcagactttctcagtacatggtgcccttaatatctcaattttttaataacagcaacacattggccaaaataaataatagttccaattattaaatagttaagtccaaataacttaataaggttttgttctaacaatttagcacccactgagcactatgtcaatttctcattttggaatgagattggacattgcctcccttattttttgttgcacattgatttctgctcagcacttcatttttatccagcaactgctgaaaacccaattttgcaaagatatggtgtcacagaaaggaatatcatggtcttaattggaaactgggaactattccaagctattagttttccaggtggttgacagatgttttcgtgtttttcttgaacatttaaaataacgcttgcacccatgtacattccctctgttgcctcaggacacattttgagaactctggccctagtcccatcactcctacaccacagggtgaggggtgaggatacctccccagctgggaaaaacccagaactggggaagagatgatttggccatggtagctttctttctgtggttaatggaagaaagctttcaagataacaaattgatatgcttttgaaatgttcattagtgtaatattatcttgcaatctaggtaagagatgactacaaacttttcatgtagatccagtgagaattagaacctttgtaatgcaacgtgtctttttatttatattcttcctagtgagaccagggaagattaataatctggaataaaagatacaaattgacataaagggaattcttcttcctttttcaaactcaggactggaagcaatactactcttatacttagcaggcaaaagtagtagagaggagtggctgtgactgaaaacacacattagaggcccaagaagtggtgagggacttgttaattgctaaagaaaggacagtagtttgacatgggaggtagggagagtattatctactagctgagaaaatgccccaatggggcaccccgaaggcctgatcagtgaggtctgagatatctgtatagtgcctggggataacttagctagattcccaaatatgccccagctttttatggtatatcaaatctactcacttcctcgtcactggccctctgaatgcattcaccccaccccatattctgtgtgtagaagcaatgtatatgaatgtgagtgaagagccgattggatcatctttgcattctatgtgttggtgttaatttaacagaggatggggaatagaggattagttatccaggtgaattgagtatttcttaaaacttaagtagtttgacaggtaacttatacttaataaattcatagttttgtgacttaattctacttatcttgtcattgctaattctcctcttaatctttgcaatgtatcataactttatgtgtttccaaatacagatactatattactggatgatgtgaaaacacagaagtgattgttattcagatgctgaaatattaagatgacaaaaatattgtctatttacgctgtaattttcttcatgttacttcatgacaccacttgggcaaccagccttttgttatctagttgtttctactgttataaaaaatttttactattaatggtaatgcaagtttattttcatgtatttatttactagactcatgctaatacttaacatttttctttttcttacttttcttaagaattaagttgctactgcatcatctatatttaacaaattgtgtgacggtctctgagcagaagtggtcaggaacttctcttctgccttatatgagctaattttttagattctgaatttagcctagtgctatatacttgtatacattctctaagagttggctgcatatttactttgtacctccttgagcttttattttattcttaatcaaattttgatactgctatgtatttcattggtttaatgaatttggtcaacaattacttctgtttctcagcagtttttgctgtagtagtataaagtactttgtttacaatggcattatcaaattatgtgctcctagaaataatcaaaatgcttgcttttttttcaaaagattaagctcattggactttggctttctaacctgtaaaatggcataacaatgtccctatcaaaaggactgtgagtatatcaaataagatagctggtgtgaaaatacttgggaaagttgatgatatacacacaccatgtatgttatgattattattactaccatctttatctgttttgttcttcagctatttcattggtttctatttatagaggataagatgacgatatcctatctactaggaagggattatcttccttcttctcactttcccaatagagtaaatagttatatttaaacttaaagagtatttaaaggttttccaaaacagttcaattaaatagataaccacaaaccttcattttaaatacccttcattaggtacctatcctcattaggtactgtttgtatttgaaatttctaagaaaatttctcaataggaaagcttaactagaactattaataagaaatcatcaagtaattaaatatataacatcattctctataaagcgcagttgaattatacacatcagacagtcttcatagcattattgtgaactaggtaaggtgagaaaattaaagtttacacatggccatatgagaattcaaattaagagaaggcacagtcctttatggtggaagatatgtgtcgtgtcagattaaatgttgaaatagttattatttattctatttccttttccttccacagaaacttaatctccttggtagaaagaatgctttctaggagttggtatcaaaggaatatcttactgctccaatgtaaatatccaaggagaatggaaagctaaacatatcaacacattacttttcagcaaaatatagtgttgactcatggtctgattaaactcatcattcctacctgagtctgatcagataaagaactcttgaggcacacagcaaaatgaggtatccttgcaagtttgattttgaaataaaagcatttcatatttaaatatgaaatgctataagcttttcataaaatatatgtatatatttaatatttactaactggagtagaatgtatgaaagaaacaatctatcccaaactcagtttactacaatttaaaaaggtagaacacataactacataaatggactccactaactcactgtgagttttcctctttcttttgtcaataccaagcctgactcacctttgatgaagttgcattagatgactttcaattctgtcattcgcctatttaacattgtttattgttatctatggggctggtcagtattctactcacctttaccctgttcccttttttgatctgcatagtggcttttttaagcctttccctttcttctcaagctgccccatccctctctcctctggctattgatggctgtaccttctacttttacattcattcatctggagatggaggagtaaaatgtttagagaactcatggctaatatctcttaacattttactcctccatctctaaatttacatttcccttcttttactcttcttctccttctccttcttctcttctctcttattcttctccttctcctccttcttctttttttctttttttccagacacagtcttgtcttcctctgtcacccaggctggactgcagtggcatgatcgtagctcactgcaaccctgaactcccaggctcaaccaatcctcctacctctccagagtagctgggactaaaggcatgtgccaccatgcccagctatttttttggatttttagtaaggacaaggtctcactatgttgccaaggcaggtcttctttgtccttcctaaagaatacagttctggtatttactacttttccaaggatagcctccttactttggctcatgatcatgtttttgtcagcaactacagctccatctttaaaccctctttccccttgaatttttagtctctttctatctcctggagccttccctcagctcaagtaacctgaattcaaaaaaattccgcttgaacctaattctctgtcaggcagccttagttctttcttcctactccacccatcagccttttaaagagatgcctgcatttgctcacatttccactttcaattcactccttaacccaggggctcctaatgctattacctgaatacaacgcaccactcaactgtcattcaaaaacctagtaattatagaaggtaactgttctatttctcctggtcctctggactgttatttctgtttgctgtcccagtactttaactgttgtcttgtttcccctagccttatcatgtacaaaccaattcatcacctgttatctgtcatgttttctactctctgccctttgttcctcatcaccatgtacgtacatcaccatgtacgtactcattcatggacaaaaatcagcactctctttgattctccttctccactggctgtcccccaacatacatacatacttcacacacacacacacacacacacacacacacacacacacacacacaaccattctataagcctcttgcatctaaaccagctctttgctccactgccatcactcccttgacttaggtcttcatcatatttagcctgccttacttctgtgaatttcgacatgaaatacttccctgtagtgacttcgctatgcaatcattcaacaatagagtaatcaagatgcaataaaaacaagaatatgatcatgccaaaactcagctaaaaacctctgtggctctcaggtcccatagactgtatttgaaattttcttctctcttgccaggtttcgctattcacatcaagcagattgtcattccttagttcagccataattttccatgcctcacatttagtaaatgttgttcccttagcccggtattttctgtatctttcccttgggtggaaaactctccatctcctctctctgttcctgcagtacatgataaatgcctcaaggattgtgctcaccatattttattacaatggtctaaaatgccagacctcactgctccacagattcagagctttaaatacaccatatttgctcaagaagcattctcattatgtgtgaatgaataagtaagtgtcatgaatttcaaatctaaggaagtgagataaaaataatgtaaaaatagggccactaggaatagaaagttgtttagagatgaagaagggtagacgtcaataatacaactgctaaaatagcaaccatagtttgtaaaaatgagtgaaatataatttcatttctagaaccccatgtagacctattgcaatacaactgatgctctgttagaatggcaagaataacactagacactcaggggttccatacagactaattcttataagataaattgcagcctgttatgagtttttgagatgggtgtcatgaaaagatggtgaatgttattggacaaatgtatagaccaagagagaaagatgaagatcgattctatacagaggcagatgtgccacgaatgatagtataggtattgagtgagaataaagacctatgtagaaaaacatgcacactaccacaagaatgaaatgcactgagaaaatgagctagtgatggtacaggatctgcaaacctgcttgtcagttttcattgtttttcaagctgtactatatcttaaatgatattcaagtctgtctaatgttttctgtgcttgcctctcatgatccttaaaagttggtttaattttggcaaagtcccacaaagatttcttaaatgatctggcaaaccagtgctaacatctgtacatacattaattgaaatatattcaaaatgctatacagtctattatcacaggacttttcaatggagttgaaagcttttcaaaatattagaaaatatccatgtagttaggtagctaaaactcaggctctacataaatataagctaatgatttaagtgttagtttccattaaaaatttaattctcagttttcctataaagtattttctgggaaaataaatacatgcgtgtgtgtgtgtgtgtgtgtgtgtgtgtgtgtgtgttaatcaagagtgacagtgcactcaggttaaatctaccattcatttctagcttgtataattttattcatattctttctacattggaggagagtgatacagttgaacaaaagtcattagttttattatgtcatcagctctagatataaatttactcggttttctctctctttgcctgcccttgtacttacatatcactggcaatggaggagttccgggacatagactttggagagaggtcataatcgctgtcggatcgatacaggaaggactcccgtcgttgactgtggacaaaatttgcttggagaattagcccggatcctgggctggtcatgggatccaagggactccgtcccgcagatgtgccattgtccacatcaaaactgtaaaggaaggagaaggaattatgttgctgtgaacattcacatgttcatattttcaaaaagcatttagcgtcagctgaggaactgacagtggaattagcaggaatgaaaattacagctaatttctgccataaaaatatgataatattgaaatacataaaagaaaaacacattgacttcacattcttgttctcctggatactgttgttaactgaccagatacaagatacaggtttttccaaactctacttcagttaaaagggaaacactctgcaaaacataatcttctaagtacaaaattcctttcggaaaataacaaatacacagtaattcatcaaatatttgaattcgattcaacaaatacccattttgtgcctaatgctgttctcccaaacctgggcttctccctccacactcctaccctataacatccatccaagcattaatttctattgtacccacttccttccatccctactaccaatattttaaattcaggtctccatcaaatttcacctatattattataacaacctttatattagtgtcttgaatccattttccagtgtcattcttcagtttaaaacccttcagtaacttaccattgctctcaggatgaagtcaaaatttctttgccagactgccagtctaaccatctgctctcaattgcaattagttgcccccagcctcaacttgccatcctcagctattgggtacttcttgctcaactcatattgaggcactatctccttctcacaggccatcaccacctcacctcctgctcccctaaataatcaaatcccctttcccctgcctaactgtcactcatccttgagacttagcctgcacctgaaaggctaccctggtacatcagagctttatgaaaggccctttctctacgctcccaagacactttcccactccctaatgacagaatttacaatgaattgaaaatgtttttcacccggtctccattcctagattgtgagctctctacaaatggagactcagcgtattcttggcacattgaaaactgtgcccaagtgtcttgagtaaatgattaaatgaataaaaggcactgtgctcagcaatacatattttagagctgggaaaaaatctacacacacagttcttaacgtcatagtccttataatctagataaactttccacaaagaacctttctagtgaaacatcaaccagtattaaaataaagtcaactttcatgtgttcttaggagaggagggtgatagcttatgatagcccagcaggtgtgtggttttaaagaaaaacttgttgaaagaataaataaacatgtgaattcaagttttgctgtcattaatattttccccattagaatctttattcaaactattaactagctcattttaaaacattcctttattttctttatcggagtcattaataaatagagttatgactctaagattggaagatgtttcatggatcacttttgaatctgtgatcaaataacagtggctccgaaataatccatcaaataaacagaagagggaaaactcattatcttgagcagctgtaaatatgtttttccaacttaaaattttcttagaattgtgtctctttatagatatatttatttggttcaggaaggacaatgagagattgtcaagtcgaacagactcactttacagacgaggataccaggtcctagaaaagttaattgaccagtcactgagctaactgcattgaatcatcgattgttcctaaagtccttccagctctactgcatgattatataaaccacaaatatatgtggcacccaaacaggggacatctgtttcaccagaataggataggcacatatgtatgtgaaaccttgtcaattcccaggaaggctggaaggggaggatggtctctaatcattcaatagacatacattagggatctttggcaaactctccttggatatgcttaaataggcatttattaagcacttaatatgagtgcattaagatacaaaaataaaggatgaatgactaactcaggctgggatatctgagaagttttcatgaagagtagtatttaagaaggtttttgaaggtatttagtacacaactggaagacattaaaaacttctaaatagtgggggtttggcaaagtagatttctcttctaagaagatagtcatggcagcttttcagcatgaggaggacctagtaatgtgaatgcctgtagaaatgtttatgtttatttccctttaatatcaagatattcttattgctacactttaaaaaagaaaataccccctccttcctgtgcatgaacagaaatgtaagagatacagaagtgtgagttttggtttagtttttttcagttcaactgagtaaacaccaaatttgtataaatcagtaattttttctttaattataatttttccaattaaatcaagcaagtcttaacactccactataagttttgaaacaaatattgctaaataccttaagtcatttagatagttatgatatttttaaatcttacaacttttaagccataatattagcactaaaaccaaaacatttattaataggtcaggaagtgcttgatatgagatattctaggggctttaatatttttctttgtatactgtaatataaaaatttgtccactagatggagatcattttcttaaacaaggaaactattttctactgaagggttaaataaccttaaaggcctaaattatttcttaggaactcatgaaaataaccctttaaatgacatccaaaaaacaaagttcacaatgtatactaagtaattatcaatattgataaaattacattaatctaatattagtattagctttacaaacattgagaatgaagatctaaaaatagtgactgatattttattggactttttcttaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagttagtgggtgcagtgcaccagcatggcacatgtatacatatgtatctaacctgcacaatgtgcacatgtaccctaaaacttaaagtataattaaaaaaaaaaaagaaaagaaaaaaaatacttgagaagacttaattgaatttccgtaacaaatcactgagtacttattgtgttggagtaaagtaacttgagcatcattaatagtctggggtttcactctaaattttggcaccacaagtattctcagaatacggtttgttctgggaagtgaacctagggtctgagttcatttgcataatttatttccatgatattaaatcctcttataatcaaaattaattatcaagaaaaagtaatattaccgagaatctccagtctgaagtatcagccaatgtcagtattagtgaatgactttatacaaagagagactttgtattttgaaatagtcattgaataaacttttacattacatcctatgtccttagatcagcacttgaataagtacagatatactacacattgtccttttctagaaagcactaaagtctagttaaggtaatagaacatcaagcaaccagagaaaataaaagcagcaaaacaggtggcatctgtattaaatagcatataaatactaaaacacgaaattgtattatataggcaatcagactatgtgatgtagacaatgaatgtaaagggaatttaagaagttgcaggatgtacacctttgaaggagagttaaaaaatgtccagccagagtagagctggggttgggggtggaggccatccagcaaaagtgaagccacaaaaacaaaaccaagaaggaatgaataaggcgtgtatataaaacaggacatttagtgtctggctaaatttgaggcttggtattaaagaatagtggggacctataaaaatggcaattttgtacagttcaacctaataggtagggatggatgtgtttatggaaagctgggccaaggagtgtcagcagaagcttgttataaagacttacgtggaaacacacaaatcaacttttaacattgaaatctcaggggagtaagatgaggaagaccagtatttgttaaaataaacatgttgcttttgcaacaaataaaaggtagaaaacagagtagaggctgagcacagtagctcatgcctgtaatcccgacactttagaggcacacgtgggaggatcgcttcagaccaggagttcaaggttacagtgactgatcgtgtcactgcactccaatctaggcgacagagcatgactctgtctcaaaaaaaaaaaaaaaaaaaaaaaaagaaagacaaaaaacagagttaaaaaaaaaaaggagaaaaataaatgttttaactacaagaggacccccaaaaaggcttgttcattaaatacttcaaatattagaactagggggtttgccttgagtagggaggttagttgtggattttaaaaggcagcacatttttactcagtaggtagtaagttaactgagaattagacacttacttaactttctgaaagttagcctaattagtcagtttgggctgaaattatagatggcttcaaataagctagttatctttgaaacataattttatcaatagtccacatcgtggtgttatgaataaaacaagaaggtgatgaaggataaggtagccctaaccttagatgctggtatcaaaatgatcagttgtgaattttccaaagacattctttagaaaacacttggatgtggtgaattctcttttgactcacagccaattagatggagcccaagcaaaaaactagaagtttgaaaaagtaactaaaggattggggagagtaaaaattaccaagtttaatgatgatggtggcaataataataatgttaataacaataaaacttctggagcactttccatgttccaggcgctgtgctttgcatatattatctcatttaatcctcacaataacactttgaagtaggcactgtattttccattcgaccatggggactctgaggcatagacaagtgactctatgttcagtagtatgctcaagctcataagtgggttttaaactcaagctgtctgattctaaggctggggagaatggactctgtttacacctctattatgaagtttcatttaaaaaaatacaagaataccttttagcttcctcacctgcagggaacttttgaaagtaacattctgattaacttacaggtgacgcatgcaaaggctaattctgagactaaattttcgtatggggctgggtgtggtggctcatgcctataatcccagcactttaggaagccaaggctggtgaactgcttgagcccaggagttcagggccagcctgggcaacatggtgaaacaccatctttacaaaaaattttaaaattacctgggtgtggtggtgcttatctgtagtcccagctaccccagaggtggaggcaggaggatcacctgaactaaggaggtcgaggctgaagtgagccatgattacgtcactgcactccagcttgggcgacagagcgagactctgtctcaaaaaaaaaagttttcatatgacccaacattttggaatttgccaaatccccagctttttccaattctgaacataacagtagggtgtaaaaaagtctttgctgtaacccatttggcgggtttctttatagcatttgagatttcatttggaattaaggaagggtcagtgggtctgcaaaagggcttagcaaatggaactaagtgaggtgctttcttgttccatatgtttgcttcccttaatgcaatttaagaatgcacacaattcttaaaagagataacttttgccagaaggcagttttggaggaggaatgatatagctatatttggtctcccatgagggggcagtaacagtaatgaccagctggcctgctgcattcagaagtgttaaagaatgtgtgtggctagcactactcatgaccatttactccacagacccatccttttctatggaaccagccccctacaagaaacaaagagaagtcggacaaactgacgaatgaactaattactcccagttctccacactgttccatttcagtggaattactggatggtaatacagttccaatctacctttcatccacgctctcaactgctcgcatactttgtgtctactgaccttgtaattgtttgtctgctgaaggtcatttctcatctttttggccttttgctagacactgcttccctagtttaaacttttcccaatttatttttgaccatgatatgggccctctcctgagccagagtcctgctactgtgctgagtaaatagctttcctcatctatcctagccatcaggaccttatacttagcactgacccccagtatgaagcccaaagtgggtggggcaatgagggcctcagtggagcagctgctaaggaacctctatcaatagcagcctccattaccgaagcatctatgaaggccactcacagggaagatcttgctgaatgtcgctgggaatcctgggagccatcactgaagccaggaccatctgaaagctgcctttttcactacatagtaagaacaatggcacatagaaaatattgacctaccaaaaatgttcctgttaagatgtttatttaagagttagaaaacacaggttaaatttgaaatcttggttcagccacttcctatttgggtgctctagggcaagttgctgtattttctaggctttcactgctgataaagataattacaatacctagctctagggccattataaggattagaagagaaaatgtttggaaagcattcaccacattgcctggcagctagtacactcccattatttagcagctattgtttttcatttttattactctttttctcccagggagatcttcatctaggtcattctctttaactttatttgaacacatggctttgggaagaacctaaagggagagatgaaagaggaagagaactgagggccaaatcacctgaatcagcccttgcaatcaatgaggtgacagatgctggagccagattgctctaaaagtttcagctgcttttatgtctccacccaactccataattccagtgtgataacatctggggagggtggagactgctgatttttttctagatattactcactgaggagaaagaataatttcctaccaggaagtgtggaaggcttggaggtcccaacaacctaggtggggctccagctgaatataatgagcagaaacagtccttcagacctcaggtctccagacacagggtgtagcttggggacctcaggtcacaattatactgatgtttatattcctgtactccactctcccctgtgtattgtagctcatgctgttagccaacacattggaactcattttgatgctttgccctcaaggggaggggaggcttacccttgagcttaaggggagagtaactgtaactggatgactacatacatttttccctctttataatactaaatattttacccattgttatcaatatcacaaggttatgaagctcgtttctaatcaatgccactgatacttctctattgaaaatttccctgcaggtcaaatagcttctctgaagtaaacaaaataatgatttgcaaaattcaccattttaatatttacttttctctgattatctatggagatgagactgtagaaactagcattttacagtgatatgcacagatggcaatctttcccaatcaatcataaaactgcatattaaatttaagtaggatacccggagaaggcatgatatttagctactttacaagattacacagctaaattatactacacatgttagcttgtataatatatatatttgcacagagttaagatatttaacagacacgttttaccctttgttttcacagatgatttttataaacaaaagcccagggctgggcatggtggctcacacttgtaatcccagaactttgggaggctaaggggagtggattgcttgagctcaggagttcaagaccagcctgggcaacatgatgaaaccctgtttctacaaaaaaaaaaaaaaaaaaaaaaaaaagtcaggcacgatgatggcacaagcctgtggtgctgaggcaggagaatcacttgagcccaggaggctgaggcttcagtgagtctaaatcatgccactgcgctccagtctgggtaacacagtgagatcctgtcatacacacacacatacacacacacacacacacacacacacacacacacactggtacaaagatgaagggtatatgcttacttatgagtaaaacattaggtggtactggaaatatacaacatatgtttctggcttgtcagtgacactcccaagtaacacagggcaataaagagattcaagatggaaatgatagcatgagtttgatgtctggactataaatgaaagaggataagctggacttgcttagcacacttttgacacaatgatatgataaaaggccaatttttctgaaaagtatttattaggccagtgttatggactgaatcttgtttcccctataattcatatgttgaagccttaatcaccaatggttacatgaggttgaggttgaggttaaatctatcttgtttcccctagaattcatatgttaaacgaggccatatggatgaggccctaatccaatagtgctggtgttcttataagaacagagagagacacaagagcattctctcttcaccatgtgaggacagagtgagaaagcagccatctgtatgtaggaagagagccctcaacaggaaccaaatcagccaatcttggtcttggacttctcagcatccagaattgtgagaacatttctgtttaggccaccagtctagggtactttgttatgcggcctgagttgactaaggcaaccagaaagccccaaccaaaaattgttttacttgaagtttatacattactttttaatgactgttaagaaaaattttcttaactgaaactctctctaagaaagcatctcaaattattgccaagaccaatgccatgaaattttccccctaaattttcttctaggtttacagcttcaggtgttataattaagtcttgagtggattttttgtgtatgatttaagataaaggtttagtttcattcttttgcatgtgaatatctagtttccccaataccattttccaataccattcaagacttttcttcattgtatattctggacatccttgtcaaagatcagttgactgtgtatgtgtgagtttatttcttggctctattctgttctattggttttatgtctgtctttatgccagtaccacattgttttgattactgtcacttagtaatatgttttgaaatcaggaagtgtgagatctccagatattttgttctttttcaagattgttttgactattcagccttttgtggtttcttatgaagactgcttttctatttctataaaaaataccattgggattttgatggagattacattggacattgtggacattttaacaatattaagtttcctaatccacagcagcatcaaagcataagcaaaaaaagcaaaaataggcaagtgggactacatcaaaataaaatgtttctgcacagcaagggagaaaacacagtgaaaatacaacctacagattaggagaaaacatttgcaaaccatatatctgatatggtattaatatctacaatacataggagctcctacaactcaatagcaaaacccccccaaaacccaattgaaacccctcaaaattaaaaaaacccaatgaaagaaatggacgtttctccaaagaagacaaaaaatggcaaacagggatatgaaaagatgctcaacctcactaatcattaaggaaatgcaaaggaaaaccacaatgagatattgcttcactcctgttaggatggccattattaaaaaaaaaaacctgttggcaaggacatacagaaattggaatccttatgtactgatggtgggactgtaaagtgatgccactactataaaaaacagtatggaagttcctcaaaaaattaaaaacagaactaccatatgatctaccaattcaacttctgggtatttatccaaaaaattgagatcagcatgtcaaagagatatttatattcccatattcatttatgtatattcacaataccaagatgtggaaacaatctaaatatccatcaatgaacgaatggattaaaaaatgtggtatatacatacaatggaatattatttagccttaaaagaaggatatcctgtcatatgctacaacatggatgaattttgaggacattatgccaagtgaaataagtcagtcacagaaagataaatattgcatgatccctcttatatgagggatttaaagtagttgaactcatagaagcaggaagtagcatggtggttgctgggcctgggtggagggagaaatggagagttgttgttcaatgtgtatcatttaatcatgcaagatgaataaattctagagatatgctgtacaacattgtgctaacagctaataataatgtactatacacttaaaatgtaagagggtagatctcatattatgtgtctttgtttttagcacaataaagcaactttttcaaaaaggatctcaaatggccctaacatgaggccatggtatttggactcttgaggcaaagcctgcagtagcagtatgaggtccatatttgcagtaattacctagaaatcatgagaacttcaagtagtaaacatatacattcaatcagaatacgtgctgacaatgggaagcggaaagtgtctttttttttggtagtcattgggaggccttaatttctctggcaatttcatgcaggtgtcactgtgattgagaataaaacaagtagagatttatttcttcccttacatcctattatcatgtgctgaccactaactaagagtatggagggaagagcagaaaagcacatgctctccaggccaggctggacctgagagtcagctgtagtcccacaggaataactcagttttattttccttgtactgctcacagcaggttactaccaatctttcactttctaagatcacttctaagatgctatatttccaaaatgcactctttctcaaaatgtggcttcatcaagctaaagtccaaagaggaatagcgtcttgttaacaaagtggggctcaagatggattaaagacctaaatgtaaaagctaaaggtataaaaaccctggaagataaccaaataaataccactttgaacataggaactggcaaagatttcatgataaaaatgccaaaagcaattgcaacaaaagcaaaaattgacaaatggaacttaattaaactaaagagcttctgcacaggaaaaaaaaacacaactattaacagagagtaaacagataacctacagaatgggagaaaatgtttgtaaattgtattacctgacaaaagtctaatacccagaatctacaacgaaattaaacgaacattcaagcaaaaaccaaaccgccccattaaaaagtgggcaaaggacatgaacatttttcaaaagaaggcatacatatggccaataagtgtatgaaaaaatgctcaatatcactaatcattaaagaaatacaaatcaaaaccacagtgagataccatttcataccagtcagaatggctattactaaaaagtcaaaaaataacagatgctggcaaggttgcagagaaaaggaaacgcttatatactactggttagaatgtaaattattaatagttcaaccattgtggaaagcagtgtggtgattcctgaaagaactaaaaacagaactaccattcaactcagcaatcaaactacagggtatataccaaaaggaatataaatcattctaccataaagatacgtgcatgcatgtgttaattacagccctattcacaatcacaaagacatggaatcaaactaaatgtccatgaatgatagattggataaagaaaaatctggtacatatataccatggaaaactatgcagccataaaaaggaatgagatcatgttctttgtaggaacatggatggagctacaggctattatttttagcaaactaatgcaggaaaagaaaaccaaatactgcatgttttcacttataagtggtaaccaaataatgagaacacacagacagaaagagaggaacaatagacactggggccaacttgaggatggagggtgggaggagagaagaggatcagaaaaaaaatactaactgtcaggtactatgcttagcacctgggtgacaaaataatatgtataccaaacccccggggtcacaagtttacctatataacaaacctgcacatgtaaccctaaacctaaaataaaagttaaaatattaacaacaacaacaaaaaaaaaaaacaagcaagcaaagaaaaatacccaaggtagtgttgcggggtgtttctgtctttatttattgtttctatgacatagagcaagtaaaattgatttaataagccgactttgaaacattgatattttaatgatgtgccctgctacttctccagccacccacccacatttattctttatattgcagacagagcgatcctcctaaaatgtaagcccattctcggcaagttcctactcattatcccataatggtgtcctattttattcagagaaaatactacgttctcccaatggtttaaggccctcagtgacctggtccctggtgcctctctaatctcatctttacctacatctctccctcttgttcactctgctcagcctcttggtccctagctgtccttgaagcactgtgcatactccctccccagggcctttggatttgcagttctctttgcctggcatattctttctagagatatcagctcaatgttaccttcatgagatattcccatactggcctatttaaaactggcacccctaacctcctaaccttttttttttttgaacaaacaaacaaaaaaccttccttactcttaatttttctccatcgcatttaacagcttctgatgaactttgttttttacttattttatcatcttactcaccccattagaatataagctccacaagtgcagagatttttttttaaaaatctactttgttcgttaatgtgtcccccagcaggtacaacagtgcctcacacgtacgagttgctcaataaatatttgtatcgtgaatacatgggtatctttagacgcagcggtactttttctataccggttatcatttaccatggttatctgtgtagttctactttaaataaacttcataactattttttaatttagctaggagttggtcacttatttaaagaaataggttaatgagattgattagcacatttgaagaaataatctggaacatctctaagaaggcattttaacgggggttattttgaatatccttctgtttgaacagcagtcagccatgcaatcaggggtgggatcaaggttttgtggtacacgaagattatacaattataagggtctgctttcagaaaaataatacaaaaaaatcttagttttttgaattttacaaaacctaaaactacgtgcagctgctagtaccacttcttacaacttgaaagggaaccaggccagtgagaagctcttagcttgatcttcattagtttcacctcagatctgcatctgaggtaattacatatcaggaaagaataagaaaagaaactggatgggtgaaaataaaaatttagcaccttatatcattacttaattaattatgtgttttctgagatggagttttgctcttgttgtgcaggctggagtgcaatggtgcgatctcggctcactgcaacctccgcctcccgcgttcaagtgattctcctgcctcaggcccccgagtagctgggattacaggcaggcgccaccatgcctggctaattttgtatttggggtttctccatgttggtcaggctggtctcgaactcccgacctcaggcgatccgcctgcctcggcctcccaaagtgctgggattataggcgtgagccaccgtacccagctgcaccttctattttcttaagagataaattgttattagttttttcttcattcctttttattctttccctccctccctatcacctccctctctccctccctctctattttcagtacccaaattttcaaagcttactcataattctcaaaatttctcttgttagttgcacgtgtttatttttcccagatcagtgagtgtcacctagtcctggggaatggggagtgattccattaggtcagatattgaactcactttgaagaggggtgatcttcaaaccatacctgtctctcaagatattacaattttctttttgagggatgggttttaaaaatgtgatcctcaatcacattcctggctatttgggtatttaggcttactaaaaattaatctccaaaagattttattgactaaataagaatgattgaatgataaatcctttgtagaaatacttagccttaaaatattatgtgttaagtatgttaaataagtctaggtaagattataacagaaaacaaaaaagtaatagttctactataattgcctttaaaatataaccgaattctgattcttttagactaatggatacgaaaactcatataccatgtttttcctctgggtttgcactctgcatcaaacaggtcaggaaaccattcaccagccctactattaaatctattttggagaagtgatattattcagtttccaacctcaacaatccaaacagatgggttttctgccttaatggggcttgaatgaatggcgaagggcttcagagggttgtgtggcctgaattacagacaattttttcaatcttactgggcaaagcaatgataagaatattatcttacgatggccataaacaatcacttgcctcttcaattcttttaaaatatatagtggagaataaaaaaagatatgtctcattatgtgtctcattgtataataagtacactgagattagctttctctcatgatttcttatattgggtgaattatgtatggttacaaattatcttttaaaagttttaagatgttggatgggctaccacagaggtagcaggatctacttcaacaatgattttatagagtgaagaaacattttcatgtttccttgaaatggaatctggctgaagacaaaatgaccttgggaaagcatagaagtcaataatcaggactgtgagtataggaaattctgcttgttgtctgccatattccattctctgcctgttcctgggcataaaagaagttctcgttcccttgcaattagatttggccaagtgactagatgtgagcagaaatattgcatgccactttcaggactggctcatagctcctcccacatgcctatcttgatgttctttttctgccagctggatgctaaagatgctgatgcgtgaaggatggtagaaacagaaggtgggagaatcctggtccgtgactgagagcaaggagagctgccacatcctcctaaacaccatcctagaacgctacttgatgaagaatgagtttattttttaagtcatttaatttgggggcttatttgtcagcacaataacattcaacacagtgcgttccatcaaagtaaactggaaagtacgtactgaaagtacattagactttcaaatgtctcacattcaatctatctctggcccaagtgaaaccatctatgtctttacttctaccaccttcacacttcatttaggttttttgttttgttcccttgatcttcctcggttaacagatattttcattatgacatttctcattacctaagtgcttaagagatgttagagaataagtctataatcattacacacagttgtgattgttgtgtaaagtgaaagccagtctggttctgttctgtcttaacaacaatcagcaaagttacagaggatcagctcaagtgtgaacctgacacatgaatttgtctctggattacagaagacacacagaaccgagattaacaaacactcaggatttacacccgtgcttcacttgagccaatgagatttcagaagtaccagatcgaaataggcttcccttaagacgtcaaagcattgcaacaaaaacaaaaacaggcaaatgggactatattaaaaccaaaaatctctacatagcaaagaaaataatcaacagagtgaaaagacaacatgttaaatgggagaaaatatttgcaaaatatatatctgacaacggactaatatccagaatatgccaagaactcaagttaacagcaaaaacaaaaccaaaccaaacccaaataatcccatcaaaaagtggacaaaggacatgaagacatttctcaaaagaagatgtaaaatgaccaacaggtatgtaaaaagtactcaacattactaatcatcagggaactataaatcaaaaccacagtgaggtatcttaccttagaatggctattattaaaagaccaaaaaaaaaaaaaatagatgctggtgaggaagtggagaaaagggaattcttagttggtgggaatataaattaatatggccattatggaaaacagcatagagatttcccagaaaactaaaagtagaactattatacaatccagcaatccccctactgggtgtttatctaaaggaaaggaaaggaaatctgtatatcaaagggatacctgaacccctatgtttattgcagtactatctacaatagctaagatatggaatcaaccaaagtatccaccaacaaacaaaccgatagagaaaatacatatatatatatatatacacacacacatacacatacaatggaatactatgcagtcataaaaagagcaaaatcctgccatttgcagcaacatgaattgacctgaatgttaagtgaaataagccaggcatagaaacacaaatatggcatgttctcactcataagtgggtgctaaaaaaagttgatatcatgaaggtaatagaatgatagctaccaggaggaggggaatgaagagaggttggctaacgtatgcaaacatacagctggatagaagaaataagttacaatgtgtgatagcagaatagggagattatagttaagaataatgtatcatatatttcaaaatagccagaagaaagaaattgaaattattccactacatagaaatgataaatgcccaaggtgctggataccctaaataatttgtctcggtcattatacatcctatttatgtaacaaaatatcccattatcctatgtacaaatattgtgaattaattattttaaaattctgttaaaaaacaaaaattaggcttgccttattcaaaatgttattctgaagcaaaatgacattttgaatgtgcacacttctggggaaatggttcagagtctatagaaaaattctagaaatatttcacaatttatccaaacccagactagaaccactcttcactgttgcctagctcatttgcagtgggatcaggatgagttggttcagactggcaatgtcgtaggttgaatcagatgcctaagaccattcctgttctgaactcataggctaaatgcctttctagagccaaatgttcctctctagaagaaggaaaggatattacctggggcatcctcttgccagtatagcactctcctcaaatttgagccctctttctctgagtttcagtgtatttctggtgtaagaaatatttcattgccaccttagagatcaaactcaaaggattaatagatcctgagggtgatagagtaggtcatagaaaagagatacctatccattccacaaatgctcatcaactacctactctagccactctgggaggaataatgaagctcattgagaagacgtaaggatggtagtagttacactgatcttctgctccaaaattaatttggggttttccttcccctcaggatgaccaaattcatggtgaggctattcataaatcctgttgacttgccaggtccacagccaagataaatgcacagctgttttctaaaggcatttgacctcttctctaatcacctcaagttgagaagcaatgttcattgctgactttctttgttttgacattaactatgttctcaaataaaaaatcaagttttacttctccagccattaaaatttctctcatttttatgaagtaatatttctcaaacatttgaatatattcatccatttttgtgccacttcatctattttctagatagattatgatattcaattatgtgtattttgtctttcttttttctttttttgtagaatttattcgatataatcttggctcccattttatttcccacttatcctcttttaaaaaatgacttatgcttttttaatgaggagtccaaaatggcacacagaactctaagtacagtgtaaacaaggccatctgtaatgagaaagccattcaattcagcaaagatttttctaaccagctatacatagtcatgacagaatcctcagatttagtgtttcctagtagcaattgtaattcttttgattgctggcctgtaaaatacttagtactatactgtaccatgacagtggaaatatgtaaatagaacctccatctccagcctgcttatataaaatgaataccactggtaaataatttaatgttaaatgtagttacttttacagaaaaatatatgctgtaaaataacttctactcttttttcatacattcagatagcctaaaaaaaggatagatgtcagttttttaaacttgggggaaaaaagaacccaaacatgattatatactttgctgacctttgaaatttaatttgaccaaattttgaaaatagtctttgagaattacagagtgagcaaatgccagtacttcatgaaactcaaatcgagtttttttttaaataagcagtgtaggtatcgtctttgctttttccatgtctttaagacttttaaaaatcttaaaatatgactgtttcaccactctttttctttttttatagaattcagaacttaagttaaatttgacaagaggaaaaataaaatccaaaccacatctatgcttattctgctcttggcttcttcctacagagctgtcctttaaatttgcaatgtaattatgagtttccataccacatatgccactaatcccacgaaagtatgtggcccttcagaccacatgaaaaaaatctctcagggcaccttgggtgctttacccacttgccatgtccaaaaagagttccatctgtgcccctgatggtcagataacctgtcctgggtgagacaaaagaattattcccaaaggccttttcctcctgtgcttcttatgccctcacaagcaggttgtttctgagcaccttcacaggcattgttcagtggaattcacacagtgaccctgggcaataagtgatgggattgggagtgtagatttttatccttatttgctgaagaaaaatctgaggctcaggaaggagggcaatgatgtgcctagagtctcatagatttaaatggctggattacgactcaatcccaaatcttctgttctttggactaaagatttaaatgaaggattgaacaattggattacttttaatccttcataaagcttgaatgaaagacaaatgcttattttaatgtctcttatgagcactcactagaaatattctctagccgagcacaatgttcaaaacctttgtgtggaatgttacattttgctgaaatgaatggatgtgcttacatgtctgtaaatagtagaatgaaaaagctggaaaaggattttagcaagagtccttcattttggtactcttgttaatcatcctaacaatattgtaatgctttatagtgtatggtaaatgtttgttaatacttagagggagatacagaaaacaactatctggttaaatttacttaaacatatcagaccagctttgcaaaacaaagggattcccacttgatattctgaagaatatttcagaaaaatatgaatgtatttcttttgtattatttattgatttttaaattttagatccaggggtccatgcacagttttgttacatggctatattgcaggaagctgaggtttgggcttctaattatcttgtcacccaagtagagaacataggacctgatagctattttttgacccttgccaccctctcttcctccctgcttttgcaatccactgttgatgggcaggaatgtatttataacgcaaagataagaactgatgctgggcaatactactgggttgagaattgggagccttgagtttgagttctgaccccgctactacctcgttgtgattttggcaagcctcttgacttctctgggacttagctatttcatcaatgaagtaaagagattgtccttttcaattactgctacatatcactttggagaggcttttaaaaatacagattcttaggcctccttttggatactctgagtcggtaaagctgaagctggatccaggaatctctattttcaaaaggctgtcatagctatttgatgtgttgtcaggttgagaacaccggacttgctgaccttctagctttaacattcccaattccaactggacagcactgaactcagctcatattcctctatgctgtgcttactcgggagcgggagtggtgagaagagccaaagctgtcgtcaccaggctatattacaccaccttccttggtggtgtccctgcccacatgcccagctcttcaacaccactttctacgctgctgttgggattttgtgtgtggttaaacgggatggagaaagaagggaaaaaaggagagagggagagaaggaaggaaggaaagaaaggcaggaagaaaggaagaaggaatgaaggaagaaaaggaaggaaaaagagatagcttgcagtggctagaaaatgtaattattttacttccttgaataactacttttgcctataaaagtggattctttatcacggcacttaggttactttaaaatcttgtcctaattcccttcaaatcttgtctctagcccctccaaagatacttctggtcatactgttctcactctctggagtatgtgttacagataatgaagttttagacccaaccaatttctgcctcatgaaatcattctcacttttcaaagctcaacatgtagtaagaaatgtgtaatatgacctccagttcttccttccacaattccaaacatcttattcacactgtcaataaagcattatctcagggttaaaataataaagcaactggctttaaacacatttctccccttatcaactaccccttcccagctatttgaggttgggggtctccataccatttactttaatcatcataaaattaacattcatgttttgcttgaccatttgccaatttctttacatccattattttatttgcatttcataacatttctgttaaataaattttttgtcaacccattttattgataatgaaactgcaaacagggaggtttactggtttgctggttaatgatgaagctgagatatgaacctagatgctgtgatttcaaatcttatgattttcctgcactgatttacaagacatcgacaggtgctcagcaaatgcatattaagtgattaatattaagtgaatgaataactggtgagaaaaggcctcatggtctcaaataatggtctctggtctatgcttgcatcttgaatctgcttcttgctatctgaacaatgtcagacaatatatctaatctgtctgagcttccctttccttctttatcacatggggaaatcatactgccctcatataggtgtgtgtgtgtgtgtgtgtgtgtgtgtgtgtgtgtgtgaactcagtgatatgaaatgtgtaacgtgtcctcaccagtgtgtgcacagagtaagtcctcattatatgtttgcttcttaattttgtgggaggcagtcattttgttattcattgcatctgaattttatgcataagcctacctgtggaggttacatttattcctgagattttaatcctctctcatcttcagtgagaaacagtaagagagacactatatgatgatagttaagaacacagggtctaggcagccctgagttcaaaacctgattctctgcctttgtagccttgtgagtttggccaagttactcactctctccatgcctcagtctcttcttccataacatggagaacatgccatttagaattatgcctggtgtgtgataagtgccatgtatttggggctattacttatgttatgggggcacaaaactaataataggcatggttagcacaataatgagatatttgtcctttgtgtttctcaaccaaaattgatgactcttgtaatataggatcaacagtaaactgggaccttgtcatttgcatttggaatagtaggtaacagtaattagatgagcatttgaagaatacatgagaactcacatataggaaaacaaagtaggagtgtgcattttgtatttaaacataatgaagcatcagctcttatgtatttatgaatggagaaggaaaaaaggtcattcgacttttgttgagcaccgtggattactatctttgatgctgtcatttgaaataacaaaaactgcctctgcctttccccagccctactattgaacagaaagaactggaaggagaaagagtgccatcttttagaaatggttcctctgagtcatagttatcccttttgagtaccacatcaaaggctctatttcacctgagaaatctcatacgcatttcaaaagtcaaactgtaataacaaaacctacactacctataatgtcaaaacatcaagcaagatgtaacaatctctctcatatcctagtctcatacatattggtgtgagttaaggacaaaggtacttttgactttaagacagtaagaaatgtgaggtcagtgtccttgggaataactagaaaccagagatatttattgcctagagacaacgttaagatgatctcagaaaggttttctttggaatggtggagattaagtggcaaggccaggtattcttgttaccaaaataaatactgcttaagcaacagcaaacatgggagagggatgacagaagaagggtttctctatccctttgctggagctaaagtaaaacaggcaaatgattttgaaggctcagcatttaaatctaccatatagggtttaactattggtgctgtactgctgtctgttgatagaactatgccttctcctgaagcttcaaactttagttgatatctcaggtagaaagtgtgttcttcaacatctttcatagctttggcaacactgatcacgttgctgaaatgcctcctcaccggagatcttaccacctgtgaaattctcctcaaccctgctctctgcctctgaattcctggacagaattagagctgatatacaagaactcccaaaggcaagcctgcccagacagtttttaggttggtagttcactgtccaggggacccagctgccactattctacaggcctttttccaagggtaacacaataatcacaatagataataacaacagagaatgtactatttttagcatttcatatccattgtctcatttgatttttattactatgccggataaagcaatggtgctaagagaagtaacttgcctgaaatttgtatttttatccattataattcgttgcctctctaggatccaatggccccttagtaaaaaatactgatgctttaactctaggttcccaaatgccatttagctccccaagcatcgtactgtggcaaaaactacatgcactttgaaatcagatctgaatttgaataggttctgttacttgccagctaggggaccttaagcaaagcttcttaccctctctgagcctgcaacactcaaaaaggattacaaagcactcacatattaaaatgagttaatgaatgtgaaagcacctagaacagagttttgaaaatagtacatgctccgtaaatatgaaattcctttttcttctttcccctttgaatacatgggagtttcctatacaatgctttggtattttaataagatggtcttaattttactcattgcatgcatcttgaggccagtgaagcactaacgcaattatctctgtcaagccttccagttattaaaactaacagccatgacacaaccttctcagttcaggcagcccacctatatttttaatgggagtattggtatatttacagtctccatcagaacaaagttctgttattattttgactctaggaccattattttatgtgacagtgactttgtcagaggagagaaaggatgtgactttaaccctggtttttaaaaaagagcaattttcctattataaactagttaaaaactcttgttgaatagcatattgcaattgatgtttggggtaatatgccagttttagcaagaaataacacgaaatagaatgctccaaatttattatttatttgcacctgtgctcacccacttattttccttcagccttcatagttcttcagatatttgatgagtggtgtaggtgatgaatgaatggcacatgtctgtaaaacactaagctcagctcaagacctgcagatcttcctagtgaactaaccaagtggttcagttgataacacaagtatagtatcccaataggtttagaccctgctctggactctggagaacattgtatctgtttatgtcattctaaaacatagccaccctgttgcaaagagtttcaaattttggagaccagagacccctttgagaacgacatgacttataaatctttggaaatgtgagtcttcggaaaaattcacaaacacacacacacacacacacacacacacatcccttttggatgtaattccataaagttcagtatagcctagtgattaagctaagggctttggagttagataacctggcctaaaataatgaccctactgctatttagttttgtgaccttcttcaagtcatttagtctctttaaatttcattttaaaaatgggaatgaaaacagtacctatgtgatgagtctttatgagatttaaaggagataaagcatgtgaagtgctcagcacactgtatgacacttactaaatgctttgtacatttttgttattttaagggagttacagatctccaaagcttatttgtgggcagcagattaagaatttctgctatgaaaagaggacaaagttcaaaccaattaaggaccatctgcctaccataaaaacaagatcctattgaagttaaataactatcaataaaagggcattcaacaactaggtctgctaccctgcctggccctgagcaagtaggacaatgggtccagccatgtccctgttctttctgaggagtggcaactgtgcctcctactgcacccgcctgtaccagccatggctgagaacttggcagtcatggatgctctctacacttgactgaaaaagaaaacagcttcttggctgtctgagccttaaaaggtgattgtcctattcctgacatattctttacaaagttctaggtgtaagaaaaggctgtttcaggttttaatgagagaatatttgttagagagaatatttgttaagcgcccagcttaaggacacacacaaaactatcaacaaatgccatctctttccaaaggtcaagagagagggtaactttacttgacgaagtcacagctctgggagaaattccactgacactcaggggactaagttatgtagtttaactaaatttgacttgaaataagtaggcatttaagagggcttttctctggggattttacacatattttgctgatgttgtattttaaggtatcctattttggtcaaagtagattctttagccaaatcagtacattttgaaatgactaaaatatctagcagccagcaagttcagatacactgatctttaggaggaaatagccacaaattgaatagtacttaaagaattctgtatcattttgctttgtttcagaaagattatcacagggaaaagcttagttaagtgactttaatattaatatattcatttctgtatttccaatatctagcataattctcacaccaggtataggaaagtgataactatttattgaatgaattttctatatatgtatgtcaatatccatttttaagaactccatggtcaggcatggtggcccacacatgtagtcccagctactcaagaagctgacattggaggatcacttgagcccaggagtttgagtctgtagtgtgctatgatcagacctatgaataaactaggtgaggggaaatttactgtgcaaatacctgctatggctgatacaaggtgcagattatagctctatggtggcctggagaacctcacacttcttaatgggttctctaagcaggtgaccaggagaatcactattctatttttgataaagtttcactgatcttttttcaactagtcttaccaaattctctgagcaacacctgctgcatttgatctcaactcaatttcaactccactggggtgcatgggtgggaacaagagaaaaataagggaaatatttaagtaaatgaaatttagcaatgtcagaagagacagcaggacaaattgcaatcaataatccaccagcaatgctaatcacttaaaattgtacatttacattttccaatgcaggaataatgatatcaatatgaataccaatgacaacagtaacgataatgagttcacatttattgagtatttactgtgtgctgtagactgtgttaaatcatttgcatggcttatttcatttaatctcacaagaatcccaggtggaagagactggcatttcctttcctcctttatagataaggaaactgaggcagagaggagttaaataaattatggacagatgtagagccagtgtcagagcatcaacataagaattctccatcgttatactggcttttctcacaatatggccttagaattacctgggatgcttgctaaaaatgattagctctcagtgttatctaaagcaaatgaatcagggtcttagggatgaagatcaggactctacatttaagagacagcaggcacagtatttcttacgtacatcacagttggagaaccagtgtctgagcagtatgaatttcacagcctgatactgctacatgaaccagattgagtaaaatgattctcgtttttactatagagtcgtataagagagaaaatatatcacaacattaaagagaaacagtaaaatcacctcaactattgaaatcatttcaacagaggactcaacttctgaattgatcatagagatataactgcttttgaccagctttagaaggcagatttttgtatttgtctctcatatggaactggggcctcaatttcccatttgtaaaacaagagtgtcggactagacaaaattttataaaactgcaggtttaaatattaataaatatataaatgttttcccttttttaaaaaagagaattcactatacaatttcttaaaataaccttttttttttttttttttttttttttttgagacggagtttctctcttgttgcccaggctggagtgcagtggagtgatcttggctcactgcaacctctgcttcccaggttcaagtgattctcctgcctcagtctcctgagtagctgggattacaggtgcccaccgccatgcccagctgatttttgtatttttagtagagatggggtttctccatattggccaggctggtctcgaactcctgacctcaggtgatctgcctgcctcagcctcccaaagtgctggaattacaggcgtgagccaccggaactgtttttttatatgtaggcttaaaatttgttgtaaaaactatctggaagtatatttagtatgtcttgacaagtttagacaccatttaaactctttgacccagtaatagcatttccaaaaattttgccaaagtaattaaccagagatacagattaacatttcttctacaaagatgcttagtgaaccactacaataaagaaaaaagaggaaaatttaaaatgcccaacaatgaaagaatggctaaatattgaataaatcattttattacatgtaaaatggattcctatgtcaccattagaatatcagatttttctagaatcctaaatgacacgagaaaatacttcttaaaaatgtcaagcgaagaatgcagaataaaaaattatatatatatacaggctgggcatgttggctcatgcttgtaatcccagcacttcaggagttcaagaccaccctgggcaacatggtgacaccctgtctccactaaaaattcaaaaattagttgggtgtggtggggcaaaactaaaatcccagctactcaggaggctgaggtacaagaatcacttgaacccaggagacgtaggtttcagtgagccaagattgtgccactgcactccagcctgggcgatagggcgacttcatctcaaaaaataataaataaaaattttcaaaatttggaaataatatatgtatacacacacatatatatatatacatatacatacattttaatggtcatatatatcctattatgtgccagatgaatatcaggtaggtctctctctctatatacacacatatatgtatacgtgtacacacatatgtatacacatatatatatacatatatacacatatatacacatacatgtatgtacatttacatatatacatatatatgtatagatatatgtatgtatgtgtgtgtgtctgtgtgtgtgtgtgtgtgtgtgtgtgtgtgtgtgtgtgtgtgtatagagagaccgacctgatttcatctggcacataataggatatatatgaccataaaaatgtatatatatatatatatgtgtgtgtgtgagcatgtttgtggggtatgtgtgtatatgctttaaaggtttattcaggaaataaaccaacacgttttaatgatggctatccctggaagctgcaatgacaggttatgtgtattttataaaatattaataaatattggaatatttattgggaattttctgaagttcccaatttgtccacaatgaacatgtgtttattttgtagttagaaaaacatgttattacaaaataattcaataggaaactacttttagaaatgcatttatgatgcaaggtgaagcatatctgcaacatgcttcttgctgacaaagaggcctctgaagcaggcctcaccaatgttcccaacgatggtaaatttggcaataattgtgttgttaggggagctccaagcttaaatgctgcaattatgagctagggtacacaaggacatgttggaagtgacaggcaatatcagcttcctccaaaataatggtcaagcgaatatgtgcttttgcccaaaaaggaaagtagcacagctgtaactggatattgtaaataagtggtcaaaggttccctaaataagcaatatcatataagcctccttgaggcatattttttccttctgggagccgtgttaggctcacagacatgaaggcagccaggaaactgttatctgtttacttctaatttatttttataactgtccatgccagcaacaacaacaacaaaaatgtttctaggagaaaaataaatttggcaataaactctctgagttttcgaaaaatcttaccaaatcaaaaacttctacttatcatgttgctgtcaaacccagcctcataaaaactttacttataattgagtgtatgtatgtctatctgtactgtaaccttgatacttggcctcaaatcctggttctgccaggagcttcgtgcctttgggaagatttcctagcctctccacatcttgcttttctcatcttaaatgtagacaatattataccatgcagggctctgtgaggttgaatcagaaaatgccactaaactgcaaagcacaatcccaggcacattgtaaaaatggaaaaatcagcttgattccattcccctcttgccatacaaggatatttcaggtctctcaaaagcgtttcaaggaatagaggaagtagtcaaacaagtgtgtgtgtgtgtctgtggatgttggtgtgtgatgaaatatacatataaatattatatataaatgtatatattatatataaaatatttgtaaggatggaataactagtatctgcttaaacaacaactacacttcgaaaatcctttatttttcctgatgagttttgttcaggtgaagatgttcactggtaaaaagacaaggcaatccatttcttttctacagtgtcagctttgtttgaaggacacaatgacatctattcagaaaggtaccaaccattttgcttttaaaatactgaggcaaacctctctgaggtttcttcaaagccaatggcaacaaacatatttcagcatctgttttgcttcactgtaggtctgtgtgtgggtaggttataaaataaaaatgagcttgccattacagatactacttaaaaaccaaaaaaactatgatcatgatgttgataattctgtattcattatcctaataaaaacacataaatgtctagaaagaaatagacaattatgtattaggccttccgtctcttatttaataatagcagtgtcattgctctagttaaaacccgctctgatcttaataaatctgatgtaaaaacatatcaccagatggggactctgttaatcttatgcgatactttcaactatgatgactaatagttctataatttttatatggttgctcttattgaggaaagagtaaccatttaagggaatcttccaccactgttctttgttgaaaggaaggctggatctacatgcatgccaacatactactgaaaagtaaatatgcaatccaactattcaacaatttggaatcattgcaatttttatagttccagatggtgatctttatccagatgaagtgagactattttactactttgtcagaactctacaactaaatatttataaccctcaaatacacagatacattatcacagtgtgtgtgtgtatatgcacatgtgtgtacacacttttatagaatgagaatgaactaggttttgtaaaagtttcagttacaagccacatgcctatgttacacattctgtctgtaaactacctacacccacacacatatacattcatgcaccaatataatatggttttcaaaatcatgtcacatagttgatctcattttatctcaacaggaaccacagtctaattgaaataaatgcctctgccatgaaactaagtcagttagtaactgtaaaggagttgatttacaggaatatctattccatggcctagctaactgaactcattaatgacacatgttatgtaatgcttgttaaattagtgaatgctcttacattgaaagacacatagtaaagtgctgaatttcaggaggtgagctagtagtttcaatgtttgtgggcaccatttaatgcataggaagcctgcatttattgagtaaaatttagagaaaaaaagaggccctgcccattgtaactcaagattaagggcaacttcaatttcccagagcctccgtaatgggcactttaggagaggtgaatatggtttgactggatagagtacaatggctttttacattgataaaatttgctgtacaattgtttactggtgaactttttaaaaatggaaatagaatgtaggcttcatatgttactaaggatacccttgattatgtaataggcacttgcattacaaaaaatgaaaatggctgaataggtagcctgagccatagtttctgcaacctgttctcctttccagtgttattaatcacttgaacctcacctgctgctctggctcctcctccttgatctttacagatatgactttaggcagaaacagattcaggagcccagcaccacaccatcctgctgcagttaacttgaacatacgtcttatctctgattactactggcttctgctttaattccctgtgcttatcttccgtccctgagactccagtccacctggccttccaacataggcttaagatactctcttcctgtcccatccatgaactgcaagctggtgtatagagcttcctgaagtcacatgatccagacaagtgattaccaattttattggataccgtatctattagtaaaaaaaaaaaaaaaaaaaaaaaaaaaagtgcaagcacctccattacgtatatttattttcaataagttatgttcttgcactattatgtcaaaatattatctattttacaaaatacaagaaaaagaaaatttgtgagcggataagaaaaaatataagattttatttccatacctcaataagttgtcctgttcacgcctgggcatatgtctaggaattacctgttctgagccactttttaggagactgttatgttttgcccccaaagactagtcagggcacactattgccaatatgcctggctagatggagcttttcctagtgcctggtgagtggttcctgctcttgcatctatctgccaccttacccacctaccacccagtcccatcagcctctgcttcatcccagtgaaagggctcattgcggattccaatccttatcattttgtcttatgctactgtaattaaataatcaactccctgggacaagaaaaggtaaaagtttcttcaggagttagcaaatggctacaagcaataaaaaggtttagaaggcaaatagaaatttagttacatcattgttatagttgtaatgtagtatgtttctctcaatgggttgcaccagagttcttttttttctacttgtttctattgagatgttatttgtaaaatgtaatttatatctgaggtgtctacacatgatagatgatacataaaattttatctgtgacacaaagcaataagcaaagtagggcacatgtaacaaatggtcctgagacgtatagtgggaaaaaataaacttgtatccctaccttatattaagataaattccaaacagattaagagctaggttaaaaaatcacaaatacggaaaatgtagctaaacatttatctactcttaagataaaagccctcaaattattaaagcaaagaaagaagttacaaaagaaaaaaaatcaataaatttgactgtataaaacaccatgaacaaaagtaaaaaggggactaaaaattggaatatataattacaataaatgtgagctggagaaggttcatctatctaatacataaagaactcttgcaaaaagtaaaaaactatgcaaccccaatagaaaataagcgaagagacaaacagaaaattaacagaagataaatggctaataaaaatattaaaaccatttttattcacaccagtagtccaaaagtgttaagtaaaacaacactgaaataccactttaacctaatatgtggataaagattttttttaatgaaaaacatttcctgcagcagcacagtaagatgagaactctcaagcagtgtggcttggagtgtaacctggtataacctttagagaagtattttttgcaacatatattaatagtcttaaaatagtcatattctttgacatagttattttactaaggaaatattcagagataagccaatgtttcagttcaaagatgttccttgctgataattttaataattgggaaaagctagaaacagcctgaatatccaataattggcaaatacataagttacaaaatctttttagggtgaaacattttgtatccatataagtaatgtttgaaataatgttaagtgatatggaaaaatgctcatgataaaatgctaaattaaaaaaagaaattaaaactgtacaatccaggtaattgctattagtatcatacttgcttggaaaaagaatagaagaaaataactaagaattagcagtgattatttgggagtgtgttgaggttatgagaaatttatatttgtatttttattttttctatacgtgtgtcgtattgtgtgtgtgtgtatatgtgtgtgtgtatgtttaagagtcttgttccatcacccagggtggagtgcagtggtgcaatcatggctcactgcaccctgaacacaatcctcccacctcagcctcttgagagctggtactacagggacacaccataaaaaaataatttttattttttattttttgtagagacagggccttgctttgttgccaggctggtctctatttctaggcttcaagcagtcctctcactttggcctcccaaagtgctgggatttctggcattccaccatgcctggcctcttgctaggtttttaaagaaacctagaatgcacataaattgcctttataataaaaactattttaagggctgggcatggtggttcatacctgtaatccaagcactttgggaggctgaggcaggcagattgtttgaatccagcttgggcaacatagggagacactgtctctacaaaaaaaaaaacaaaaaaaattaaaaaaaacaagccaggagtggtggggcacgcctgttgttgcagctactcatgaggttgaggtgggagtatcgcttaagcatgggaggtcaaagctgcaatgagctgtgattgagctactgcactccagcttgggtaacagagcaagatcctgcctcgaaaaaaaaaaaaagaaagaaagaaaagaaaaaaagaatatgtaagggtcattgtgccttgaatataaatattttgtagattatatgacaagaattttaaattaatgttttcctatttggataaaatataaagatgtccaacaatagaatgtagttagaagctgtgaaatacagaactagaaaaaactttttaaaattcatatggaaccaaaaagagcccgaatagccaaggcaattctaataaaaaataacaaagctggaggcatcaccttgcccaacttcaaactataatacaaggatacagtaaccataacagcatggtactggtacaagaacagccagatagaccaatggatcagaatagagagctcagaaataaaactgcacacctaggaccatctgatcttcgacaaagctaaagaaaagcaatggagaaaacactccctattcaataaatggtgctgggataactggctacccatatgcagaagattgaagctggaccccttcctttcaccatacacacaaaaaaattcaagatggattaaagacttaaatataaaacccaaaactatagaaaccctggaagatgacctaggcaatcccatcctgaacatagcagcaggcaaagattcatgacaaagacaccaaaagcaatcacaataaaagcaaaaattgacaagtgggatctaaataaacttaaaagcttctgcacagccaaagaaactatcaacagagttaaacagacaacctacagaatgggagaaaatatttgcaaactatatatctggcaaaggtcaaatatcctgcatctataaggaacttaaacaaatttagaagaggaaaacaaacaaccccattaaaaggtgggcaaaagacatgaacagacacttttcaaaagaagacatacatgcggccaacaagcatatgaaaaaacccttaataacactgattattagagaaatgcaaatcaaaaccacaagataccatctcataccagtcataatggctattattaaaaagacaaaaaataacagatgctagcaaggttgtagagaaaagggaacacttacaaacttttggtgggagtgtaaattagttcaaccattgtggaaagcagtgtggcaattcctcaaagagctaagagcagaactaccgtttgaccatgcaatcctattactgggcatattcccagaggaatataaatcattctaccataaagatacaggcaaacgaatgttcattccagcactattaacaatagtaacgacatggaatcaacctagatacccatcagtcacagattagacaaagagaatgaggtaaatttacaccaaggaataccatgcagccataaaaaagaatgagatcatgtcttttaacatggatagacctggaggctattatccttagcaaattaacacagaaacagaaaaccaaatactgcatgttctcacttataagtgggagctaaatgatgagaactcaggcacacaaagaaggaaacaacagacattggggtctacttgatcagggagggtgggaagaaggagaggagcagaaaagataactattaggctttgggcttaatacccgggtgatgaaataatatgtacaaccaacccctgtgacatgagtctacccatataacaaaccttcacatgtacccccaaacctaaaataaaaattaaaaaaagaacctgtgaaatgtttacatatttcatatttgactgtggacaaactgctactctgctatactttatttttaaagttgtattgtaaagttgtactacgttccccataaagcaaactatccaagatacagtccagcagagtgcttaatggccataggctttggtgtccggaagtctaggttggagcactggctctgcaacagtgtgcaggtgattttatctctgcaagcctcagcccaactaaccaggtgtgtaattgttttcccctccatggatgccttgtaaatcttattttctaataactgaataatgactgaatatggttaaccatatcatctgggttttttttttccccgagatggggtcttgctgtcacccaggctggagtgtagtggcacaatcacagctcactgcagccttgacctcccagtctcaagcaatcctcccacctcagcctctcgagtaggtgggactacaggtgtgtgcaaccacgcctggagaatttttaaaaatatttttttgtagagacagggtcttcctatgttgcccaggctggtcttacattcctggactcaagtgatcctcccacctcggcctcccagagtgttaggattataggtgtgagctactgcacccacccagccatcatctagattttaaatgccaaagtgataatatggagcagatagaataagatccagaaataaacaaatacccaagtgatactttcattattgctttctttcctaggtacccttgctccccagcataacaacgtgcacacacagtcgtagcccagccatggttcttagcattgcaattagatcatcatcatcactgaagtcacattctctagtcacattatacataaaaatgtcaaagaatcttgccccctctttttttgatgagggagtaaactaggcaactgtgaggtttttacaacataaaattctttgttaactctgttgacatttggaaaaatggctttatgctggctttacagcagcataatctctatttgtttctttaaaaatgctgtgattagttactgtcttttcctttaaaataaacaatagtgctgccaaaggaaaaatgtataactgtttgaaaggaatacattttatgattaacatatctttatatataaacaaaataaaatatgacttctctctagttaaaatcatcttcataaacaaatacttcaggaatagattgttaattggcaagctaattggatgcggtacttgttctgggagcatctttattacttccattactcaaactccctccacctgcaaacacagtcactacacacagcgtactcctcattatcacgatgggatatagatgatgattgaagaaaatgtatgcatttttttcattaatgattttactcctctcaaagggacttttaactctaagtaaagtctgtttatgaatttctgataaaaccaaattattttacattattaaatttcattttcatagaatctcttttctatatctttcttaatgtacttttaggcaaagtcaagttatttttcaaaattgggtttggttagaattttgatcattaaaaaggatattaaattattcttcctccagctggaaatcaagccctctatggcaccctagaaggaatcatcactcagtgaggagtgatgtcataggagtgttgaataaataaatgcttaatgaatacatgagtgaatataagaatgaacaaatctataaggcaaacgaattttgattctttcctatcatttaataaggcaaactaatttaaccaaaggcagaaatcaaatctactggtgtgtttcatgtataaccactataggtaggttttgtcttaaaaaatagaaaagcccaaaataagacagctgattctcaagcaaagatgagaacaaacacaaagcccttccagagctacatgatggaaactgtgcggaaagtaaagactccctcttccagtcaccaacacatgatacttggagaagaatgtacaaaaaactgggaagcacttcagacagactgcccagctctatttgctaataccattaatgattagttcacataccaccctcctatttctcaatcccaaggttcactcagatgtctaccctagttttccctcctattttgcttttgatgtggattgatttgaataaaacatttaagaaacactaatttagagtaagagctaaatgtctgttttttaaatggtgtcttggcttaaagatagaaaagcagtcattaattttttgtcctaataactaaaaatgatgtcaagcagagcagatggcaagaagagtgcttgtacagcactaagcacctcatggtgccggatgactcaaacaaagcacaggtcaagaagcccctggcctgaccaacattggtcagaggagtccaggaaaatacatttcttcttcttcttcttttttattttttacatttcttcttctttacattaatgaatcaaattttcaattgaaaaattaattagcacacatagtaaaatttccccaagtttaaaatggtgagtactcagcccccttctacctcagattccaaacgtgtagccacctcttcctcaaagctagcaacttctaccatcaccttaagtgcatacgcagaaagatgcttttgagtgaaacatatttatgtatgtacagtcttagcatatttttccataactgggaacattgtgccttaacttttccacttaaaaatacaccttgactacatcaataatgatgcagccattcaagagaataactttctgctgtaagaaacatgagaatgcagatacactggaaaataaccaaaaggttaaacttagagctaccatttgtcccagcaattccactactaggaatatacccagaagaaaggaaaatatatgcacacacaaaatcttttgcataaatgttcattgcagcacatttcaaaatagccaaaaagtgaaacaacgcaagtgtctatcaactgatgaataaataagcaaaatgtggtatattcatataatggaatattattcggtcctaaaaaatgaaatctgatatatgctacaacatgaatgagacttgaaaacattatgctaagtgaaagaagcaagtcacaaaagacctcatattatataattccatttatatgaaacattcagagtaggcaaattatagaggaaaaaaacgtagattagccgttgcctagagctgtggggtggaagggaggcaggtgatatggagcaggtaatgggggagatggagggtgataactataaggtaaggggtttcttatagtggtagtaaaatgttctacattgattttggtgacggttgcaaaagtgtgtgaatatactaaaaatcacgaaattatacaccctgtattgatgaagagtagggtatgtgagttatatctcaacaaaggtcttccagaacaacacaagaagcttctctatgtattgacacactgtcaagtgcaaaatacaaactgcagaacaatgaatgtgcagattatacttctttttgtttaaaaagggaggaagagaatagaatttatgttttcattgcacttacataaactctaagagtatatacaaagaaaactagtgaaaatggatacatgggagtgtgcatatcttcttttcaaagtataaaaataatacaatagtaaatgtcatctggagatagtgtcatactagagaggtcttcctcatagatgcacagtattgtcttatagttgtgcatcagttgttcaatcagccatataccgattgacatttaggctttctccagtgttctgttacaaaaactccagcagaacatttttgtacatatattttttgcacctttacacaagtacatagagtaaatgttaaaaaatgaagttgctagataaaagatagacaagaaatccttaaagtaatgcagctaaagaatatcccttaaatttgttgacaagtatagtagctgtaaccccagtagtattttattgcaattactgagcaaaatacactttctttctgataagaataaatgaaaacaggatttccccattctctgtagttagagcattaaaaaggaagcacaataacttccttttaaaagaaagtcagacaaaaaccaaatggtttattctatgtaagctctggaagttgagaaagagaagcctccttttaataggcatgaatttgtttgaattcattatgtggcttctcgagtgctctgcagatttaaaatgacctttcagcctcaaagtgggagtctcagagcaaaaggatgaagagaatctgtttcaattaagataaacatcaactaccaagccccaattataccatttgaatttgaaaaaggcaaaactgttgtcaaaaaaaattggaaagcatcaggacagcagtaaacctggtaaaatttaattgcatcacgttttgatgatgttactgagtgttcatggaacgtagggctatgtttggatgcattcctccttttccttccctccactctccctggctcattttggagttgtttttgagtgattctatttagctgcattggcatctttacttaaatggacatatctgtgcagagaaaaccctgttattcattatggtcaaagaatggtagatattaactaacaactacgtaaatatactaaaaatcaatacattatataacctctatagatgaaaagtatggcatacgagttatatctcaataaagttcttccagagcaacacaagtagcttctctttgtatcaacatactgtcaagtgcaaaatacaaactgcagaacaatgaatgtgcagattatgctccattttgtataaagaggggggatgagcatagaataataaagtgatacatacatctttaataaatgttatgatgttgaaataattacaatgcaatacatttcatactaaataaaaatcgtatttagttacttttggttgttattgttgcttttgtcatgattttgctgttttgtgaccaaaaatatacttgagaacttgcatacatgaggaaaatgatcgtggcaatgatgtgtgatgggtttcagttcatacaggccaaactgtgtttgctgtttgaagctgatggaacccattcataaactccttaagggtggccaggaaaaagaacaccacatacatcctgagcagtctttccagtaagaatatcagtacctggcctttgatatgtgtggctgtcatgctcatccctactgcagtttggggaaccacggcttacatctgtcttttgcatcaaccatgtcattcatccagcaggcacatcctattaccagctgaaggccaatattacattctttgggaaaactattccaaccatttggtagaatttttttttactcacatatatctactatccaattacatttagaactcagatcagaggcaaatttagctcagagaggcattagaacactgaaatctatgcacttatggcaagagagaattcagcgagggttgcctggtgtgtcacttgctacttaaagtcaaagtgagatcttacacctaataaaaatgctcttgtagtttagcaagtcaaactcttgggagggtcttaaactttgtgtaaagagaagggatttacagcagcagaacattttcaagggcacttttatgtcagaagcctttccttttttcctaggtgaagtccactctctctgacctcggctcaccaaggcccctgggaagacaggctagcaacagaaatcaggtcagatatgtacagaaaacaccccagtcaaagacaaacactggagacttgtaggtaggaaacccatcatttcacgttgtccaacttttcactggaaatctatacatgagtgccatataaatttaagttcttaagacagcaatctttcacttcttttcctttttaagtgattgaaaaagatagcctttctgctcctcatatctgctggatattcaagacctttgtacctgctataatccccttctccccaatgtttgtttgactggttctttcagttctcaacttccctgaccactccaactaaagtacatctctaggacacacagccacaaagagacacacagacacagacacacacccatacacagacatacacaaacacactgtttaactcggtccctcctgtgttctcttcactggacttaaaacacaattaggaataattttatttagtgaatttgttttgcttggtaagctccaggaagggagggaggcaccattgcatctccagagcctagcacagaaaggagataaaatatgtattttttctgtatagaaactaccctaaataaaactgtagaaaattattctaaataagaatcttgctgttgaactattttatatataaaagtatatttatttcttatcttcttgtatcatctttgtaggctactattaaaatataatttacatatctctaagaactgagatacattgttatatcagttagaaatatatatcatatattatatatcatatagataacatatatataatcatatatcatatcatatatagatatatatatcagttagaaatatcagacatttcagtttagaaatagcatatttctaaataatatacaatttagaatataagatatatatattttaagaagactatgtcaaagaagtttcaaggccagatttagttagaagtgatactgatttttttccacattcatgtgactttaacagaataataaatttagattaaatctaattcatacttttattaattttcaaattaaggaaaaattaagttttacctagaactgttaagacattttcagtaaactttccattatcatttcacttgtgagagatcatatacatgtcatatcatacaccattttgtaaatggttaaaattctcacattctcaaacagtaacttgttttaagactaacatgaaaacacaaacataaacaagaaaatattaataggagtttttcccttctaataataaactggctagcattttttttggtttgctgtgtccctaccattacttcaagcactttccatgtattatttcacttaacattcacagaaaccctatgggtagcttttcccccttgtccaaaatcacccagcatgtaaaagaagatgagttccaaattcatttgacttcagaatccacccccatctctccagtacatattgttggcaattccaaactgccctggaattttaatagctcagctctatgttttcctacagcctaacaaaatagaaatactttgaatgaagttaagcacataaggtctgacttcgaaatgataccaaggtttaaaactagccattaacttttacatggaacaaaaaggaatatttataaagccatacagaacatggccatctggcctactcctgatgcaagaagctgaaacatgcttctgaaaactaagtgctttttatttctttctttagaattgttaaaagtttcttggataactgagaaaaaaaagaacctactttctcttgaggatgccagagtaagtatctttcatgtagcattaatgttctatttacccatcaaaaacaagggttaaaagcaacggttacacagagtccctccccaagcctctcatatataatcagaaatatcctaagggaccaattattttctattactcctattagtcagaaattcacatattgcaaataataatttcttctctccgtcggtctgaatgaatttattcaggatgttatactaaattagaaactgtgaggattatgaccaaacaagtttccatgaatttaacatttttttctacaaaactttataggatttcacaaattccagcatcagttgatacacaagggactcccctttctattatctgactacctgaatctaccctgtcttagccaaaatagattatctgttactcctttaaaaagattgtcctgagagtctttttttctttttctccccaagttggttcccattctgaatttggacactaacgaacatagaaatcaaagactgtaaagcaactatttattcagaaacatttcagaagacactaaggtttttatttagtattcaattaagacttgcctcgaaggctgggacttctttatgtgaatttgaaatttacagggtatgtcacacctacgctatatttaggatgcaactgagtgaagatgaaatgcctaaagcaattggcaccaagggaatttggtactttaaacattttggaaagcccaagattgcatgtgtagttacatttcctatattctttctctatctcttttatacacttaacacacaaatggcatgaattacgaaagcaaatgtgtttggcactttgaacaaattatccatcttattgaagtaagttagctaaaacttttctttgtgtattggaaatttagacaattgtttgactattaagaaatgatccatgggaaatttgaaagataaacttctgtactttattcaggaaattactaacaatttataagaaagtcaaatcgtcaatataacagaaacagtgaaaaaccaaaaaaaacaaagcttcaaaaaagctaattacttaaggagggatgaccaagcatataaagctaagagaagggagaggttcaaattagaaattaatttagaattcaattaaaatcttataagtaacgtttataaagcttacaaacaaaatcttacagtttttcccgattactggctaaagtttataaaaatcatttatggaatttcccacaatatacaccaaaaaaaaaaaaaaagcagaggatagtaaatgggatgggttttaaagtcagactaagttcaaaactagccatatagaactggagctgctgtaactgcacacaaatggtatagtagtccagatgtatgactggcagtcatagaataatgtggttcattgtgaaagtcagataataatttgatattttgttgtaaacaggttttccattcttgcatggtgcccttttatggcagttgtaatccttaagggcaggccttttaactgaactacactaggacataaatgccatttccttctgatttcctgcattgaatctggtctttgatagtccattcgaaagtttttgttagatccctatttgatgtaatggccttacttattaatgcagttatagccagggattatgcacagtaacaaaggaatatataacagcactcaagcatagtaatagtaaaatgagtttatttagagagctgacaaacaagctagtagcagttatttatagaaagaaaaagtttatttctcttattagtgaaatagagcctcaagcattcaaaaaatattttaactagggcctataaaaataaaggtctcccgaagattatctgtaaagacagattttggcaataagtgaaataatgccttatattcattttatgagttaattttgtataaaattcacttttttccaactattttttcctgatgtgccctttttgtgttccctctctacagatacattaaaatgttctactctgtatattttatctttgaaaactcaaaggctaaattcattaaaatgagaaagaaatctgttggttttaaaatttatttaaataaaaataaatttaaatatttaacttggctgacacagccttgttaggaggtgattaagtaaacaatttacctagaataaaaatatctcttattaaaatggcatggatttccaggccagtaagaaaagaaaatatctctctaacccagggaaagtattttggtctaaaaaatcaaatattccagatttattttatattactccaccccaaattcaagtagggaggttttaaaattatgttgtttaccactggatttctggaagcaactgaaacacttatataaatgcacactcctaccaggaaagtaaaaactattccaaggatatagtagaaggtgaaatagaagtctcctgccctatagaaatacttcagaaagtcactagaccataaattttatgaagccgagtgctgtatatttcaccattgtctctctaacagccagcagggtacctgtggcagaacaagcttaataaacacttaaataaagcaataaaaaatgcacctttacttttgtaactaatagacccacagaaataaaacttttctttaaggactatatattttaagctatagaactagactaaatgatcaggtagctagaaaatgtttctgtacaatactaaaacaaattacttcctcattattaaggattaagccttaatttccttctttttttttaagcctaatttcttgccattccaaatatttaagtctgggagtgtggtaaagctaaaagctggcttcacaatcggaaaagttcacaatacaagaaggtaagccaaccctaagttgttccctgactttgaaggtcgggggtcaatccctgtgttagggctccaggacaagcttgtcactttggttcagcatccctcctgtggaatctgctcatatgtgacaactgtgtggggtttcaagatgcacacaatgaggttagagtgagcctgaagtggtggtcttagtacttaccaccaacagatttcttggcttcatataaaaatcacccattgatagagtcagaaggtcagcatgtcagtcgggtgataaccatgtgcaacacatttatcagcatttctatatgcactactctttactagtttatgacacgagaagagtcattcgagcagtcagaaaatatagaggaaaacttggaagtatatattttagaatgggaaacacaggaggcaatggaaggtgtgcctagattagaattgccagtggtggtggcaaactaagggtgaaagaaagccacagggaagaggcaaaaatcctcccggatactatacaactcttgccataaagagtaactactgtgtctacaactcacccagtacaatctcctgaaaagtgccatctactaaaagaaaattaaaaataaaaattgactgtaatattctttgtaatatggaagaactcactgttctactttccatgcaaaggacagatgttgaatgcccatgatggagcaggcatggtgctgggaacaggggttcattgctctacaaagatgagcaaacccagtctactccaaaacatgctcacaggagaggtacgtgagacagaagacaataattgtaatccttcaagagttagagaaatgtacaaggtttcatgacagcacagagaagagagttttaattctaattggggaagtctaggaaggcccttcagaagaaatgtccactgagggtgaatctaagcaacagaatttggatattaaatcatactaaaataattattgtaaaatgacaacagtttaaaatgctcaaatagtcatatataccaaattattatttaaatagaaaatctgatttttaccctgaatttgtatctcaaacaaaagtttgcttaattacctatacttaagtgagaatgaatgaaccatatccgcatcaacaagggatcatctttcaaacataattttgcaagggggtgagggaaacagccaaacacaaaagagtacatgctatattattccttttatataaaattcaaaagcaggaaatttaaaaagtttgtgattttcaaaatcaggatcactattatttttagtaggtgggggcaggggcttaaaggggcataaaggtgacttttggctgctggtactatttttaatctgggtggtgattacaggggtgacctttgaaaattagaattacttatttttcttctttgcatttgcaacatccaaaaagagtttttctgtttacaatatttatatgttcttcataggtgacaaatagacaaaacatatcaaaaaatacacatgtatttgtatgtatgcataaaacctgtttctgctacaatgactttatttgcatgcaaatttaatggtgagattagatatatagagttatgatgagatcatcaaggccatttaaatggcaagcagccacactatgtccctcttctgtctggcagagatcaccaatggatcacagcacattttctctgagaccaacgcagctctcagtacattattccaggcagctactgctattcgtaattacaagttgcccatagattaaaaagactagctatcttggttttaaacaatgcagactgtctaattcttttgatatttacatgaaaaagatcttgcaataatggagggatttcacatatatttctaggtaaacataaaatttcattcctatgtacgtaaaatgattttttcagttacacgaatacctttaaaaagttgtctgctaacatcaaatttgcttttttgtgtgtgttttatattaccctagaagctcttactgattcatatactagtagactcttaacgaaacacagaaaagtaattgggctatctctttttaaagcaaaacactcagggaatctttaatggttaattttttttcccaagctggtgaactccaccctcaatcacacttaatccaatgtgcagttgttaattataacaaaataatgcttttacagtttgttttgttttgttttggtaactactcataataaaatagtagatatcagagacaggaatgctaaatgcctgctctaacgtattgcattcttgacatttctagcccctgtggctgttcagctcatcctaacacttcacgccacaagaacagacctaaccagatctctatttttgtctgttgttctttagaaatgatggagaaagcatcttaagccttctgcactgagctgggatggcgggacaaaggaaaaaggagtccttctcagtctggtctgatagagatgatgaggctcagctccagggagataataatctgtgaattacacaaccaggaatgcaccttaggactagaagagtaagggatttgtagaggtagagaatgcctggcagtgtgattaccgtaggaccaagccacagggtggcacccagtaggaaagatacatggagaaagtctttacaaaggtgcacctagagataatgctcaggtagctgaccattcctttcagatgaaacccctgcctagttgtgcttccttagagggttctcattgagttttaaataactaaatcagaggtggtttagcttcccactgaccacttcttattttgccacctccactaagtagtttacttctttgacccacctagatagcagtgtgtcttctttgaatcacactattaacgtgatttatctggaatacctagctctatataaatgcttaattctgactgtgttaaaaaagactaccttatggaaaagaaacccttacaaaatgaatcagctttcacatttagagttcttgattatttagaaagtcataccaatgtgtaaacttcaaaaatgcataatataagctaacagttcctggtcactcacaaggagccagccatgtgctaagcacttcaggtagatcaactcattgaacatattaacatatacatcattgctaaaggtaacattttataattaagaaaatatgcgaatcatgaaattatcttatttgccactcaaatttaggcaagccactttacttcattaggcctcagtctgaggaataagactaatgagtactgtctaggattcatcatgaggatctaatgagataattaggtcaagtgaacagcacagtgcctggcacatagttaagtacacaataaatacaaattgccacaatttttaattcagatgaagactatattgagaggaaagaagtaaatttaaaatttcaagatgcgaattacagctacttacttagctatatgacataagtttaggaattacattatagctcaatacaaattataatagaactgctttcacacatttgcctgacagactaatttttagctctctttttcagctcaaacttcatttttgaagttaaaaaaatatttctccagccaggcatggtggtgtatgcctgtagtcccagttactgggaaggctaaggcaggaggattgagactaggagttcaaggctgtagtgcatatgatcacacctgtaaatagccactgtacctcagcctgggaaacacagtgagaccctgtctctaaatatatatatatatatatattcttcaacaaatctttttaccacttaagcattgacattgtttttaacagtttttcttgaccctacttgactggaaatgttaaagactagcaaaatgtttccagctccacattggggttaggggtggggaaaatcagattataggttattctctgtggtctcttttatttcaaaggttttatggtgctactaactggtcaaatgccagagagaaggaaaactgcaatttatagtctgaccagaggaagagagtcaataagctgaacgagtcaggaactagctagatctccaaggaatggagccgtgtcaaagtccatgttctatttctcaatatatctctagggctcacggttggaggcttgtatacaaatcttggggggaaaggcagacaaataccataggcaaacatgttcttgatatacataagattaaaagaagaaacttgaacagtctaggacaggaaggaaaagtataagtagcagcttgttgactacttttctaataccatgaaacagaactatgtgtagccaaagcagtttagatagtgaggaaaagcaaacaaaacaataagaacaacaacaacaaatatgggatgtagtttcgacagaccaagatttttctgcagcactgtaattttataagctgtgcgacttcaagttttattcatacagtttattcatacagttgcttcaactgtatatagtactaagttcattgtctgtcaaagagtagatgcccaatacattgtagctatcattaatgaggttatgactccaactatgactatagacctagaagctgctttctccagctagctggtgatctagctgccaatcagttacttgctattctataacaaagttgcagtatcagagcaaaaatcacagcccgctgttgcctatcccatgttagaatgccattggttaaaagtggacacattttacagtaatttatcctgactaaaatagtatcagtcatataaattccttgatgcaaagaaaaaactctgtgccacattgcaatggaatgacatcctgaatgttaggaattattattttctgtattccatatgaatgtctcaagcaagttcactaaaaagagctcaatttctcatctttgatgtattttaaacaagaaagagaattagatacaacgggagcacttttctctaggaagtctgaaaacaattacatactgaaattatgtttaatgaaacatttattttaacaagtcacactggtgccatctattttacaatttagaatgaatattttgcaatatgaaatgaaaaaagaccaagaagtcactcactagcagttttcaaaggccataaagaagaattggtttatctattgattcactctcattatatctactgacaactaagaggaaatgggttagaatttaagcaaagaagatttgtattagatataaagaaaacttcctaactctgtgggtttaaaacaacaggactgcttcctataagggtactttggaagatgcaatccttggtgtgcatacattctacacctagtttctagttttctaatttcttattcttcctcatgtgtagtagggaaatggaagggcttgcaggtgaccccctttaccctatggcagaaattcttagggctgagatggggggcaaatgtcctctacactgagtttcattaatggcagcttttgcccagaggttgccagtgttattaaacagggtagggtgctagatggtggatgcttagttcaaactgggctggaattcttccatattggtctctgtataatctcttttttcttgccacacttccccagctcttctcttgaaatattcccttgtgtttttctaactcttattctgaagagcagttcacccttctgttagcttctctaattcgcatcctcagccatcacccaggatgctcattagggagccaatccccttagaaggcttaggacagataataaatacttacaatattgcccctgtcatgctaaaaaactgcatccataggttctggcattcttcctactttccatacttttgaaatgctttctaatttaggtcaaacttgacaaagaactaggcaatttgagagctgagacatatcactggcacgggctctcattagttagttacctgtacacagttatatttaacagtgtctcacccaggcttgctgtcattgtgccccatgtggtaccccagcccttcccataggcaccaatccctggagagatttggtgcttgtggctgaagtataccttacttctgtccattttctaatataccttcaacccctgtattatattttgagatattggatcacctctggaaaggcttccaagaaaatctatattgattttttattaagactgtgctttctttgtgactatcttccttaccaacctagctaatatccctcaggccctattctctatacctttatctaaactttgacaattctatatgtttagtattagtattattgggaatatttatacatatcgctcagcatctttccctaaaaagcttaaaaactccttaaaggcctcattaatattcttccccttcagtttcatcttagaatctacttttctcaatcttgctagtaatggttgggtggatccatgactaaccattcgtatactcatggttaccttcatgtcatcatcccttctgattcaatagaattcactacatgattggaatgattgacagaggaactactaagtgagctattcctttacctctcctaaaaggcaagttttaatgataaggccaaaaccatggtgtgcctcagatccgtggggaagaaaaaaaaaagagttgcagtcaggactaagtattattgcacacataaccacagccagttgacatgatagaaaaagagggtggagaaccccattttgaaataccaaaagaagcgtcttgcttctgaagaatttcataccaattcagcatttctttaccaacaaccatactcacttcctgaattatcagctatgcatcatacagtgtttagtgcatgattttctcattccagatgagcctaaaataaacttgtaaaaaataagatgctaaataaaatgaatagatcttaactattatagtgataactcttctgtgatatctcagaagtgggaaaagttacataacttcaaggtcttataaggcagaggtatttgaactgctacattacctacgagtttatcccaatccatatagagatacagaatacacaaatgactctcccgcggtaaggcagcactgcagagagtaaaactgtaagtgatcttaacagtcattagcttagtggttttcaaacaatattccttggaatcctaaagtctttagaggtattttaaggagagggtttgaatttggggtggggggtaaatgtacaaactcagtggctgttttattgttttatgtgtgcttatactttttacttatatatttcacacatatctatgtttttaaaaattatatctatatattgaatttatatatgattttatatctaaaaattacagtataaatattcatttatattaacttcaactcacatttcattaataaaaaatgtcccattgaaataaacgtgtttaaaatccattgacctgccttgccccttttattttacaggacagtagacttggcttcagagggactaggtgactcctccagggacacagagcatgttagaagtacagtggacaaatggctttttccagggaatctcatacttcatgactttaaagagtaaacctatctgtgatccactctgtgtctttctagttatgttttaaatacatcaaatatttcaaggtatcttaatcatttctaaaagctgtatatctttaagtatatttcataacagatacatcactaacttgggtaataggaccaaaaaaagtttacctcatgctcaaaaccctgaaccaactttgacagtagtcacatacctaaaccaaatcataatatatattgcacaggcagaaaatatgagaattccatttgtttgcgtatttacaagtttctaagatagaagaaataggaaggaagattgcatatttttttcaaagctgatcttagatgtcatacaaaatctgatatgtactacttgtttccaacctgaagccttacagagcttgcagagaacagaaaaacttggtaatagaattggaaagataatctattcaaaattgtgaggcattggccttttgttctttattgtctgttataaagaccagaggaccttatttgctaccagtagagaatataatggtctacaagctgcaagagcctttcacaaagctatttttcaacaaccaacagtctttcacaaagctatttttcaacaaccaacaacgtcaaccctgaatttcataggctaccatacttccgaaaagaaaactgccaaatactgtaatgcatctagaaatattcacaacatgaacacttttatggccattaaaaagataattatatccacagtagaggaaggcaacaagctgaagaaccagagcacgttctttgaggtagacagacttgggttaccccagcctatgaccttgctcaagttatttcatctcacggaatcattttctcacctgtaaaattaggattaacaactccttcttttcaatattgtaataagaactaaataatatatatgtaaaattcttgatagagctctttcataagacactcaataaaatgaaagctataagtattagaaaaatggattttttttttttttaaattgagacagagtcttgctctgtcacccaggctggagtgcagtggcacgatcttggctcactgtaacctccacctcctgggttgaagcaattctcatgcctcagcctcccaagaagctgagattacaggcatgttccaccactctggctaatttttggatttttagtagagacagggttgcgccattttggccaggctggtcttgaactcctggcctcaggcgatctgcctgcctcagcctcctaaattgcaggtattacaggagcaagctacgccgcctggccaaaaatagaaaaatattgatatgttaaatgaagaagcagagtacagaaatagtatttacagctatttaagatatgtaaggtaagttgaaaatgagaataactgaggatggaataatggggttaatgggttattttccttccaacatattaatgttattccatctttttgattctcaattataaaattggacattttagcttatatgaatgctttccactgtgatcatgaggccaaaataagaatgctaagccagtctagatttttacaaccttaagagaaaagagctaataaaaaaattataatcctccattggtcagagttgcaagaaaattcagaaaattgtatccaaccagtactgaaatactcatttgcatattatataacctgagcaaattgtggtttaatgtctaagtagatattggcatatataaagatgagcttgctaatacatatagtaggtatatttttaatattttaaactttcatatataatactttattgataaaaactacatacaatatgcaaatacagtgaagaaaagagaggcagtcccccttaccttcactcctaccatttttttttttactcctaaaaaataaccactaccaaaagcttggacagagtcttccagaattttttctgcatctacaaacctaagtattacatgtatacttattacataataatacttataatgaaaagtataagtactattacatatacaataaccaattttaaaatttgctttaaaaacaaccacagtcatattttgaacagtagcatctcttttattttcagattacataatgaatgatcttacatgtaacacataaatcctaaacactgttctgtcagcaggaaagaaaaaagtccacttccattgactaaacttctctttatatttatatttgtaagactaataatgttttacttacttaaactaaatcacaagtcttaattacattaatgagaagtatccctgggaaatgtttataaatgtttataaaagtgttaaagagatatcaaggaatatgtaaggtaatattttcatagtatataacaactgactaaatctgaatttaagatatgcaagaaaggcaaacaattctgcaatcaatgaatctgctaattttattagctttatgagcataagaaaatatataaagtttttctcaatttcatgcaggcacatttttttaaaataatgcttaagaataaatactataatcactttctgctagaacgtggcatataaataactgttccttaaataaaagcaacctagtatacacctttattaaataaaccctaaatttggacacctatgttacaaagagacaaatagattaattttaaggttatttgtattttgtcttgaaattaataaaattttaattataacaggctgacctttaataagaggaagggtataaaatacaagtttgccatgaaatcccatttaaaatgtgaatatctcatagcaatttaattaaggctgtaaggacaagttagtgtggactgctttttatgatacttggagagaaacaaatagaaaaaggtaaagaagtaatccaaaacattggattcttgcacaatacaacaaacttccaaacgtaatgtttggctttagggaatcccggaggacagtagacagatttggagaaagtagaccaatggaacacaaaatagatttatgtaatcagagtgaagatggtaaagccagaaagatgtgtcccaagaacaaagtattttggagatcaacctggaaacaaataaacatctgaaaaagagataaatggcaaagttttaggtctctctcatgggaagtcaactgaaaaggaatgagggtagggtggtggtggagaaatgcagacagcaacactggtgagaaaacattgtccctctgagcaatttgaggcctgtggcctttatgtgcagaggcacaagaagagaggccgtttgggtttttttaatgctcaagtaaacatgtgtgtgtgtatgtatgtgtatacatatatatacacacaaacatatattttctctatataccaaatctataatctatattgattttatacatgtaattaaataaataaatataatagatgtgtctaatatttgactgatagacggataataaaatggcaaaactgttactacagctgattataccctcaggccaaattttttggcagctgcagtgatatacccaagcggttatattattaagtcagatgtaagattaataactggagaggtttctatagtgtgtagttaaatctaagaatcatgcatatatagagagagatttatttcttacacagaaatcattctatccccaagtctatggagaatatttttagttaaatggaaaaatacacacattaacaaatcaaaatatttaaaaatgcattttaaattgtggcttgacttatgaaaatatcccatacaatttaaaacaaaaaatataataattgtggataaaaatagactatgataatctcagagaggtaaagggtgtcaatgttactcatctcctgaaatgaacaaattatttccaattgaaacctgaatttgaaaatacatctcctggcagtttagacaaaaagagaaatagtttggttaaacactatttttaaagtagtaacatcttttcacataggaatggtataaattataaatgagttaaattcatgtatattataaattctgtttactcatgttggtgatttatattagctatggtaattcatacaaggattttaaggattttccagtatttattgtttgaggaaaaaaaggacaggactctccaaatttgtttgcagatgcaatcttttctttaaataaactcaaggaataatttattgcacgtgttattttgtaagaaatggcaagtaacgttaagagacaaaatcttcatctataatttattaaaactcacagaaatactgcggatggggcaattcttgtttctggttgactgtaaaacactacaataacagcaaaggctaacctatccacaaaaacacaagctaaattcctgacgcaaataatttgagtatttacatgtgtgtttgcctgctcacatgataatgcatattttgctggcctgttttcctcccattctcaaccacctcacttcaatcattgcttttatttccccagtgtgaggtatgattatttccatttcaaagaggtgagcttagttatttataatcaatcactaagaaaaacaaaataagactaacccctaaaatagccataaaagtattttgtaaatacctattgtagaaaaaaaagttactttgttggaaaatactccttaagggccatgccatatgctgattagcatatcaaatcaccattggggaaataatagaacattagaatacattgaaactgacatattttttcatcagagtaaaagcattaaaataaccaaaaatataattactaggaatcatttctaataaaataaaacataagagatgaatgaatgataagcaacttgatatacatttagccacatagttaaattcaagtttgtttcatgtgtatgattaaatataaataacattattaatttctaacacatctgtgctaaaagtgagggtattgcttttaaagacaagggcaaagcctgtcaaccaccagcctgcttgcagcaagcaaagaagataagaaaacaagcaactgaatcaaacactgaaaaatgacaagttttcattttcaaaactcccaacatatctgcaagtttctttcctcctttaaaaattatcatcagataaattgttacagtccaagaggaattaaaaaaaaaatcagcacccatttggttaaagcacatgagtttgggaacaaaataaagaataaaagagccgccaatactgccttctttcacaaagcctcgacatcacacaacttactaaatactcaaggagtacgtcaatcttaaaagagaaaaggggaaaagcatgagagaaaagaacgttaccaaactgcctctgcagtccttagggaacttgtagatcgggatcttggcttcataataatgctcattttgaaaaaaaataaaaaggaaaataagtcttcaactattctgattaatacattctaactgtctttctgcaaagaagattttaaagatattccatttccaagggaggctgcttgaagaaatccaattttcctggagtccatctcctgtcctcggtccagctcatgggcaaggttctaacacgcaggagcgctttcttccttcatactgaatttactccagtactaggctgttaggaagtgacagtttcttctgtgtcttgcaatgccaagggaggaactgaattctgaattgattcttcatctgggtcacaagggaaaccagcatagtgaaagagtcacttgatctcttttttgcaattccatagtaacagctttaaaggtttctgacactcgaagagcgcaggtagagagagagaaaaagaaaatgaccgggaggtactgtaacacgggagagctgtcaaggaagttccatttcagggcaagcacaggaaaacactcctctccgtggagcaaagaagtcagccaaggaacaaatctctccacactttggctgggtgggctgatttacctgcgaaagtaatttctgtgtgtccctgcttagaatccagggttttgtgaatgagaactatcattcaatctcaccaggcagaaactattcctcaagggctgtatgacgtctgtaagaaggcagttcaaaacaccgcagggcagtgagaaaggaaaaaaaaaaaaaaaaaaaaagaaaagcccagcgcccagcctagcctcgtcaattgctgagacttacaaagcaaaggggcggatcagctccagagaccagcactgtaaaccggccaagcagacaagagacctcacaaaacttataaaaccatttccttctctgggaaatgagatgtctgtgttattctgggtaacattccgtgatcacctttacaaggaacacaccccttgccattaagttgtttatttaccataataaacaaatgaattttataaaagtcattctttcaaaaaagtatttcactgaagcactaaaactaaacttttctctttagaagcaaagttgagagaacttgatgacttagcagctgttcattttgagcggatgtaatgaaatgtcatgctttggagttggttgtagagatgtaaattacctcttaaaaattcagcagagtgtaacaggcacccttggatcagaacatactggaattttaaactgaaaaattgaatgtattattcctggacaagtggctgcacgtattaaggctgttcccttgcacaatgttttctaaaccttatttttttttaaaaaaaatgcaaatttcattcatctctacacacaaagacttgggtttgctaatccttaacagctcttcagtaaggaatgaagctttatatcttgtcaatatctcttattatttcgaaggccaaaacctttcccacctcctaaatataaaatattttctattacagtagatataatctaagctgattccaattgctcccaacagaaggaacagttgaccagcctgcctatctctctgaacatctacacagaggatatatactcctctgggtgtgccaacttcaattattttggatgtgaattaccaagtgaaaataatgtaagcattctgattgcttaaatggcattagctagtacgttggttctctagtctgacgtgaacttggtgtttatttagcatttgcagacaggatgttggagtgcagttgtgacccacccaaacaacttggaaaatgtagtacggcatccgccagaggctctggctgcttcttacaacaaacccttcatctgctcccctggtcacacttcaaggtgcatttgtgacttagtcttctttcaatgactctcaggcctcttacggtaaatgccaataaattgctttccacatagttatccccttaagcttttcagtttccttatgactgccaggggacattcacactttcttagcactgtcccatgtctagtatattgctggcattttaaagcaggttaattaatcatgtatttttttggaaacttaaaagttttgtgagactaattatttttaggggagaggggatttagaggaagaggtttaatttttttcttattggaatttaaatgtgggaaaagaaagaacaaaagcaaaccaagtaaaattaggcaactactatttatttgaaacactgttccctccatgtaaggtctaccaaatagcttccagttgccatttcagaaagcaaatgacaatgatcagagaatgtaatgtctgactgttgagttttcaactctccagaaataattagcctgtgttctaccgtcccccagatccatgttacaatgagcttatttagcctgatgctactcccttctctgtcacacacacacaagtttagtgcagccccatgtgctgttccttgcttacttgcccaacattctacatcttccaagaatctttctctgaaaacctaacacacttattgggcatctactaaagactgtataatagtaccataatgactaagaaatcgtccctctcccctggcaaaaacaaacttaagtggggaatctgacaatgtatggaactaaccagaatactcaaagtttttggattggtacatcaaggttgccattacagagaaagaaagatgcgctatgttgtaagaccattgagatttaaatttaagttttgcttctactcctaatatttaaggtagtgacagaataaaaaaaaagtatgtatttgatgttacagagttttatccacttgtaagaccatttctcacatgaacatttctgaaagaatgttttgttatctaagcatcctgtagttttccctctgaaaagcttccccaaatggaaaagatatggcatttccctcgaaattcctgttagcatgcaagcatatgatggcatgcaggctgatgaggaggcctgaatatggggagactggatttaggaaccatgtggcccatgcttttgatccagaagctgcgattatttctcagtatttccctgttgtactgaattgtataatgtatggaccttttactttctggttgttaccacatttcaatagactgtaccatagatgtatacatccattgggtcatccatctgtagatgttttgttgaatcaaatgactatgtcatttgatgtttctgaaacttcagtcataacaccaccttcataattctttccatattagcattccatctataccatgatttgatatttttcttaattgactcactttttaaaaaaacttaaactgaatataaaaggtaactttatatttattctgtaaatagatttaatatactggtataatttgcccccaaaatataagatatattaatagaaaaaaaggagtccaaaataactcctaaagtctgtctcataccactaatggtgccccgatacaacttggcaacacttacatggaaagcgtcaattgcatacaggtagattgtgcgcacctaaaatgtgatctccctttctcttatcatccaatggtgagcgtgacttgtgagacttatgacatttatccatggattaaacattaaacattaaatgaagccaactgaatgaggtgttacggagtaattttactatacaactcaggttttctcaagtattactattttcaaatactctgcctactatcaaatcttctgttctctaaattcctattttcagattacaatagatattctatactttccaatctatcatgagcatatttcttagagccatattatatatcaactaaatattcaggcctctcaaatatgctgaaattcagtactccagatatgtcaaactaactttttagaaaaaaagaccaggggactgcagtttttacagtttcctgctattctctattgtactctaacgttaatgagaataagacactgaactcctgtagcagttcctcattattgagaaatattgtgttattttccttatctggaggggaattttgaggcaatttctagaggtttcttttattttattacacttactaggaatacagttggattcaaggactttcctactggcatgaaccttgcttggagctacatttcttaattcccaaaggagaagtccggagtattatattttgaaggctttcctatcttcagatttcctacctctttcataaactgtcaggttaggataataataataactactaattattaattacctacatgctaagtagactatactttcttaattatacatcacaacatccctccaaagtagatgtgataataataatttcatacataaagaaagtcaacaatttgttcaaaatttttggacccaggtatatttcattccaaagcttgctcttcatgatgtgtatgtgtgcatgtatgtatgtgtatgtgtgtgtttgtgtgtgtgtgtgtgtgtggaagacagaaagaaaagaggaagagaaagagattaaaaaatgctaccaagtttttggaagtttttaaaattcatccatcctctttagttgtacagtggcaatgaattaatataataaaaatggtgcacgtacattactagtataatgataaacatatttaacagctagaaaatgttagatctttaagatatgcaggattaaacaatctaacttcactgtccttgtttctaatttttaggcactaacttttaggtatcataaacactgtgatgagggcatatatgacaacatcatgagtttgttagccataaaatatgataaggtctttgaccatctcacaacatgagtaatggtagtttcctgttacctatgcaacagatgacattttgattgcctcattaggcaatactggttaataaatgatcattttaaaaggtaacaatacgtgagacctctggtaacgtataaatttcaatatttgtcaacaaattacattggctattaaaaggtacagaatactagtttttaaaactagaataaacatttgtgcatggagtcagtaatgttgacataaaatgaattttgtaattgactttcagaattttgcactaattcaatactggatttcagaagaaaaactatctaatttaaaattttctaagtgctgctgtatttcctttgcattctgcctctcctcttgtccctctttcacatttcttgttcttctttattctaaacttaaatgaatctctgcaaatttaacattattttgaattaaatatttaaattttattaaagaaatacatgtaaataatgtaaacaaagagcaatgagtgtaatatcctcaaactccagcattgattcctgatcccaattcatacacaagaatgagaccctagaaaggtgacagtaagttctaagtgcatgggtgaggcttgtgtactgggagttttactgcagtatcatcaagtgcccagtggggattttttttgcctcttccaaatgttactatttgtaagagattttttcctctggggtatctctatttttctagagaaggatataaatatgcttcctagcattctggtgtgggtaggagaaggacgctgaaggtcttactgacacattgcagacattcatttaattgtcctaaataaagttaaacatacagccatccttctcctactctttgcttagtatcccaaagtctctgtcttccatggagagggatgcaaaatatgttgactacactgaaaaagagtgagggcttatggagaagtgtatataatatacatgttcatacacctgctatatttagaactcttccatcttccaaagtatgttttgggcgactggggcagctcagtttgcttcactttagtattgttctctgatttggttaagtcattgaccttttctcttcctacttctatctttatgtattgtggcttagagtcacagacatctcccagtttcctcaaagatgaaatgtacctttctgttttttgtactaattattggtttgagtgactttttaaagaaaaaaatggcataggaagattgtttctccacagttttaaagctagaaatctataagttctactttaaaacaattttctatgtttatctaagcatacgcatttacaaattttatttatcaaatgactatatgtcaactctctctaagcataggtaaatattaagtattttttattatggtaaaatacacatcacgtaaaattgacattttaaccctttctaagtatactgatcagtggtgtaatgtatattccccctgttgcacaacgattatctccatccatctccagaactttttcatccttccaaatcgacaaccctgtactcattaatagtaacttcctattctcctcttctcccagcccctgacaagcaccatttggctttctgtccgtatgaatttgactactctagatatcttatataggggaatcacaaagattaagttgtaaaggtagattcagaatcacatagccagttatggtctagatgtctcattattaaagaaaaaacaattatggaagcacaaagtttgaagataacaattcacaccttgagaaatcaatgtacttgccttatccatcatcaattctttcaaagtattcacttgactttcatagacaaagtcaagagcaaaaatatctttgcctttaccaacatctggtgtgtgtttttaaaaattattcttctaactattttttttctgtttaaatatatacaaatgttatcagtgcttacccagtctggtcacattataactttagttcttatttcaaatttatagtagcttcctgtatttaatcaagtagttcctaactctatataccaatctcaagggataaagcaaaaatttaaaattaacttacttcaataattcttaaaagacttttgaaagagatgaaacaactggaaagaccacattgccaaatgaagccctagtttctaacactgagataaattgagattttcattaaaataagattggaggctgcgcgcggtggctcatgcctataatcccagcactttgggaggccgagacgggtggatcacctgaggtcaggagtttgagaccagcctggcaaacatggtgaaaccccgtctctactaaaaaaatacaaaacttagctgggtgtggtggcgagcacctgtaatcccagctacttgggaggctgaggcaggagaattgcttcaacttgggaggaggaggttgcagtgagccgagatcgtgtcattggactccaacctgggcgacaagagtgaaactccagctcaaaaaaaaaaaaaaaaaaaaaaaaagatgtgaaaagcagcctgtcaaaaataaatgaacacaagatgtgttttaataataatttagtttctgatgtaatgggaaatgttgaaaattgttttattagaaagtaaactctcatcaggacctttaaatttacatttatttgataacatttttcttgtacatattaaaaatgccaaaataatccaggcaactcaggcagtttctccttgatcacagattacaaataagttttctctaatgtaaaacagctgctctgagaaaaacgcctactatttaggaagggtatgtaggatcaagttaagaagaggcctttggagtcagactgcctggttgcaaatccaaattccaccaatcactagttgtttgattgcaaacaaattatttaaccttccctggcttcagtttcctcagctataaaatggagatagaagagaattttctgaggactaaaaaagacatgtaaaaccttagcaaagtatctagaaaatggtaaggaatcaataaataatatctgctattaaaaataagttttaaaagagtaatcaataagctatggagaaaagcagctttaaaacttaaaaatatatgttactgcactagtatttgatttaaaataattggtttgtgcttttgtcttcctttggatcctgtccccttgactccctttacacatagcttgtgtagttttcctgacttctattttacacatctaaggtttttttctcttatctttggattatctttcaaagatacaaaccttaaaatgtcaaagcctgtgatgaaaaaccttctatagcttcatattccttacaggatcaatttcagccttttttgtgtgttaaataaaaacttctaccatttgggttcaatctgctattcagctttgcccttgataactaatttttcccaccctatattgccaaccacacaatctcacacaccttgccccaaatctgctcactttgtttcccctgcctggggaacctctcacctttctcccacttccctgctaagtatatttcctactctgccttcaagatctagcataagtagcagtaaagcccaactaactccaagacaaactcagaagttcagtctccttggattgattcaatctgggaatatctcaggttaattttgtttattataattattattttataacacatttgcagtatatggcaacacacagtgaacatcacagggggattcaaatcccacagacactgtttagctatcgatttggactctgtaagctttgaaaacacattatctctttaagattcagtaccttcttctacaaaataaggacaatatgcacacctagaatcctcccagggttcctctgggattaaatgagaaaacatgctgtccaatctgcaatcccttgctcttgatcactttcagatctttgcacacgcatttctggcaggattatctttcttttcttttacccctctttttgatcaagagttaaatcaggactacgcctcccatcctgctgctctgcaatctgaattaggtgtctggccatgcaaatctctagatgttcatcctaatttctttcaatttatcagcaccatatggtcatcctctcttcatttggttaactataagccactaactaggaactcctactggaaaggattgttttaccattcttggtagagcacaaggcattatggaggcccaaatagaaacctgggcctccataatgctgtgagtttctttgaaaacagggaatgatgatgagcattttttcatgtgttttttggctgcataaatgtcttcttttgagaagtgtctgttcatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcgttagtgggtgcagtgcaccagcatggcacatgtatacatatgtaactaacctgcacaatgtgcacatgtaccctaaaacttaaagtataataaaaaaaaaaaaaaagaaaacagggaatgaggcttctgcatctttgtattcagaatacctagcacaatatctggcttacaaggtatttgcttaacagcagaataaatctttggtcaacggtggtagataagccctttacagattttcttcctgtgcccttttgtggcatttgcttcatggctggaattagatttcaaaaactgagtcttgcctctttcttgtttttcataagcctctatctctaaaagttactttagatgccttctgtgccaaaaaggagttcctacaatagtgttataattaaaaaaaaaattctcccaaagaaaaaggaactggttgccagggtaaagaaatacactggaagaagtcttatgcaggcactgaaccaacgccagcatcattgataagaagcgaaaaattttttgttaaatatttaggaaaaatggccttaatctggagaaactattatgcaatgtgatattcaacccagacagagtatttgaattctaataggaaccttttggaagctcaattcaaagaaataacttttccaggaagagtttccccacattttggcaggacaatggggagggtgtttgtgtcatcttataaaatctgccaatcagtcaccactgtctatgaatgagatggctgtttctctggatgaaaaggctgcatcctggccagtctttaagaaccttatctggagccactactaagtgttgtccaatctgcaacccctcactctcgattactttcagatctttgcatatgtatctctggcaggattatccttcctttcttttacctctctttttggtaaagatgcattagcacattcgtatttgtatcaaccacatgaagactgtatatccatgtactggatgagaggaccgaagggcactaagtgcttcccctacaagttcagtggatgaaccaggtcagaactcaagcctggctggctccagaagagaaatctgaagatgacaggatgaactcccatttattgattgctcaccatgtgccaggcactgggtaagatgttccacatgttctctcatttaacatttaaaacaaactcacaagctaggtactattatttcttccaccacacagtcaagaaaactgaggtctacaggaagttaagtaccatgccctaggtcttacattaggacttaaacttagattacccaaatgaagcataacctggggaaagcataaccttgagaactaaacaaatcgtattttaagtaacatctcaataggaaattttttaaaacttatttaagcaattctttgaaaagaatggtagaatgggtaaacttattactctggacatggtttttttgtgcacatgacattgaaatcattaaaagttagtcactgtttttattctaggaatcacgactttcaaatatttcaattatttagataccagactgcaagtgtactcaaaagtaactcttgaaaacagtgccattaagcaatgactcctcattctgcacactcacattccctggcaactactaacctgttttgtattctctatggacttacctattctagatatttcattaaaataaaatacaatatgtgatcaaacaagtaacttttggaaaaaatgcatttttactttactatgttggttctttccttggaattaagaccatttattttttatttcaaaaacactttctttggatgtatattttcatttaaagttttctttttggatggagagggaggtggagccatatggctaaatagcagcctcccaaaggaacaacaaattgaacaactctccacacaaaaaagcaccttcatgcaccttcataagaaccaaaaatcagcttaggtaccagcttagccacagcagggtaaagcaccaaaggggttctaggggttcctgattccagggcttggctttagatggtatttctggaccttccctggcttacaggtgggcccactgccccaaaatagattcctaggcctggcagcattcaccacaagctgattgaagagcccctgggccttgaatgaacatcagcagtagccagacagtacttgtcgcaggcctggggcagtggtggccacagggagagactcctctgcttgtggaaaggagaaggaagagtgggaaggactttgtcttgtgacttgggtgccagctcacccaccgtagaatagagtaccggtagattcctaagatttctgactccaggccctggctcctggacgtcatctctagacctgcccaggactaggaggaactagttgtcttgaagggaaggatacaagcctggctggctttaccacctgctgattatagagccctagtgccttgagcaaacataggcaggagccaagcagtggttactgcaggctttgggcaagacccagtgctatgctggcttcaggtctgaccctatgcagtcccagtggtggtggccacaggggtatttgtgttacccctcccccagatccaggaaacagagacacacacagagagagagagagagagacagacagacagacagacagactgagactgaatctgtttgtttgggagaaagtaagagaagagaaaaaagagtctctgcctggtaatccagagaatgactctggatattatccaagactactaaggtggtacctctgcaagagccacagtgttactgggcttggagtgctccctaatgcagatattcctgcagtgacccaaaactcagaccacaacacccaagtttcttcaagcatctggaaagcctcaccaagaaggacaggtacaaacaagcccagactgcaaggctacaataaatacccaactcttcaatgcccagacaacaacgaacatccacaagcataaagcctatccaggaaaacatgacatcaccaaacaaactaaataaggcatcagtgaccagtcctggagagacagagatatgtgaccttttagacagaggaaactcaatggaattcaagataacacacagaaggaattcagaatcctatcagataaattcaacaaagagattaaaataatttaaaagaatcaagcggaaattctggagttaaaacacgcaactgacatactgaaaaatgtctcagagtctcttaacagcacaaaacaatcaagcagaagaaagaactgtgagcttgaagacagcctacttgaaaatacaaagagaagacaaaagaaaaaataataaaaaagaaagaggcattcctagaagacttagaaaatagtctcaaaagggcaaatctaagagttattgaccttaaaaaaaagttagaaagagagatgggggtagaaaatttattcaaagggaaaataacagagaccttcctaaacctagagaaatataacaatattcaagtataataaggttatagaacaccaagcagatataacccaaagaagactagctcaaggcattcaatactcaaactcacaaaggtcaaagataagaaagaatctgaaaagcggcaagaaaaaataaagaaaaaacatacactggagttccaatatatctggcagcagacttctcagtggaaaccttatagggcaggagacatattcacagtgctaaagggaaaaaaacttttatctcaggctagtatatcctgtaaaaatattctccaaacatggagaaatcaagactttcccaaacaaacaaaagctgagggatgtcatcaacaccagacctatcctgtaagaaatgctaaagaattctcttcaatctgaaagaaaagcatattaatgagcaataagaaatcatctggaggaacaaagctcactagcattagtaaatacacagaaaaacacagaatattataacactgttattatagtatgtaaacaactcatatcttaaatagaaagaataaaagataaactgatcaaaaataataactacaactattttttgaaatacagacaatacaataagatataaagacaacagaaagttttaaagcgggggacaaagttaaaatgtagagtttttattggttttccctttgcttgttagtttgtttatgcaatcagtgttaagttgttatcagtttaaaataatgagttacaatatattatttacaagcctcctggtaatcgcaaatcaaaaaatatacaacaggttctcaaaaaataaaaagcaaaaaattaaaacacgccaccagagaaaatcacttttactaaaaggaagacaggaaggacaaaaaccatatgaccatttcaacagatgctgaataagcatttgataaaattcaacatcccttcatgataaaaatcctcaaaaaatcgggtataaaaggaaatacctcaacacaataaaagtcatatataacagactcacagctggtatcatactgaatagggtataactgaagactcttcttccaagaggtgggacaagataaggatgcccactttcaccactagtattcaatatattaataatactggaagtccttgctagaacaatcagaccaaagaaagaaatttgaaaggaagaaggcaaattatcccatttgcagaaaatatgatcttaaatttggaaaaacctgaagattccaccaaaacactattagaactgataaataaattcagcaaagttgtaggatacaaaacaaacatacaaaaattagtagcatttctacatgccaacagtgaacaatctgaaaaagaaatggagaaagtaatcccatttgcaataggtacaaataaaattaagtacctagggttaactaaaccaaaaaagtctacaatgatctatcaactatcaaatactaatggaaaaaaagagaacacaaaaaaatggaaagatattccacattcatgaattggaaggatcaatattgttaaaacgttcatactacccaaagcaatctacagattcaatgtagtccctataaaaataccaaggacattcttcccagaaatagaaaaaaaatcctaaaatttatatgaaactataaaagactcaaaatagccaaaggtatcccgagcaaaaagaacaaaactggaataccagttttgaacccagaaatgaatccatacatctacagcgaactcattttcaacaaaggcgccaagtatatactttgggaaaagacagtctccttaataaatggtgctgggaaaactggatatccacatgcagaagaaggaaactagacttctatcttttgccatatacaaaaatcaagtcaaaatggatgaaagacttaagtctaagactctgaactatgaaactactaaaagaaaacattgaagaaagtctctagaacattggactgggtaacaatttcttaagtaataccctacaagcataggcaaccaaagcaaaaatggacaaatgggacaaataggatcacatcaaattaaaaagcttctgcacagcaaaggaacaattgacaaagtgaagagacaacccacataatgggaggaaatatttgcaaactatccatctgacaagggattaataatcagaatatataagaagctcaaacaactctacaggaaaaaattaatctgatttaaaaataggcaaaacatctgaacacacatttctcaaaagaagacataaaaatggtaaacaagtatatgaaaaggtgctcaacatcattgatcgtcagagaaatgcaaatcaaaactattgtgagatgtcatctcactccagctaaaatggcttttatgcaaaagacaaataataagaaatgctggtgaggatgtaaagaaaagggaaccctggtacacttttgatgggaatgtaaattagtacaaccactatggagaacagtttgaagactcctcaaaagactaaaaatagagctaccatatgatctagcaatcccactgctaagtacatacccaaaagaaagaaagtcaaaatatcaaagagttatctatactcccatgtttattgcagcactattaacaatagccaggatttggaagcaatctaaatttctatcaacaggcaaatagataaagaaaatatggtgcatatatataatgtagtactatttagccataaaaaagaatgaggtcctgtcatctgcaacaatacggatggaagtggagataattatgttaggtgaaataagttactcacagaaacacaaacttcacatgttctccctttttgtgggagctaaaaattaaaacaaacgaaggagatagagagcagaagacagtttccggaggttaggtagggtagcgtggagggaagggtgggatacttagcgggtataaaaaaatgtaattagatagaatcaataagagctaatatttgatagtacaacagggtgactatagttaacaatttattgtatgttttttaagcaattatagggtaaaattggattgtttgtaacataaaaaaaggataaatgcttgaggtgatgcatacccatttaccatgatgtgattattatgcattgtatgtttgtatgtattccacaaatatatacacctactatgtatgcaccaaaattaaaaattaaaaaaagtaaaaagaagttttttttttttttttttgaatggatagcttctgtataagggataggaaagcagacttaactatttaacctgaccttgtatattaatttgtgctcttttggggagaaacacagcctattcattccaggcatgcagtgaatgctaaaaaaatatccacaaacaacatagaacagtgattttcagaagaagggatctagtgtgttctctgtgttcttaaagacagtgctttgtctgatatttttgcaaaaaagttgagtcttaagtatggtgcttggcaaaagttgctttatggaaaatggaaggcaaataagcaaaaagagatcatgccaaaatactccctgttttcagggcagattgttattccatatggggaaagaatatgaaaaagttctcccacccaagaccatgaaatttaagccttcattcagttgacagtcttcagtgagtcagattcctgcaggatttaagttactccctggctgactctcaggcatctctgcagatagttaacctttttcttgttatcttacagcaactataaattcttattagagtgataaaaagcaataacaatttaaaacataagctatttttaaaataacaatcttgcaaataggtagtaccttaagcaaagatgttttaatacctttttaggcctcactacttatatctaacatattaacatggacccactttccacaacgtagattatttttgctatcaacagtctgggaagggtctttataattttgcttttgaaattatgtggctactattaaactcatttaaccaatgactggccttgattttctttgcaatcatccagcatacttggagatacttgtaaaataaaaaactcagcacataagtttttttaatttagtaaaatgttaagaatactcatttgacaattattgaagtcgacataatcttatgctttgaacatttaattaaatgttagtcctcattttgcagttttctgtttgtattcaattacttcattttccaggtctcaaatggtttcatagccccatgagacgctcataggctgtagcccctgaggaatgtagtgcctggtatggaccacagaaccctggaggtgggatctggaaagaaagggaattctggtaagaagtgattcatgcaaggagatgtatttagcatttccagatagtgccctatttcctgtagtaccttgataattatgagttaccttcccttgctaatgagatgaagtaagtcatcaagcatttattgttacaagggttttattcatgatccagctcatacttagtatcatagatgatttttagaaagcataaattgtggttgccagctttgaggacctaaaatttagctgggaagaagaatacaattctccttaatgttttctctggaataactgaacacatgagattgcaagatgatgagtccaaggtttggatatatgaatgaccaaactaaagcaataatatggctttcttaaaaaatacagttatttaaatgattctagttgtgttaaatcattcttttaaatacctggtgagtggcttaggaactaagatagagtctgagaagaatagcattgctggtggccccaccaggatgagagtcattattatgatccaacaaaataggaggatcattaatttttcactcattcccagagatgtagttttgaacagggttaggttcttatttcaattagagaaactagaaccatgaaaagaagatttcagccctaaggaaaacagatatatcagagtttaaaactccgattcccattctgctcaattgctcagtggatatggtcattatttttgttctttgaaatggactttgttttttaagattatgtagaatgcattgtttggcaaaaagcacaggatattcaaacagaggcccaataaccaaatgcattttttctccattgcgttcttacctaaataggaactataataataacaaggcctcagtaatgcagagttcttgcccttctgtaagtgggcagggtgcgtgtgcaggtaggtaggccattaggtcaaatttcaatgtctgagatactctcctgaccccatgggagtcacataccactgaaggcaaaatctggctgcagggtcacctgtgttgcattggaggactgtgagtcatctcttcatactcagctctgcaacagtatgaaaaggtcaccacgaccacgctcacctattctggtgaattagacgtataagcagcctgctcccaactccttggagatcatttctgagaacatttgtcttctcaacctgttgctgggcatgactggaagcagaataaatgactacagaatgtttagtttacccagataaactgcttggcagtctttggattatgtaaaattaattgtggaaacttaatgttgaccagtgatcatagtatgcggacagacctacttagaaactgttttgtgtgtgtgtcagccagtgttactaagaatcatttaagggaatgaagagtaaaactcttttatgtaaggcattagtttagcagggccactgcatctctgtgtgagctgtccattgcccaactctagggagtaccatttttacaaaccacagcatgaattgtgctttcagaattgtgcaaaatggtggccctgtctttctgcatctcaaatggtgacataatgtaactatattttccatctttaaatagatcctgaaagctcaagttgaagcactgaggctgacactctgggctacacagagaaagcagtgtcagatggtggtgaggaacaccttgtaggcagaccgccaaggtataagtcccaacctggcccttactccagccaaattgctttagttttctatgcctcagtctcctcaattgtaaaatgagtgaaatcagagtggctgggagaattacattaaatagtgcaggtaaaatacttgaaagaacaatgcacgcagtcacggactcaatagatgttaactcttaagactgtctctcttttgttcaatcattaggattctggaatgaataaaacattatcacagctgttttactatgattctgctttaggaatatttgtggctgtagaggaaacattttctgtgtgcctttatgaaagctaataactaggaacagtttaatagaatgctcttagagaaaatgaaaaatagaattttgtgacagccattaagagtttaaaagagactgtggtaaggattgtctcttctggatgctttcaaatgtaattattggtgaaggctaatagaaatccatggagtttcagatactgatagaaaatgataggcatttcaaaaataaacattaagcaaaggctacaaaattaacattatacctccccatttatctttttttctctcaggtggcacaaaagcttgacaaagcgtccatgaaccatttgaagatttttgttgggataatcagatatctataaatgccattgtttaagaaagctaaccaaataacgttttactattgactaataaacttttctaataatcttcaattttattttaataaaatattagatgtagttcagtttctcaactctggaatagtgacccaggaaaaatatgagggaaacttgaagtctatggaagttgtatttggtgttaactgaggcctttgtgtcagcccagcacaaactgtaaagtcaaaagtgtgactttctctttctggtcttgacaggcttttgttttgatagacttgtcctcatctttaacctcctactgttcttctaggttatccaggtagctcttcaggtgcccaggttgcctgttgcctctgctagcctgcctagttcgtaacatcaggcagagatgaggcaggaacttcggccctcaggcttgattagtggttataaggccaaggatcataggaaaaaggtatcaccttcagattaccttccctgtgtattctgtttttgtagttttcatcagagagtaagcaaccgtcatgtgaatatcgtgtctttaatgatctgttaaaatggcggctctcagagaaagtgctctccattctcctcctcctacctcaggccccctcagaaatcaggctggtggtgttagggagtgaagtaggctaagtgtaagaaaaaaaaaacaaaaaaaaaaacagctttggaatgctgatggacagcaactcatatttgtcctcagtgtcaggataataaggactcatgggggtgggaaatattgtaaatacaaaccttgaaaggaggtagctgctattcagagagccaacatagccaacgtttctcaattgtacagagaaatgtgaagttatatgtgagatctttccactttcaatcgtgatgctaattcaaaatgaaaaaaaaaaatctgactggcctaacaaaacaagtttggggtcggggtggttactaggtttccttttagccattgtttgggacatactgatgtactgctttattaatctccaagaaactcatttatgttgagtggctaatgcatcagtagggtaatatttactttatattttaatattttataagttaatagatataataaataatagtaaccatacagtgggattagtttccaatggtaaacatttcaggccttcaggccttcaggaggaattttgaattgtgatgaaatggcaagtgcctattccatccaggcataaaaccaatcctagccaatttattaaaaaaaaaatcctgcattgttactctttagctaatgattaactaaagtctgagtgactagtagaatgagtaattttgttacataagccagagaaggtggaaggaaactaacatttattcaatacctactgtccactgggtacttcatctatatattctcttctaatcttcaaaacaacactgtaaggtagttgttacaaataaggaataattacaacttattccttattttgcagctgtaagttgatgtttagagaggtcacatccaagtctcttggaccatgcttcttcattatacaaggaatattgatgttgccaaatattaattcaggagctggtacagttagaaattagtaacacacacacacacacacacacacacgcgtgcatgcacgtaaaaagcaaggttaaactcgcaaggttaggcaaggttagctaccatatgatagcttaaagggaagaattctgtgctgataaatggagtatttttctccttaactgagtcatcctgtgtcattgttaggcactgtagacagtacataagttaactgagatctgatacttccttttatcccttaaaaatccaacacagggctcactgtaattaggtataaataggtgacttaacccttcagatctttctggaggagagataagtgtcttatgagattgaaataggagggatcaacaaagattgcagaagaattaagggctagcaaaatctgtcatgattccaaaaggatcaagttgaaagtgaaactagttcacacattttcacgacagcttcagagttaacatcctataaaggaatctatcaacattgtgacatttgtttaggcttctataagtgagaaaatgtgtccttccatgcaatactaaatgtaattatcatgttatctatttaatccaacttcacataaatcccaatgattaaatctactatctatttagaatattatcacatacttaggaagatatatcaataaatacttatgggtccttgtggtaaataaatactaatgtatagatgaggttatacttgccttagagagtttacaacaaaaagagggacgggtagtgaaagacataatgtccatgaaaaccaccacattattgctttatttgcttcacaggcctcatatgtgaatttttttttaaactatagattcttacctactaaagtaaagtttcagtgagtgcaaaatttgactggcttctatcctcctatgtccccagtacctagaacagtgcctgaacttaggaagcactcaagaaatattgggcaaatgaatgaatgaatgaatgacacagatcatgaatgttataatgagaaagcagagaaaaaaaattatctgggctggatagtcagagaatgtttccaggagaggggatcccaaatatggacttttaaagctgataaaggaaggcaatttccttgagaagaatggcatagacacaaaggctaggtaagggcaaagagacacctggagtaatgtggatttactgttattctatcagtaaatcttgatgaaaagacttgaggccatgtaaagaagaactctctaataaaaatggaatgggttcccttggggttggtaggagaggtgatttctgtgaggggaggtactggagcttggggtagaagaacacaacaaaaatatgatagcaggcagccaaccccaaggcacaagtgaaactttttttttttttttttttttgagacagagtgtcactctgttgtctaggttggagtgcagtgggatgatctcactcactgcagcctctgtctcctgggtgcaagtgattctcatgtctcagcctgccaagtggctgggattacaggtatgcaccaccacaccaggctaatttttgtatttttagtagagatggggtttcaccatgttgaccaggctggtcctgaactcctggcctcaagtgatccacccatttcagtctcccaaagtgctggaattacggtgtgagccaccgtgcctggccataagtgtaacttttaaagtttcctctcaccttgggattccaggcctctcttttggcctggttgctgaaacaatttaggagaatttctgaaaattttcaaagtattcataaatggaactttgctttcctcctcctaaatcaagacaaagctcacactgaccacagattatcttaaatttggtgaaaacatatttcagttggtggaaacacaattgttttgcaagttagctccagaagtggtaattgaaagtgacatttaagaaacattttctatggatctcagaagatgattactcattttgttttgaaggtttatgatatgctaaagtgtttttaaagcacattataattaaacaacttgtaaaaaaaatttaaatttccccctatggaagctcctatttcaaatgtagtctagagagaatttcaagtaaacatgtaactgcacatctgattttgtgataatttgctttatactttttaatatcatctttgatgttacatattcagatgtttaaataccaatacaaaaacaataataattttgtttaaattttccaaacacacaaaacaaagagaagcattcattcaaaatacttgtatacacatgcaaacaaaattaactttgtgtttatgactcacataagggaagttattggtgcccatagcctctgaatacccgcctctcaaagcttattattacaaagaccagtagctccttgcctgaaggtttttaattcctgtgagtcttggcaagggctattttctggctgcagttacatgcctggcctgagcataaataacctgggagtggtggattgttaatgacccccggaagcaggtgatggatgaagagttggtgaaaagcaccccagcttcctcatctcacagttgggataactctggggtctgttccacactgtcttccagaacccaacaatggggactgagctcctgtttccctctgtgggaacggacttgatgatgtgtattttttcagagatccttccatttcctgtctcacttccctactcctttacttaggtttcttgaatttcctaaataaacaactaatattccttatattggggtctactgctgcaggagcctaaaccaatacatgtctcttccattattttgtgacaccaaagaagattttgattaggcctagaaaatatacatgaaagctgatcaaaatgagaggaatgattaggtttgtttgtctgtttttggtaaatatggaaacaatgccatttcattttagtaaattgccaagttttctcaagtccctcctatctttctccatatacttgctcttctgtcatttgccttttttcatctctggcatacatacaacctgaaataaaacgccatggggtagattaacgagaaacactggaataaaaaaaaatgctcgcccaggcgcagtggctcacgcctttaatcccagcactttgggaggccgaggtgggcagatcacctgaggtcaggagtttcagaccagtctggccaacatggcgaaaccctgtctctacaaaaaatacaaaaaaattagccaggcgtggtgtcccgtgcctgtagtcccggctacttgggaggctgaggcaggagaatcgcttgaactcaggaggtggaggttgcagtgagcagagatcacaccactgcactccagcctgggcgacagaaaaagggtctgtctcaaaaaaaaaaaaaaaaaaaaaaaaaaggcttacagtgtcacgtgaatcacatgcttattaaatgaatgaaaaatacactttattatttcatgtgtgtattaagaggtcatatggatagatcagatgttggcaaatgaatgtgttatttctagaagaaatagaaatgtttccttatttgccagggcctaaatcagtgtttctttgaaatgagtatattttctgacagtatacttcatgcagacactcccacacactccccatacatgtgtgtgtgtacctgacttatatcacttaataatatgaacagactgaagataatgtcaattaatcaataataaatcctaaattccgagttaatgtctgtgctgttttgaacaaggtttgaccgtcttaaataaaaagatttttgtgtttgtttgtttttcacaaggtttgaatgtcttaaataaaaagcatctaggagctatagggtgtagagaaaactctccctgatggcatttttcctctactctcacaccacaaaaatcatcaacacagatgaagccttctacgaacaaacatgtgaggtttcccccccacaccaagcagccaacactagctgggtgtcctgtaattcagttccaacgctgtctacctggagataatgtcagatcccaccggttgaaggttcagttcccaagactgccccccaccacaccagtcacaagtgtgggcctctggagcttctaaccggccacctccaagttggcatactcataatcctctctttgggttcaattaatttgctggagtggctcacagaacccaggggaacacttacttatgtttgctagtttattataaaggatattgcaaatgttaccgattaagagatgcatatagggtgaggtatgggggaaggggtgtggagcttccatgccttacctggctgtgccaacctccatgaaagtccaagtgttcagctatgtggaagctcactgaaccctgtccttctgggattttatggaggcttcatgacatcagcattccttcccccagggtatagggcagtactctctctggggaaggtcttaaaagccacaatcagaaaggcaggaacaggtgaaaggagagaaggagaaggtcaggggcctgcccctgaggcctaacacacccaacattataacaaaagactgtaacaagggctgtgggagttatgagctagacctcagatgaaaactaatatatatcataacaccacacatagattcaaagatctaagttaagttggtcattagtcaacactatttaaaagccagatatgtccaaatggctcttgaatctacacttattatagcaaatattttaacgtgtagagatgaaaaggacagattttctttaagtgtctgaagccggtaaagagaatttctgccttttttcctctgtaaatctaaatctgtttgaagaaagaagtgcgctgtgaaatgggaaggcaggggtgggcaaagacacattttagtgaggttttaatctccattttgctgagtagaaatagaaaggagttttgaggtggtttgaagggaaagtgggggagagagagagagaagaaatgggagaaccactgagaaggtttaaaatgtcttcatgttacttaggcagataggcagatatgagcagggtaggagagtgccccaaggaatgtcaggcaacagtcaggtgactgtcatgcaattgtcaggggcctccttgggaatgacagatggtcatggctggcaccaagaaggggaaaatttcctcccaaacaggaaacatcttgagcttatgagcaacaacttcctcataagatcccaggaactaagcaaacatgaccaggcatctgcagtaaggggcaaaatggcggagtttggccttccttcggggatatgtccaggcatgctcaagaaggggcaaaacgtcagagtttgcctgatatgtgaccttcctttgggggcactagaccagtaacgaaaaattgtcatggagagcatacacacaacttcagccaccaaacggcacatgcagcccctgacagatattagcaagttactgcgcatgcaaggattagccaacagttcccccaagaaggatgaggggaggagatcaggaagaatcaggatacagtaactctataaaagccttgaaccaatgatcaagcggggcactcaatcttttaaattttccacttggtcccttccgaatgtactttactttgcttcaataaacttctgacttaaatctattactttttataaaatttttttccataagttattagggtacaggtggtatatttagttatataagtaagttctttagtggtgatttgtgagattttggtgcacccatcacccaagcagtatacactgcaccatatttgtaatcttttatccctcacccccctcccactcttccccccaagtccccaaagtccattgtatcattcttatatctttgtgtcctcatagcttagatcccacatatcagtgagaacatatgatgtttgcttttctattcctgagttacttcacttagaataatagtctccaatctcatccaggtcactgcaaatgctgttaattcattccttttcatagctgtgtagtatttcattgtatatatatctgtacaccacagtttctttatccacttattgactgatggacatttgggttagttccacagttttgcaattgtgaattgtgctgctataaacatacgtgtacaagtgtctttttcaaataatgacttcttttcctctgggtagatacctagtagtgggactgctggatcaagtggtagttctacttttagttctttaaggaatccccacactgtttcccataatggctgtactagtttgcattcccaccagcagtgtagaagtgtttcctgatcaccccttccatgccaacatctactgttttttaaaatttttttattatggccattcttgcagaagtacggtggtatcacattttgtgtttttgatttgcatttccttgatcattagtgatgttgagcattttttcatatgtttgcttgccatttgtatatcttcttttgtgaattgcctactcatgcccttagcctactttttgatgggattgtttgtttttttcttactgatttgtttggggtccttgtagattctggatactaccctttgtcagaggtatagattgtgaagatttttctcccactctgtgggttgtctgtttactctgctgactgttccttttgccctgcaaaagctcgtaaagtttaatgaggtcccagctatttatctttgtttttattgcatttgcttttgggttcttggtcatgaaatccttgcctaagccaatgtctagaagggtttttccaaagttatcttctaaaatttcatagtttcacgtcttaggtttaagcccttaatccatcttgagttgatttttgtatacggtgagagataggatctagtttcattctcctatgtgtggctagccaattatctcagcaccatttgttgaaaaggttatccttttccccactttatgtttttgtttgctttgttgaagatcagttggctgtaagtatttgggtttatctccgggttctctattctgttccattggtctatatgtctatttttataccagtaccatgccattttggtgactatggccttatagtataatttgaaatcaggtagtgtgatgcctccagatttgtactttttgcttggtcttgctttggctatgcaggctcttttttggttccatctgagttttagaattgttttttctaattctgtgaagaatgatggtgttattttgatggggattgtgttgaatttgtaggttgcttttggcagtatgggcattttcacaatattgattctacccatccatgatcacgggatgtgttcccatttgtttgtattgtctatgattcctttcagcagtgttttgtagttttccttgtagaagtctctcgactcctttgttaggtatattcttaagtattttattttattttttttacagctattgtaaaatgggttgagttcttgatttgattctccccttggtcactgttggtatatagaagagctactgatttgtgtacattaatcttgtatccagaaactttcttgaattcatttatcagttctaggagcttgctggaggagttcttagagttttcaaggtaaataatcatatcatcagcaaacagtgacagtttgacttcctctttaccgatttggatgccctttatttctccctcttgtctgattgctcttgctaggacttccattactatgttgaagaagagtggtgagagtgggcatcattgtcttgttccagttctcagagggaattctttcaacttttccccattcagtattacgttggctgtgggtttgtcatagatagtttttattacattaatgtatgtcccttgtatgctgattttgctgagagctttaatcataaagggatgctggattttgttgaatgctttttctgcatctattgagatgatcatggaatttttgtttttaattctgtttatgtggtgtatcacatttattgacttgtgtacattaaaccatctctgcacccctggtatgaaacccacttgatcatggtggattatctttttgatatgttgttggattcagtcagctagtattttgttaaggattttaccatctatgtttatcaaggatattgatctgtagttttcttttttggttatgtcctttcctggttttggtactagggtgatgctggcttcatagaacgaattagggaaggttccttctttctctatcttgtggaatagtgtcaaaaggattggtaccaattctttgaatgtctggtagaatgctgctgtgaatctgtcgggtcttggacttctttttgttgataattttttaagtaccatttcaatctctctgcttgttattgatctgttcagtgtatctaattcttcctgatttaagctaggagtgttgtatttttccaggaatttatccatctcttctaggttttctagtttatgtgcataaaggtgttcatagtagccttgaatatcttttgtatttcagtggtgtcagttgtaatatctcctgtttcatttcttagtgaagttatttggattttctctcttcttttcttggttaatcttgctaatggtctatcaattttatttattttctcaaagaaccaggttttgtttcatttatttatttatttttttgtatggtttttttttgtttcaatttcatttagttctgctctgatcttgattatttcctttcttctgctgggtttgggtttggtttgttcttgtttctagatccctgaggtgtgactgtagattgtcttttttgctctttcagtctttttgatgtaggcatttagggctatgaactttcctcttagcaccacctttgctgtatcccagaggttttgataagttgtgtcattattgttgttcagttcaaataattgtataatttccatcttgatttcatttttgacacaatgctcattcaggagcaggttatttaatttccatgtatttgcatggttttgaagattccatttggagttgatttccagttttattccactgtggtctgacagagtgcttgatataattcaattttcttaaattcactaaggctcattttatggcctatcatatggtctatcttggagaaagttccatgcactgttgaatagaatgtatattttgcagttgttctgtatatatctgttaagtccatttgttccaaggtacagtttaaatccattgtttctttgttgactttttgtcttgatgacctgtctagtgctgtcagtgaagtactgaagtcccccactattgttgtgttgctgtctatctcatttcttaggtctgttagtaattgttttataaatttgggggctccattgttaagtgaatatatgtttagcattgtgacatattcctgttggagaaggccttttaccattatataatatccctctttgtctcttttaactgctattgctttaaagtttgttttgtgtgacacaagaatagctacctctgctggcttttggtgtccatttgcatggaaagtcttttccacccctttactttaagtttatgttggtccttatgtgttaggtgagtctcctgaaggcagcagatagttggttggtgagttcttatccattctgcagttctgcatcttttaagtggagcatttaggccatttacattcaatgtcagtatcgaaatgtgaggtaccattgcattcatcatgctctttgttgcctgtatacttttgttttgttttgttttcgctttttagcttgtatttttgttttacaggtcctttgtgatttacgctttaaagaggttctgtgcaaaaatcacaagcattcttatacaccaataacagacaaacagagagccaaatcatcagtaaactcccattcacaattgcttcaaagagaataaaatacctatgaatccaacttacaagcaacatgaaggacttcttcaaggagaactgcaaaccactgctcaatgaaataaaagaggatacaaacaaatggaagaacattccatgctcatgggtaggaagaatcaatatcgtgaaaatggccgtattgcccaaggtaatttaaagattcaatgccatccccatcaagctacccatgactttcttcacagaattggaaaaaactactttaaagttcatatggaaccaaaaaagagcctgcatcaccaagtcaaacctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaacggttctgggaaaactggctagccatatttagaaagctgaaactggatcccttccttacaccttatacaaaaattaattcaagatggattaaagacttacatgttagacctaaaaccataaaaaccctagaagaaaacccaggcattaccattcaggacacaggcatgggcaaggacttcacgtctaaaacaccaaaagcaatggcaacaaaagccaaaattgataaatgggatctaattaaactaaagagcttctgcacagcaaaagaaactaccatcagagtgaacaggcaacctacaaaatgggagaaaattttcgcaacctactcatctgacaaagggctaacatccagaatctacaatgaactcaaacaaattcacaagaaaaaaacaaacaaccccatcagaaagtgggcgaaggatatgaacagacacttctcaaaagaagacatttatgcagccaaaaaacacatgaaaaaatgctcaccatcactggccatcagagaaatgcaaatcaaaaccacaatgagataccatctcacatcagttagaatggcaatcattcaaaagtcaggaaacaacaggtgctggagaggatgtggagaaataggaatacttttacactgttggtgggactgtcaactagttcaaccattgtggaagtcagtgtggcgattcctcagggatctagaactagaaataccatttgacccagccatcccattaccgggtatatacccaaaggactataaatcatgctgctataaagacacatgcacacgtatgtttattgcggcactattcacaatagcaaagacttggaaccaatccaaatgtccaacaatgatagactggattaagaaaatgtggcacatatacaccatggaaagctatgcagccataaaaaatgatgagttcatgtcctttgtagggacatggatgaaattggaaatcatcattctcagtaaactatcgcaagaacaaaaaaccaaacaccgcatgttctcactcataggtgggaattgaacaatgagaacacatggacacaggaaggggaacatcacactctggggactgttgtggggtggggggaagggggagggatagcattaggagatatacctaatgctaaatgacgagttaatgggtgcagcacaccggcatggcacatgtaccctaaaacttaaagtataataataataatttaaaaaaaaaagaggttctgttttgttgtgtttccaggatttgtttcaagatttagagctccttctagcagttcttgtagtggtggcttggtaatggcaaattttctcagcatttgtttttctgaaaaagactgtatctttccttcatatatgatgcttaatttcactgggtacaaaattcttggctgataattgttttgtttgaggaggctgaagatagggccccagtcccttctagcttgtaggctttctgctgagaaatctgctgttaatctcacagattttcctttataggttaccagtgcctgttctggtgcagggggtaggggttggggggcgcaatgggctctgtgggggttcttagctttcgtggtttaatgctctatttttgtgctggctggtctcctgccaggaggtgttgccttccagagagcatcagctgtggtagtatggggaggaaccctagaactcccaagattatatgccctttgtcttccactcccagggtagatagggaaggaccatcaggtgggggcaaggctaggtgtgtctgagctcagactctccttgggtgagtcttgctagggctgctatgggggatgggggtgagattcccaggtcactggagttgtgcacctaggaggattatggcttcctctgctgagtcatgcaggttgtcagggaagtgggggaaagccagcagtcacaggcctcactctgcttccacgcaaacccaaaccaaatggctagtctcactctcactgtgtctcccaccctctaacagcctgagtccattttcagttggagggcaagatgagcttgaaaatctgccccaggctacccacctcccagctgtgaatgaaagggattggttctactccacctgtggagtctgcacgccagatgtgtgccctcccctgagttctggccaggaggcttctcaccccattcaaattgttacaaacttcagctagagattttcttctccctgtagagttttaccccttgcacctctggctctggctgccctctggatggatccctgtgatgccaggcatggatggcctgctaggggactcagagagcttccagggcctttctgctactttctttgcctctgtatttcactcagctctccacattgactcagctccaggtaaagtcagaaacttctcttgcaaacagaccttcagcttctccagtgggggtgtgtgttcaggagaggagggtctccctttcccacttccacagttggggtactcacagtatttggggtgtttcccaggtcctgcaagagcagtctgcttccttcagagggtgtgtgggtcctctcaaggttgctggtttgttcttgcagtcaatctggagctataattcacaatgcgagcctccacatgctgctctgtccagagctgcaatctagtcctgcctcctgtctgccatcttaaatctacttctgtctcttggatgtattttttcttctcagacaataagaaccaaagactgtgtatcctgcccaaacccgctgccagtaacattttggtgtcatgaatcagattgcagcttctcggtaagaccctctgtgccttgccatctttggctggaggcacccaactctgcttacgtgaggtcttctttctcttgctgtctcactcaccagcccatctccagaaaaattctctttggtcactcttccctctagcagattcctcagttcatcctggtgggcgacagcagaggtggaggacttcagagtctgtactgagtagacctaagtcactgtggcccttttggacaggtggctcacaagggtgatagggcttgagcctaggccattcaaagactggagaccttcatttccttaaccaaagtggacttttccccaataagtctacaccctattatgcttcctttttttctgtggactttgagatggccttatatgctggccacactgtctgtcttgggggcaagtcaacctcttccctgcttctattctgcatatcatgcaacttctttctctgcttaatattgggaagactctgtctccaccaattctttatttcctatcatgaatttttaaatcctgctacacattgagaccaggttttccagtggctcttgaggtcatttgtttgtctccatagggcatctgtatgtggtccattaagagcaactcctacttcctttctagagctatctgcactttggggagaggacaattctttctctgccttttgtggtctctcatcccaaactccctggccctgacagttcttcctctacactgagaagactgataggcaatgtcctcttaggtctaagggctgctgtttgtgagactgtacaaaagcagccttccatgaatatcccttattttctaccattcccacgggtggcagatggattgtcctgtcattttaaatacttgttttccatgcttccccaggaatccacaggagggatgacaaggggactcagatgcaggttttcctctgttcctctgaccatctacattcttaacatatactgggacctacagtgctatgtccagagaaaggaaggcccagttcccttacagctgctggctagggataagatcctcacctacctaaagggatatggagaatgggaatttgagagaaaggaaaaccatttcattgctggaatgctccaaacaaaggtcactgtaagatcacagtgtcaaaggtacaggtcagccagaggccacaggtgcaggacagattaccattagcagagagatgaaggctggtcctggagggaaatgtgggaccagggttagtggtacctggtaatcactggtttattccagaactccaggatgaatgggggatgccctactcactactctgatccaaggtataaggggatcaggaaggaatgctttcagctgggcgtggtggctcatgcttataattccagcactttatgaggccaaggcgggtggatcacctgagttcaggacaaaaccccgtctctactaaaaatacaaaaattagctgggcttggtggtatgcatctgtagtcccagctcctcggaaggctgaggcacaagcatcacttgaacccaggaagtagaggttgcaatgagctgagattgcaccactgcactccagctgagcaacagagagagactctgtctcaaaaaaaaaaaaaaaaaaaaaaaaaaacagaaaaagaaaaaagatgaagaagaagggactctttcctcttccttactcttccctgttctgtcttgcagatagataacggtgtctccatactctgggactgaccccttggatgcatccttaaaatctgcgataaatccaaccaccaaaccctaaaatgaaaaaactaatttttcattgcagaggaagtctggctagagaatggaagtacaaattttaataccattctccggctagaccttttctgccattatcagggcaaaaagccagaggtcccctatttacaaacctttatggcctaaagggaagaccctaatcctcgtaaagcttgtaaggcaaacctcacatcctagctatgcttagccatctcctccagggccctgcatcggccctggagactcctctgctgattcctctccaacatttcttcctccagaagccaaaaggaaaaactacctcctcctttggaggtgaaagagggagaaacagccacccctggatcctccccctatttatcccactcccagacctttggaattggccccactttacaccgggctccttagttctcctctccaagcttgtaggaggtaagtgagccaactgaactcgtccaggtccagatccccttttccatgtacgacttttgacaacttaggaaaaacctaaaaaagttctcagatgaccccaaaaggctcatagagggcttccccaaattggctcttacatttagattaatttggaaggacataaatgtactcctgggacaagcccttttacaagaggaaagacagaccatctgcggagcagcaatccactgtcgaaatgacttacacctggaaaatgccaactaccctggaggggctacagctgttccccagctggaccccaatcaggactacaatgccaaagcgggaatatgggccaggaaccataggctcttgtgtctaatagaggtaataaaatgaagtaagatcaagcctctaaactacaataattagccaccataaaccaggggccaaatggaaatcctatagcctttctgaaaagtctacaggaaacttattaagcacaccaaacttaaacccagaatctcctgagggactagtcctaaaggacaatttacccaagctgctccagacattaggaaaatttacaaaagtcagccttagaacccagtgcccctatgccacaaatcctcaaattagcctcctcagtcttttataactgagatctggacaaggaggacagggctaaggaaaaggagaaatgcagggacaagatgcaggctcaactattggctgctttacaagcccaccagccccctccagggtctcctaaggaccctcctccaggtaactgccactgatgcagaagaccaggctactggagaaggaattttccaaatgggccaaatgggaggaagccccacacagcctgccctctttgtgataagctggagataagtcccactggaagagggactgccctgggatccaaaaggtcccccagttgaacccccatccaataatggccttgagctgaaggggccctccactctggccagcttccaaatcagacatcatcattaaaggaacagagccaagggaaactctggaaatgacaggtagtgctataaatatccttttaaatacaagaactgcctactttgtgctaacctttttctctaggcaacttacccccaaattctgttgggtaacaggagcaagtagcaaccccttcctctaaagattcacatcccctttatttatattgcttatgggactaattactattctcccactagtccctggcaatgtctaaatgcctcacactgcttttgagtaggaatatactttccaaaatgggtatccacttaatatttacccaacatctggactgatatttccccctaatatcccagtttctcccaggaaagccagcagtcctacctcagggttttagagatgccccacacttatttggacaagacccagcaaagaaatctaaccaagctatatcttgagtggggacaacttctgctgtatgtagatggcttactcatctgctccccctccataaagcttgcacaacaatatgcagtacaaaccttaaccttcctagcaaaatgtaaggtacaaagtatccaaatccaagacagagaatttcatacctagaaccaaatatatatacagagagtactgctggctccagaccctctaacaaccaacttgtgtacccacccaggtccttattaaaacctaaagtgatggatctacaaaatctcaactaatcccctcatggaaaggcccttttactgttttcctttccactgcaacagctatcaaagttcctggcacctctagttggatacatcattcctaaataaaaccttgagaggcttctgaacaatcaacaataggaccagcacctgagtattcctgtgagtcattggaagatctataatatctctttcaatgaaattataagtaatgccttcttttctttcaaactaatgctagctcagcataaggtagccccagtactctggatcttattcatggtgggattgcttatgcttacacttggttcaaaaccaacattcccgagtgggcctacacccctccaggctatgtatttttatatggacctaaacaaaataaactgccctgtgagggaagttctaaaagaacttattcaaccccctcacttgtaaacctttttatctgcatagataacacccaacatacaggggatgtgccctaggactcctggggccacaaggaacaggtgtaaccatctataacattacaaattcttaaaaaaggagagctcttggccttataatggtagggctaggggctgccataggattagctgccccatacagaggattcagttatcataaagtcaccctccaaaacctctctacacaaattggagacctaggtcagagaactgggaacagaatctctaaactcaaggcttcactgaattcagtagctaatgcagtcatggacaacagactagctctagattacctccttgcagaacagagtcgtctgtgctgtcatcaataaaccctattgcacttgtgtcaacaatagtgggcaagtagaggaacatataaagagaatctgtgaccacgctaagtggcttcatgactctgggaaagaaaatccctcagcagattccatctggaactctgtaaaatctgctctcccattgctcacatggttcctcccctgctcgaaccagctgtctccatacgtctacttctttttggcccctgccttttaacctactagataaatttgtcttctccaggatataacaatttcaaaccaagttcccaataatgcaggtgatagatgcaggaggcagataagagggaggatccctggagaatctcccgcccgcctgtgcactgcgacgatggggtaaagctaccaggaagttcatgccttgttggggggaaagagcctgggaactttagctcgtgtgtgggggcttggaatccaatctgtgagatgggagcctgctggcagaaacccctctcactttgctgaaagtttttcttttcttgttttccttttcgcccaataaataataaattccattcccctcacccttccacgtgtctgcatgcctaacttttcctggtcgtgacacagaacctggatttagctgaactgaggagcagaaattctgcaatacaggaatatctacctccctacccaaatgtgaagaaaacatacacctgtttcccctggacctggctggacaccaattctacctaccgatgggaccattctgttctgacaattagcaagagattgagacccagaggacaaatacagcccttatttcagcaggaagcagccacagaggactgaccttcatccactagccccaaataattgagtctcacactcttgaggggggaatatgttagggtaggtagataggtggatatgagcagggcaggatagggccccaaggaatgtcaggagacagtcaaatgactgtcattgtgactgtcaggtggcctcttcaggaatgatagatggtcatggctggcaccagggagggggaaatttcctaacaggaaacatcttaagcttgtaggcaacaactttgcgataaaaccctaggaattgagcaggcatgcacagtaaggggcaaaatggcaaagtttgactggtatatgaccttcctctgggggcactagaccagtaaaggaaaattgcccaaagagtacatgtgcataactacaaccaccaaatggcgcatgcagcccctcccagattactggcaagtcactgagcacgcggcgattagccaacagctggcccaaaaggaagtatgatgggaggagatcaggaagaatcaggaaatagtaactttataagagtcctgagccaataatcaggcgggacactcaatctttccagttgcccacttggtcccttccaaatgtactttgcttcaataaacttttgcttctgtctgaaatctacatctgtctctcagctgaatttttttcttccaggaagacaaaaactgagggccgtagaccctgcctggactcacctcccgtaacatttagactctttatttcacttaaatacttgatcaagaggtacatgaagataacaagctatggggctttgcaataataaaggcagattgccagtctgagtttggaattggaatcggtatagacataagattcatgaaatttcaaaaatgacatatttctttacatgtttatgatcatgaaaactagtctttctgtttaaaagaaactacctgggttcctttagtctttgaacatagaactttttttttaatgttacattgatagctgaaacagttgataatcatgttctagagcaggtgagtgttgctatatactggggttgagatggggaaaatgaaataaatgtataaaggatcagaactacagcatcttaaagtgaaaacatcacaaagctcagagtaaatttccatcttgctgttgatttatatataaactgtactcacatgttcagaaggagaagtggaaatattatcttggcttacatggaagaggaaaagactatatctagttatttaaaactacctgttaacttacccacagacacagctctatgtaatgaactctagaatgtggttagtgtcaatgttccagttgtggacggaggaaacagttttcaccaaatgtagttgacaatggctgtgaaacatggcacagtgactagaatgaggtaaacagatgtcataataaccacgggacacctgccttcttcacctctatgaaaatattgctgccttacacatgggcagaggtggagaaatgagaaattctgtccttagacacttcactccaaaacctgccaggttcaagtgctgccttcctgtctcaatggagaatttccagttctactctagggatgaggctgtggtctctccagaggtgggtcatggcctcagtactataggcaggcactacatcctgcagctgtcaatccaggctgataatttgagacctagcagctgatgacattccttctctgcatggcagttgtctctaacaggccagtgcacatctgagccaaagatgacatttttggcatttgcctagacgttgagagcatccactggcttggtgggcaccagttggcaagaagggaaaaccccagccaaggaaagttttaagaaggccacgtgctggcccttcagaagcagctgcattcatagtacacactaggggaggcaaacgtgtgcctgtgtaatctgccttcttcactcagtgggagggaggccagttaacaatgatttcaactctttattaaaatcaactaacacattgctgcacttagatagtagtaaccaggcaggacaccagcaggcttccctaactgcctttttattacaagacctatttcaggcccatcccactttacatctctgcagcatgacttcccaaattacaggcataataaactaacaaaggccacaacccctgcaggcatacagagtcagattacgtctgactgaatctgctttctctattcataaacaacttaaaacagctctttccctcgcgtaagaacctgacttgccaggcacacagtgaaccagcagaagactacatgaggacaatggagatatgggtgagacaagggcaggagatgccttgttcataggaaatgaaaagctctaaagcccaaagaatttcccttaattttttccacgcagttcccttgaggttatgcagctggatgttctcagagctgagagtggactggcttactataaactattcattctaccttcagatactttcaggccctctgttacgatggttgactcaattgttcctcaaaccaaagcttatgcatgtctaagttctctgatcttaaccttttgaaaggcagtaaaatgaaagaccttatgaacttttgtttgtccgtgatcttacttcctccttttaagatagttttccttatgtaaaagaagcatggagtaattgactttggacaagtgacagagaaagggatggatttctaacttaactgttggcatataccttgagaatgaatacataatacacgttttagtataagccacagattcctctggtctgggtacactggaggcatttttataaatgtaacatggtttattgacaaattcagggaattgtttcacattggtcttttctgtcataccagaggaagttttagactaaaaataatattatccatgttttacagataagcaaattgaggtggagtacagttaaagagcttgcttaggtcacatagctagggacaaatccctattaaatggaaaggatatgagactgaattagtttgccatgcagtaattaaaatcacaaagttctgtacaatctccttgatttttaaaagaaaaagttgtctgtttcatgaaggacagctacttacagaatatatgcaatagggttaagttgaaattgtttcaaatacacaaaagaagccattttttaaaaaaagggttctgaaaggggtgaaaatattctgttagtcaacgaagcagaccacaatagtacatttatagacagattagaatttatggaaagagaaaataaattaaaaatatgaaaaatgttaaacataattgtgttacggtggtagaataataggcaagattttttttaacttcttttttcacaatctctggatgcatgctgtttttgtaattagcaactgtgtgttaaagaaataaactacgtaagcagcccctttctgcacaagatggctgctatgttatagaagtctagttcaatttatacacaggtgaatttttctaatcttttattttataaacaacgatttggaaaattcttttatcttaataaaaaaaagaccatagcccttctgttcattgcaggcagtctttagttaagacaatacacacaggaaaaggaacaggttatcaaacatgaaaggtatttagttaaaaaatcaagtccctgctttcaaaatgctcataatctaaggagattcaagttaagctcatcatagagctgtgtgcagtatccttaaactacatgctaatttcaaatatgagagagtacatatatatgtgtgtgtgtgtgtgtgtgtgtgtgtgtgtgtgttttcccaagacctttctccttccctatttaaaacaataacattttgtcaagggaaaataaacaaaataaaatagtttgaggttgacccaaaactctgaatatttgaattctaatttgattctaaagtcagaaaaaaagtctactctcctggtataatacttttaaagcaaatggaatccatcatgcatgaaaaactaatctctgacctttaatggtaattttactgattgaaaaaagtttcaaacactcagttgtgggaaggaaacagacatttgctcacagtctgcagactttggctcagctgacagtaattttccattgattgggagaaaatcatggaaattacatagctatggctggctttagactggtcttatgtaaatttcaaccttaattctgtgtttattcttttgtgtgagtgaaataacaacagagtctctataaaaagatgttactaatatatctgaggtgacctataactactatgcatgatatagttatgtcttttggattaactatatattttatgcatttataatacttatacatgcacagttaaaattcttttaggaaaagcaataaggtactctgttctgaaattgtttctacaaatgctgcagtatgagtttttcaatgacttaaaaatttccatatgaggagaagtgttagaaatgtatttttccaaatgcaggtgggaggacatcttctaagcctcaagccagttctacaggaaccaagacaaacaccgaaaagtgaaataagattaagtctctgcaccatttctaaagcagtgaagcaaaactaccttcaagggtcagtggagaagacacccagtccacagccatagatgctaggatagtcttggtcacatccccagccataccttattgagtcttggtggttgaccctgagctctcatgttctagagttccataatagccaggcttccaaatgcaaaaagtgtgtgtgtgtgcacgcgcatgcatgtgcgtgtgcaggtgtgtttaggcaaattcacttaataaaaatgggatgctgataaggtgagaaaaacactagccagacagcctaaatgaacagtaaaacacttagaatcgtgcctaacttagaatagtgcctggcacttagtctggaaacacaggctatacataatatcaggaaggacatcttcggtccgttaagatatataataactatgttttcagactttatagaaccctgtattttcataggtataagttaccatttatgagaaacccatacacaggaggaaaataaagtgaacaattttaatcataacaacttactgagttttaacttcaaagcgtgtacttatatttatacttatttgatgtaattcattacccatattttgtcagcagcaacttgtaaaaactttaaatgaactactatattgtcaatcattgctttaaaatctcaaaatcatttcatgaatacagcacattaatatatgacaagattgaaaaaagttatataaaatctgattgagggcataatttgttaataactctaggcttttaaaaattgtgaacttagagcaccgctatttccctttcaaatctccctctctcacctcctttcctcctctactccttcttttcttttcttccttctttccttctcattattcaccaacgaacccaccaaccaatcagcaacaattatttgttgaagctttttgttgttttctcattaagataaaccaattaagtaatctattttttctattgataaatttgtttatagaaaataattttaaagtattcaatttctaaagtcggttgctctaaagacccatccttggagaaatccaatgatttcctgcacttaacactgggatgaaacacagggcccagggacattcatattaaacttgaactgactccatctgtactttgttcagtctgtttattgtgcttctattgagttttcattctctcagtctgatttcctttctgctcctgttccaccaacatggcaccctgagggcttttctccatacatcagacatgttacctggcctatgtctttccctcgctccctgagatggcattcttggaacctggcattgaacagggccttcctcctataatgtgtaatgataatcctccaatctactgccctgcctagacaagatttttatgcttagggttggaatcaagtttttcaagcacaacccctgtgacagctaatatttaagggtctcagcagaatttaatttgtaaagaactaaatataaatatacttcttaaatctggcatcttgctcatcttcttgcctttgtgttctccctgttcttttttcctttctttcaaattatctcctgcaacattaagaaaagtgtggaatggaaaagtagtcataaaaagaaagctagagtttggctctgaaatgtctatgagatggtgtgaaaaggcgcctcaggactgaactgtgcctggaaaggcaactttttcttcactatatgcagccttcctgagtcactggtcactgctagcagcacagaagccacagaatgaaaggagagcaagtgctgagtgtaatatgggaattatagagaaacagggagtgagttcttctgttgtactgtatgaccatgtcaccggtccctcttaaaagataatctaaaaatagagtacacgcatgcgcacttgtgcacacacactataaggtctgctcaagtactaggattatttgggcttgaggatttttggattgattgaatacaactttatttatgtatccttgattcaggaataaaaaaatggctaaaatcttttgctacatagcaattagagatttagggataacataatctgaggatgtcttcaagtctcagatatgtaacttagctgtgcaatcttaggaaaattatgcctctttcatgggccacataaattctcaggactaattaagacacactattggcacaataaccagcaaaatgccttagtttggtttttataagtgtgctggatttttggaagaagtccaataactacatactaaggaaaatagttcaatcattttttattgctttagttcttatcattcactcagtattgctggtgattgagggaacataaacctctagaggaatgaactgataccactgcatgagaccaaaggcaactaatcatgaaatgagacagtcctgaagtaactggttctgattctgaccaagcaacccaatgagtagtttatgggctcatgtcatccctttgaaaagcacaaataaagagcaaagaaaggaggtcacacaaatggaggttactctcctgagtttgtcaagaagctcattgggcactccatagttgggaacactggtattctagaatctttatggcttatgggtcaaatccaatgctatctatatttacattatgttttaggcattgcagcatatattcaccatccttttcttcctcatgctctcctccctcagtgatattgggtttagtcacattatgtgctgtggctaacagaatgtgggcacaaatgatactgctttataaactgaggccttacaaagtattgaacatttctacttgccacattgggagttgtaaactgtgccacaaggacacgccctgggagatcactggtccaagaaggagaaacatgaagaacaagcatgaaggcaacctgcagcctgaagcagcactattctgacccattagtaggactatgagcaagaagcaaatgtcattggtattttgtagttgattgttcggtagcattactgtagcaatagctgactaatgcaccttgcaataatagatcaacacagaaaatgtgaattttgtttttctcttggaatctcaacagttctgactaattcaactaatccctaacctttctattttattttgcctattcaagcttgctagcaatctagactgttatcattccttaaatatgcttcatgtagtgtacagtgcctccaccctcgacaattcccatctgtctaatctttttatgcaagattcaactaaaatttttttctttcatgaagaacatcagattctcccactaattctttctgagagagaggcaatttcttctttaagctcttttatctctctctcttgctttattgatgaccatctgtgataaattatagtacccctagtattgttctataccacttattggttaatatatcccttggcatttgaaaatgctttaaggactggaatacttctcttgaatttcatacagaataagcccttcattagttacaatttaaattaattcactccccttgcccccagtctgcttcttctttggatatcctaactcagtaaatgtcattcccatcctcctagttgtccaagccagaaatgtgagtgattattaatccctatttctcttacctattaaccaagtcctgtttagtcaaaacccctaaacatcaatcaaacctattcacctctctccagccccactgacattatcttaaagcccttcaccactctttcctggaatattgtaattgattctcacatgttctacctacttttggtcttgaagatttgcaatccaatttcccacagcagccaaagacattttttttttgaagtgcatatttaattatgtcatttgctgcttaaaatatttcactggctccccactgcagcagaataaagtagaaatttctatgtgacttatcagatcttttatgatctacagtttacctctatagccctatttctgactgactccccaacttatgctctataccttaggccaactaatttttctgcatctccccaaacctaccacattttatcttattcccagtcatttgcacatgatactgtgtctacctgataccctctctctccttccaccaccctttccttggctatctcctcttgagctttatatctcagatcagataacattttcattaaaagcccactctggcattcctctctccctcttgctcaagcaagcatggccaggggcccttcttgcgtgttcctacagcatcctgcatttacatgtttccctgtagcacttatgatactatagtttctgatttacttgtagttgactctatgggtagcctacccaagagccattccttcctactaggcccccagtgaaattcaaatatccacctacccttgcagccacatacttacagggaggtgggcctcagccccagccaccatgagggaaacctgattgtctcagctaatcatgaaagtacgatttccaaggcagtgatttgttaagacatcggcatgtgaaaccattttggccaataagacattgaagggaagtgggacaaggggagaccatctggaaatgattttttttctttcttaaaagaagacgtaaaaagaagatcctcttttctgactggccatagttatctgcatgtaataggtggacctgtgacagacatctcgagtttacaggaacaaaccagaaaactcaccaacacttgaggctggcagaagagaaagatgaaaaagactcaggccgcctttgataatgtcactgagtgacttggagcctcccacctcaggatggctttggtttaagccagttaagttacaactttctggcagttacagctgcaagcattctcactgactgacacatgtctatcttcctcactgtactgattattaatgagaatttatgcttggagatggaactgcaaaggaactaagaactaaagaaaacatcttagaaggctgcatggcatcatggtaattaatagggaaaactttattaatgtggcatcatatagagaatcagaatcagcttttgaggaaaaggatgtagaagtcttctgatttattttctgggccagagaataaaatggaacagtaatagccttttgaaaagctaggtttaagatgatcacagaaatcctactgtaccaaattcagaagcctctagaaaagtgacctaattcagtttctgctgtgctctgccccttgctgttcactttcctatctcagctctggttttacttcaaaagctcaggaacttaaaagggggaaacctaacaacatatttacctaaactctgatcaaagatccaagaaaaggtcaaggtgatagctgaacccacaattatattaaccttttgtggaaacattgaacaatgcagtagtatctttgcttctgcagaatatcttgttagaaacaggaatttcaagaatagccagaaagataaatcttcttgctacctacgtttttacgctttaaatagtaaatgcatagcaaaaggacctacacagtagtgtattaaacagtgacacctttgtatttatcaataacagaactctcaatattcataaggaaatgtaagataatatggataaccaagattattgcttgagcatattctttaaaaattggcagacagttcaagctcctatagtgctgcaaatggaacttattgtatacttatagttacttgtaaaatgagataattcgtataaggtagaagttacccctcccttgaaagtttggtagaacttgtatgtagaattatttgagccagtactattgacagtctgcttattcactaatttctatgtgtggaggggtaggggtgtctaaaattgtaactattgatgcaatctgtcaaattgtataggtctactctagattttttttttaaatgtgttgagtcacaatgataaactagattaagaaaatgtggcacatatacaccatggaatgctatgcagccataaaaaatgatgagttcatgtcctttgtagggacatggatgaagctggaaactatcattctcagcaaactatcgcaaggacagaaaaccaaacaccgcatgttctcactcataggtgggaattgaacaatgagaacacatggacacaggaaggggaacatcacacaccggggactgttgtggggtgggaggagggggaagggatagcattaggagatatacctaatgctagatgacgagttaatgggtgcagcacaccaatatggcacatgtatacatatgtaacaaacctgcacgttgtgcacatgtaccctaaaacttaaagtataataataaaaaaaagaaaaaaaatgtgttgagtcagtttgtttcatttttgtacttttgtgttacaatcaaacttaaaaatataacccatggtaaaaatactgcagctttaaaaatacattattatttttccctctctgtgattctggagccatatagtctatagagtagccccccccaagacacatataactattaaatacttaaaatatggctagtccaaattgagatgtgtcaaaaatataatacacactctggattttgaagacttagtatgaaaaaaataatttcactgacttttaaacttttaaaaatctggctattaataaaaatctaaaattgtatatggggtgtgcattatatttccactgggtagcactgttctaaagcattcaacagctctcctcacattatgccctgcactacagacattgacatatgtgtaatctctaaaacacatgttacaatgaaaaaaagcatattatttcgaaatagatgtgtgatcttgcttggaaaagacacataactttcttgcatttccattgcttcatctttaaagtaaaagggctgcataagatgattcctaaattcctttccaattcgcatatatttaatgacttcatcatttccccaatagattccaaagccagagaatacaattcatgtaatagctcatttcagtttgataaatatttctgaagcatttgtcatgtgccaggtcctgtgagaggaggtaattttacacctaaccatcttccacctttttttagcactattctttattcttggcaactctttgagaaatatctatggaatgaatggacacattattattctgctgtctcatatgttaatacagaaacagaaatacacacacacacacacacacacacacacacacacacactccagactggctgtgaatgaaataccaaaaaaaaaaaaaattaaattgagttgtgattctttagcagaaactcaagtgcccatataactgaatggtctctggatctggtagctaaaagtgctttactctttctgaaaaatggaaaatgcattataagtctaagtaaagagcactccaattttagctgccttggccccttctgaggctttcctgggtcaataattagcaacagagcccaggagactgggggaaggaacaggatgatgaacaagtgcaaatgagctaccttaagaaagcgatagcacaaagcatgagagcactcagaattgtactgcaaagtgttcagattaggcaggcccaaaaatgaaaaaattgaaaattaataaaccagaacctagctgtatgcactgacttaatgagatccgttgttaatgtaacacatttttgcctactacttttgtgaagacttcttaaattattttaaatatttctcaagaaatgcctctccaattttactggggttcttaacgttcttctcaattttctttccaaaagcataagggagagaaatgaaaagatgatttgaaatactagaaagaatgtaggactaagagccaggaaatttggtttctagtcacagaactgctacaaactggtgatatggagttgaacaaattgtttagtcttctttggtccatttcttcgtctgaaaaatgaggataaagctctgtatattctagaggtggataagggggatcaaatgagataatggtaagaaaaattacatttacaagatacaaatgttctataagtgtattttatacaaaattatcagagaagtctcttatgagctaaaatatgataatagcacatgtggtccaagatccaaaagtgaagactaagaagaaaaatatataacaaaaattatatccttttattagaaatagcacaatatccattaaactaacctttaaaagcacagggagcagtggttaattatatagactctgaagacagactagtggaatttgaggtctgacactgccatttactagctgtgtgatttggggcctctcacttcaccttgtgtactgcagttttcacatctgtaaaaagggggtaataatactacatccctcctatgtttgttgtgaggattaaagcacttcacatatatgaaacactggcacaatgtaggtattatataagtatagctgttatatgggagtacattctagaatgctttaaactctaggcacacttcctagctagcatttgatttatcttgtttgaaaaacagcctgtatttaacatatacatatcagaggttggaagtgtcacaagtgtatgttgggagaacaaagaaaagcaacttcagtacacaatccacaaaataatagcctcgatggactctacacttcagagggctaaattagatggtgaaaccaagtacactcatgtagtgccttggtacatgtgtggctttgtgtttttacattttcctcaggtactgaaataatgactaaaaacaccctgtatttgcattgcatttaaaaaaatcactttcacatatattacctcattagaagttgagggtcattaaaagtggacaatgaacttgctttcaccctcacaaatctctctgaggaatcaagtcaattgaatacgtgtacttgagaaaaaaggtgggctttttgccaaatactttctggcagctcataagcctgagcttttcatctgagccaactgcaagcctggaagggtccagaaaagcgactcatctgctcagcagacctcactgcccctttgttgtggtgggcacggtgcctttcacacacagctgttggtcagtatgtggatcaccgactgcatcctccttgcaagaaggccattttggatgtttcgctaaggaatccaagagtgcaaggcagagaggggaggctgactagttggggacttcctccaggattttcccataggctccacccagttgcttcattccattgatggattcaagggtgattttccatgagactacacctaatggaaaaggaagtctcgggctgttcttatctaatttgccaactgttacatcagcattattgattcagagcccccaaatcagggaaatatagaacagatgggaattccctgcaaatgttttcatggaatcatttgctaggaaacccccaactagcaaaaagcataaacatatacctttttattgaagccctgtaaaatctaaccagaatgcttgctccaggaagagtctgttctcagaaatcatgttgtctgatcaagtttacttcttttgtctactcactgaagtccttaaatacattataagagaatatgctaaacatatgtcaaccttcaatcaataagcatagtgtaatgtctaaaggtcatgatttggattatcacaatactttaggtatcaaaatttataaaactgagcatatctatattatctgccaaatggaaccagattattttaaaaatttcttcatcatcttgtgttatttgaatgtaaaaaacctgaaggcaggctgtccttgtctacttattcaacacttagatcagtgcctgaaacatagtaggtattcaaaaatatttatagaataaatgaatatctgagaagctgagtcattctcaccacattgacattttacatttatctatagtcaaaacagtctcaaatttatgaagggaaattaatattagcaacataaaagtgttttcttttgcagatatatgacattaaattataattgtgcaaagtcaaaaagtaatttacaaattaattatggagcattattaagtgagtcaaagccattctataaataaacaatgcagtacttttctaaaggttgttactattatatgtaagcccttgggatgaaaactgggagtcctatctttaatatgttcatcacgttaattaatgaatgatataaacaattcatgcaaacacctcagtcaagcattactcttggggatcagggggctatttcagtaacaagagttaaaagcagggaacacaatcttggatttggtaaactcatctaaatttcttgatattctccaaagagtagcatttaagcaaaacctggtacagaagtgaaatatatagttgaagccaactttcccttggtaaggtaactatgatcctttcacattagtgagatcgtttggaccccatcgctaaactagccccaggcaacctgttcttggtggcattctccccacctcctcctgcacaattctctcctgcagagagaagggtaaaagtcttcatgctctcccactctccaatgatgctcatgaaaatttgttctcaggtaagattctaatctcacgtattcacactcacatacattcaaatcaccaagctaccttcccctgaagtatctgacttactggtttgcctctatgttaaaagagaaaaccattttttttatttctcaaaagaaattttaagacttagctgtcaggaaaataatgtcttttagtttatttcgttttgagattaaaggcctttctctgacattgaaatttcatatgtagactaaattgaacaatttggttatgttgtttcagctacttacaagaaactacacaactcattggctggttgtctcgctgtggcacttctctgtttatgttgccatggcttcctcgacagcctcattcctgccttcgtgtctgacacacatttctgacatcgtgatggatgcctctaccctgagcaccagcacctcctcaagggaaacgcagcctcaaccacactcatcattttctttcatcaaccgcctgtccttctggatcgcccagtttccagtcttgagagctccgttatcactgaccctctgtctcctgatcccattgtagtagttgatagtgtcaactatgttacacctatacaatgttttcagaaatgacctctttttctattttcccctccatgaatttagtttataatattatttcttaaaatacaaataatacttgctcattgtagtttttccctagggctgccattacaaaataccacagacttaggtggctttaacaatagaaacttatgttttaaaacagttccggaggccagaggactgaggtcaagatgtcagtggggttggtttcttcgggagacctctcctcttggcttgtagatggccatcttctcctcatctccacgtagtcttctctgcgtgtgcgcgtgcatcttaatctccttttcttataaagacaccagccttgttggattcgggtctaccctaatgatctcattttatcaaaatcacctatttacaggctcaatcttcaaataaagccacattctgaggtcctaggttaggacttcagcatatgactttgggtgtgacacaattcagcccataagcctcatgttttccctatggtatgtgctctcagtccagaatgacatttcttttccagaatcattttgataatctatagaaaaactgttccacagccacagagccatccttaaacaaagtccctctgttcagaatccaaggcctgttgccccatgttaaatttatgttttcaagttccctttcttgcaattctaataaaacacagtcactctgaatctctcaaacacaggcttctatttcctacttcttttgcttctacttaggttttctgtctccaagaatgaaattatccttcaacattctaatcaaatgctagcttactttagcgccagcttttctcagtctgagatatgttcttccaaacaatcatgattcctggttcttagatccatggcccatttacctggctctcctatttcatttacctttctctgtgggtttcccagttcaccaaatcataagtatctatgaatagagagctccttagagcatggctactgataaatcattcactgagttgactaaatccaggcagtatgacatcaatcatttcagaggcaatatgatgaaaatatttcaaacaattattatttattcttgtttttatcttgtaaacatggcataaatcagattttgatgaccaatggtcagtgatggttttttttggttatttttcttcccaaaacagcataaaatttttactttaaacaattacaatatgtatgtatatactttattgaatttttggtgacatttttaaaaactgagagaaacactgttatttttatccacattatgagatggaaagccctggggtccattatgagtgacatgcttgcctaatgttttgcaagatctggcttcaaggcactcttagataatgtctagtttattttccactctaattcaccctttccaagatttactctgtatttgatataaaaaatcttagttcttctccattttcctgtccttaagacaccttaacaaattgacattaggctttaaaaactatacattaatacaggccaaatgtggtcgacaatttgattggctagcccacagtcttttccaaacttcttcatccttgctatctttattaaaaagaccagaaaaccaaatgttaacttccatctttctgcactcaagatgaccatgtgtcatagttctggctaaagggctgtaagctctggggaagggctttgtgtttcttataagtggggtagatacaactttagctggccatcctctctcatccttcctccttccctctcactatctgtgacacagacatgatcatctggacgtgcagtagccatttgccatcaagaggaacaggccaagaaaattgtggagatgctgcctctttgcaaatggtgataacatcatgcaacagctgaaacacctccggtgccacctacttaaaagtaattcctatttgttcaagctattgtgagtccaggtttctgttatttacaattgaaagcattgaaaactgatataccaagcatatctgttggcagtttgagttttcctcaaaggaaaactcttttgtagccatagaacatactctataatcaaaatccagttacaaatccgcgaatccagttctctaggtcaaaaggaggcaaaagagaatgagttggctgttttcactataaatcactcaccactaaggggatctctgttatcttcttttttttaatatgaagggcagcatttttcttttccctcagggattgttattaactattttctggatatatcgagaagggggaagttacattaaaaattagacagaaaggggagacttttcacttaaagttgtgacaaccttcacttaaagttattgtaacatgcttcttgggaaggaagaaggcataggatggcatagcatgtcaaggtccatctgctttcttttgattttccctgtgcagaatacctcataactgtgatccatagttggcaagaatcccattcatttccaacagaaatccaggaagcttagtgtgtctctctccagttcattatcagagcaattaaaatcagcagttttaatgctgcttaaagggcttcagattttgtaatttatgtagcctaaggcaagattcattttttatggagagattttgattccatcctaaagagttctaattaaagactccttggggagtttttcttgatctgctggatttaagattctttagtaaataacctgctaagattatttctggtggggataatttatctttaattttcatatcctaattatatttcatacatatcttgaaacccaggtcagtaatctcattaagtaaatataaaatagtatataatatactataataaaaatgatgcattgttaaaagatgtatgcaaatctttaaacctgcaggtcttgtttatgaggatccaaagctgaaaagtctttactgctacttatttgaataatagctaccttcatatgcttaatgttaagttatagggttttcttttaggtactaagtttcctcataaaaggcatacaatcattatatctctgagtgtttttaaatttaatagtttttttaaattggagtctgatagcctttataggattggccacttgtttgataatatcagtgctaagggaagaaattaggggaaaaaagttggaagagaggatccagtggagttttttttttttttttttttttttttttggagatggagcctagctctgtcacccaggctggagtgcaatggcatgatcttggctcactgcaacctctgcctcctgagttcaagcaattttcctgcctcagcctccctagtagctgggactacaggaacctgccattatgcctggctaatttttgtatttttatagagatggggtttcaccaccttggtcaggctggtctcaaactcctgacctcaggtgatctgcccgcctcagcctcccaaagtgctaggattacaggtgtgaggcactgtgcccggttgatctagtgaattttatttgaagttgtgtttgtagtgtaagcatgttgattatacgtatttagcttttatgttagttgtgagtatgtacactgggaaaactagtgcctcccaaccaacccttggtaccaccattgttttacttaggtttgtagagaaagcaaaaccatattaatattggaacagaacttgaagcgggtcttctcctcacctccccattcctaaaaaaaaaaatcatttttatattctataaattaattacattctgtgtgtctcttccatggaagagatcaacctaataagaataacagaaatcatctaatccttcccatttcttcttgaaatgttactggtacatatgtttttccttttcctgaaacccatttgcctctgcttttcacttggctaattcctattcactcctcatttttcagcttatacactacttccttccagcagccttgatttcccatccatcatattaattggttctctcctttcctgggatctttacttcttcaatgcattttatctaattatgcatttaatcatgggctgatatgtttaatgtttttcttcgctattcctttggaaggctcatgacagcaggaaccatgtcggtatgtttaccactgtgacctcagagcacagtccagtcctggcatagtataggtgctcaataaatactagtagtgaagatctcagattgctttcctgtgcccagagcatgggaaccaactccaagaagcaatagcaataggagacttctgacagtaaaatctccattttgcagaggaaacagctatgaaggcagaaagtgcccataactcaggaaaagggaggatggcaaagaactgcatctatttcacagtcttgctcagggtcatggctgtggttatcaatctttgcctctaaaaatacatagtttttgcccctatgggtggtcactgcttagtcactgcaatggatttgaactacacaacctacatttatcacttttacccatttaagaccaacttaaaggcaaaaagaagtaaaagaatgatgaagactttttttttaagattctgcagtaccttcataagtgtctccctctcagggatgaagtaagaattgctcctttaaaaagtgtctttctgtgaaaggaccggaaaattcctaaagatagaaactaaaaagctagatggcagcagactgcctttcatgtccctatcaatgaatagattgctaactaacaatcaggggcattgttcatatcaataatataaatagttcaaaagactccagaaataagttcctaaggcactcccagccatttggaataactatggcttggaaattttcccatctttgtaattttgcaaaaaatgatctagactagaggtctataactatattcagatgattcctattcataaactgagaataaagaacagaccaacttcagtaacagtgacattgctgggagaataaattggctcaagaagtaacaacagcagcaaaacggttaaggcacttcaaggtaatcaatttagctctatcgctttttgctgtgactctgaaggaagttaattgaatctctgaaagtagtatcttgctgcctggaattggtacccacaagcttcaaataaactattccatgaagtttaagctgtccttgacagaaagaagggcacaatcagctccaagccattagggaaggtataatttcacaaggcaagacagccaaggaaagtgatcctcaaagggaaactttcgtagaaaaaattttgtactttcctgtccccatccatcagtaacctcaacagagctatttttggattgtttccctttattcctattgatgactattattatatttttgaaaatgtttttgttaatgttgttagaaactggtaggttaatgaaactttagccatggttgttgttgttagaagcaggtgtaattaataaaagtttagctgtgaaggccaggcatctcagggttcaaactttagcttattgactactttttaagctatgcaacccttagcaaactgcttactcacatgacctctgttctcacagctgctaacagaagtggtggcagtgataataatgttgagaattgttttgaggtataaccaaattaccatggaaaatgcctagcaaaagtccaggcttatagtatgagctaattaatatatcaaaatctcattcctttctttttttggctttcctttcttctacggccttctccatcttccaagacccagccttagtagcagatgatgacttgggtctcctgcctaccaagaagcccagtgcgctggcttcctgacacaagacatagccctgttagggagtcaggaatctatttactcaatgttcagttcatattagaatgcaaatgctcttgcaaataaaaaacattaactcatgtctaattgcttatctacactttcagcacttcttcatttttttaaaattttactgtgagcaggctctaaaaagagaatatagcaagaacaaaggttttggctttgatgaggaaaagtgtgtggagagaacacaaaaagaggagaaggatgaaggaagaagacaggaaggtctcaaaacctgagctcctgcagcagtcactccactgaactagcccattctgagcttgtccagttcttttgtaaaccaagcttgcatgcttcttaaattgtcaatggttagcttttcatggttcttaaaaaacttaaatttttaatgatgctggtataagtgaaaggcattcataagttcccccccccccaccttttttttttttttgacacggagtctcgctgtcgcccaggctggagggcagtggtgtgatctcggctcactgcaggctccgtcccccggggttcacgccattctcctgcgtcagcctaagttcccctttttaataatgaaggtcataaataggagcagtcaacagctaacatttttgcagtatttaccatgcagtagacactgtgctgggcactgtacatgattatctcacttaatccccacaaagccttatgagctattattattatttcaatttacagataaggacactaaacagagagagaatatacagctaccaagtggcagaatcagctaataggccatgtgttgatatgttctgattgcagagtttgatgcctctcctgggtgaactcaataggaccagaacacagttctactagaacatctggtatgatttcacaatgtcacgttgtttttgcctttgaagtgaattggggtattctgaatgggcatggggacattttaagaggtcatggggcacgagattaaacctacaaatgtcatgggagcctctccatcttgtgaaccctcttactaaccaccttcattcccatttaggcttttacaaaacacatgactgtaaactgattttctttggtagaagagaggaatgttgtggagaaaacacttgaaaaagttcataggttaaaaaaacacaagaactacttgtttcatacatggttttatgtaaatgtcaaagataacctctcaaatattctttaagtttccactaatatgtgatatcccaaaaatgttgcctcccgtgataatatcttgcattcttctgttattccatgaagcatatcttacttggttctcacagccaacaatcaactgaggtaataaggaaagataaccatagccctgctttatagaggcaaaagtgggatctcatgctatatggcacagcagaaacagaatctcaaactagtatttaggcccctagtcccagccaataacaagtttcattagcgcaaaagttctttacctacacacagtctatggctttcttggtgaaaatagtattcttggtgaactgaattttgcacaggaaacaatggactcagcatctcatattcttgtttagtgtatcttaggaatcatgtgcatgtccagtctaaagcagcaggttgtctaaagagtgttcggctaggcagtgccgaaagactgcacgtcattagcttttgaaagtcattaccattaagtccatgtccctaaattgtttctttctgtgaggaaggcagaggatcatatttgaatccaagatcatcgaagtatggtagacatgaaaggcgtgtggttagggcactagcagaactcaagagcaagtatgcactttccaagttcccagggggcaggctgatggcagaaatgtctaatttgaacaaaactgctaaataacttgcttttttacttaaattcctacaaaaatttcccactgctatagcaactattaatgaaagtctgtttttatgcttctcgatgacatttttagcataatttagagaaaaaacctcagaaaataaaaaaagtaattgtaagacatatgttatgaaaatatcttatgaaatatgttatgaaacttttgttcattatgtaaccagtgccaaatttgcaaccatttaggtctctgatggtgataacttatttatcttgtcattacttttccaaatcccaagtcctacagaactgtagcttcaactagaagccaagccctacctttgtcctacacaaaaagagacctagactgtgagcagcctcgctacagatttctttgactccctttggatcacacactatgaatataagaataaccaagacatgcatccaagtttatttttaaattctagttttgctttttctgatgtagcaaaaagtgagttatctgagcatcaaattacatattttcctgaaatattttatattttctcaaagccattttccttagtaactaataatgagagatgatagaaggcaatttaaggcatctcagcatttccaaatagcattctgtctaaggttagtttcagcatgcaactggtgataaatggcatatagatgcatgtgcaggggaggaggtgttctgtggcaaaagaagtttgagaaaaagattttaaaaagttaaacagttttttagcaattctcagtgcctttaatatgcaaatcaatgaatcatgtttaagacggtaacgatacatgcaacatttcttaaaatgatttaagtatagaaccattatttgcagagcagttgcagggaccagtgttccatgggcacacgttcggtcatgtgggctcaggagtcacacagacctgaattcctattacagctcagaggagctgtgcgtccttgagagaatgattgaagcacatggtaaatgttggtgtcttagcctcagtctcttgaggttaacaaaaggtcactgaattcaaaaatactaagaaaactacattatattcttgacattcaaatgcatcttcacaaatcccctaattcactaatatcactctagcatttacttttcccctagaaaaatttagtgggtttttttgttgttttgttttgttttgtttaaaaaaaaaaaagcaattctcattggtgcattaatccctgttgctttacaggaatgtgttcagtcttctcaccctctctggaatctcattttcatcaacagcccctatttgctaatgttttaattctctcttgatgagcacttttgcattgactggcacactctacagaaagttccaattttttttccctagaaacaagcacagagtgaactacgatggacttgctcataaaatttgatctcatttatcactttaaattttatccttttaaagaattaataattttcttagctgtttttgcgtagtgtctactgtctagatcaacgctgttcagtagaaacataatgtgaaccatgaatgatggccacaacatgtaattttaaatttttaaaaagccatattacaaaaagttatttttacaaccaggtgaaattaatgtatttactttttacttttgtgggtacatagtaggtatatttatggggtacatgagatattttgatataaggcatacaatgcctaataatcacatcagggtaaatgaggtatccatcacctcaataatttatcctttgtgttacaaacaatccaattatactctttaattaaaaaatgtacaataaattattgtgactgcaatcagtcttttgtgctatcaaatactagatcttaatcattctatctaaatatatttttgtacccattaaccatctccactcccacacccctgccactcactacccttcctaggttctgataaccatctttccactctatctccatgagatcaattgtcttcatttttacctcccacaaatgagaacatacaaagtttgtctttctgtgtgtggcttatttcacttaatataatgacctccagttccatccatattgttgcagatgacaggatctcattcctttttgtggctgaatagtactccattgtgtgtatgtaccatattttctttatccgttaattggctgatggacacttagatacaaccaggtgaaattaatttaaatatgttttatttaaccctatacacagtattagtatttaaacatgtaatcattatgaaaattacaaatgagaaaatttttactttttttcacactattatttgaaatcctttgtgcatgttacattaccagcacatctgatttggattagccacagctcaagtgctctatggctactagctctcttgttggacagcacaggcctagattagcagtcagcttccttctgggtggcatttttctacacaggtacaatgtgtttatcagttcagagttattacatttgcaagggagggtagagaataatgaaattatattgtgatttgaatacttggtggtgcatgggtcccttcaatagtttggtaacttaaatccacacgagagctccgttgtactttggatcaaattactccctgtcatgaagcatcagagtcccttataatagtccacaccacaaaagccaagggatttttgtaattgttttacaagtaggaaaagcaataacagtgatttgaaatttttacaaagttaaattctgtaaatatatgttgaatacaaattgtgtacttgacacttggctagttcttaacactgaaagttttttagatatgagacatccaattttcttggcaaaggtatgtatgtatatataatgcgtatgcaaacacacacataatatatccatatatatccaaaatacatatatatgcatgtatgtatgcatggcgtaactcctatctattttacagggtcacttggttggtgattatttccttcttttcctttgaatcatgggcactatagaaaagcataaaatcagtcttgtttcataaattaatttttctattcaaacttgcacttatctttgatggaaagaaatgtatagcctattcttgtgaataacgctagctgatgtgagctgactgtttactctatgccaggcgctagtttaacggctatatatgtattatctcatttaatacttgaataactctaatgatgtaggcgcagaggcacctgaaacagagcacacttaaggaatttcataaatgtcatacaagctgcaagtggaagagccatgatttgaactcaggaatttctgctcaatcatgaagtgaactactcactttaaatgcatagtattctaacactctctttttagataatgatttgttagctaacctgaattaggtccttaaaagcaattctcaaattatgattttacatatctttgaaggtcttaacggaaaggaactttgtaaagatagttttatacttagcataacctctcattttattttccttcaagacaaatccatgaaaaaattcagcttcattccttatctctgacaaataccagaatgcacaacacatggtgcctctgatctgtatcgtttcccctagcgcttgcattcatctttgatgttgatattttgtggtctagtggctcttgagagaagacaattacctatctcctttgaaccataaattaccatatttggagttgcttcttcatataatttttactagtcctttttatttctctcatatataaattgaaatgttgaaatgatgagatctatttttaaagtacataaattttggggaggaatgggacagagtttaaattgttgacaattatacataaaccagctgaatcaactgggcaagtaaacatgggcaagtaaactgggcaagtaaaccttcagtttcacattaatccatttgtgtgtaggcatcagggaggtctcattcttgtaaccccagaatataaaatataaagtcagaagtagtcttcattttcacacccctcctcttttcaaaaaattcatttaaaaatatttaactgacaaacattgcatacatttatagtgcgcaagatgatgttctgaaatacgtacacattacggaagagctaaatcaagctaattaacatatgcattaactcacatacttttttgtggtgagaacatttaaaatctactctcttagaaattttcttttttttttttggttttgttattatttaaagttcagggatatatgtgcaggtttgttacaatggtaaattcgtgtcatgggggtattaagcctagtatccattagttatttttcctgattctctcccttctcccaccctcccctctctggtatgctcctgtgtctgttgttcccccctatgtatccatgtggtctcattatttaggtcacacttataagtgaccacatataatatttggtttacaatacattgttcttaatgatagtcaccatgttgtacagtagatctcttgaacttattcctcttgtctaactgaaattttatatcctctgaccaccatttccccaatccctcctgttcccatcaccccctggtaacccccttctattatctgcctctgtgagtttgacttttttagattccacatagaagtgagatcatatacatctctccttttgcttatacttactagctttcagccagaagaacaatgttagcaaaagggtcacttttgaaagctgaccaacccctggttaaaacaacatatatcagaatgtacagcataaagtttaaggcttcataagtctagcagattatatactcaatatacatttgttggatgaattattgaattggatataagttcacagggacattgagctattctttgatatttcctgggcttggtgttgatttcatgaatgcatgcttgatgtatgaagaaatatttaggcacatatcttggatcatttacaattttctcatacctccataatgttatttctgtaagcttaaaaggatattgtaatatacagtccatacactcaatttcgaatgagaaggttgaggacccatgaagttaaggtaacttgtccattgttgtttaatgagccaagacaaaagtggaaatctagttcagccggctgctgcccttccatgcaaaaactggtataggtcatattatgattaccatttgaatgcaacctaacaaaatgttgtggtctgagacttcatttatgataataatgaaaatttatattaaaagcaagaaattacattttgcgtggtggattacacagtacatagcacataaatgaaatctggaattggatttgaatatttaaaagtacattatgccttcatacaagatactaaacgttttatgggggaagaggtttttcacaagggttataataaaaatactttttatctatgtagttgttccttagcagttcctcagtagttcttagtataaccaagaaatactaaaagatgtattggcccatgccttcccctttccccaaagtttactgtcataatggtaaagggtgagcgaaaaatgcttgaaaagcagcccatgatcactgaatgattccatttttagcacaagcttcatgatatgaatcgagtgactcttacgtaaaaattacatactttttctttttttcagagatgaggtctcactctgttgcccaggctggagtacactcctgtgatcacattcactgcagccttgacctcccaggctcaagcaatcctccctcagcccccagagtagctgagactacaggcaggcaccatcacaccctactaatttttaaattttttgtagaaatggggtctcactctgtagcacaggctggtgtcaaactcttggactcaggcgatcctcccacctcaccctcccaaagcactaggattatagggtaaaccactgtgccccacctcgtatgctttttcaaatttcacgatgtgaagtatctgtctggtaataaagtgatatattgtttcacatcatgaaacccttagaatacgtttgatattgctctaatgtttacttatgttccctcatatgccacaaagtagagagccttaagattggattttgaaagctttaagaaatgggacccacagttatcacacatactaaatttttcctgacatcatctaataattaatgatcacattttgacatggtacaaactgaaccaggtcaacaaactttatatgccagaagccggattgatatcatcaatcagttatggggagctttggagatgacataaaaatgaggaatatatattaccggaatcttaacattaaaaagacataatgactataatgacaaaaaagaaagaaaataaagggaaaaaaaccttctttaaatgcatgggtaaacaaaatcttgaaaaagcaatacacatttattttagcgtgacttacactgcctatgcatttactagtgtttttcaacaggttaaggtggtttaggaaaagtccaaaacatattttccaagaaataatgtacgggaaggaaaacctgatttaaagtgagcacgggatatatagcaagaactcaaagtacgacatggaaattttaaaacagaataaaagattatttattggtttttgctaacaatgattactattggtttgaaaaatgaatctggataaaatgtagaataacatcacatatttaagctgcatatggatcaaacagggaaaactctatttctgcatatcagatcgtttcttattttagtcacttaattcacagttacatagtattcatcatgaggagaaacagacagagtgtgaatggctcactgttacccacactattcctggaaaaacaggtcctaaagattaaaagactcaactgcataaataaaaggcatgatgacattgttattacaggcaaacattttttaagatgccatcactgaaaatggatgacctatactttggtaagaatgcagagaactgaaacatcactttgggggcgacataaatgtggcaaccagtatagaaacacatttggcaatatctaaagacaaaggcataacctatgacccagaaatcctacctcttgggatatacccaacctacgtgtatgcacaaaacactgcaacactacatgtacatttgtttactaagtgatatatccaataatgttcataatggctctaattcataatggcctaaaactggaatacttaactatccatcaacactagaataagtaaattgtagcatattcatttggtgcaatactaacaaaatgagaataaagaatgcacaaaacactatgaatgaatcccataaacacaatattgactgaaataaaataagagtttatattgtataatttcattcatataaaattcaaaagtagtcaaatctatgctattggaagtcagttagtggttatcttcgggtgcatagtgactggaaagaagaataaaggggtccccttgggagctggtaatattttgattttgacctagatgttggttatatgagtaaatatggctaagcatttttttctctcttactggcacattcacacccatcattttataccaaatagatccttgcagagtgctaagggttatctataaatagcaaagaaagagaatcctttccattttaaccaacatgaggaaggcaagactgcgagacttttttttttaagtcatgtagtgctaaaacaaacaataagccttttaaattcactccaaaatacaggataatttgtttcccccaccgataataatttcttctttccctttcttggcattttggtgtgtcagatctccctaaggtttatgttgtctcagtttacacggatttgctttaggaaaaaaacctgacgttccttgtatgagtatctcatccaaggggttgaaaagcagcgcatacaacagaagttgcacaaagccgtccttgtcatcttccacacaggaggacagagaacaaaaacgtcccaaccagtgagtggcagtgccactgaggacctcctgaacaactctactcaaagcattttgaactttataccaagaaactgaggaaagttaggagggaaaatatatagtccttttctagaaccagtaagatgtgagataaacaattatttgagcgatgaaatgttttcatcttttagttcatctgagatcagggcagtgatacttcatagaacccacaaataaaagcttttcgtcaggtacaacctgaagatggcagaaggagttttgttgcttgtttttttcctccactaaagtggccactctttcactagagaatgtactaacgtcatcaaattaatgtgattcttaaacaggacataaatcttccctttggatgggaacacaaatctgattcattaactttccattctttatctaaacactgccattatgtgaaaagaaaaattcctgaaaatcaaggatattttgcagttaaatccctcctcccagccagtctattttgttaccctatataaacaaactctgccattacattcctttatccatagcaacttccagtgggtaatccacaaatcaattaaaggcaagttaattgccaaaaagggatcaagtgacaagcattggaagcatatttatgggtgctattctcaaaatctgtgtgtcagaaaagtttcgtccagctagctttccttttaatgcaagatttaaaatttgtattatttctttgaaaataaaaaattaatctcacagttattcttagcttaaggtgtttatgttttgtaggcagacacagacacatatttcaaacaaaacaaggttcctactataggactattactactgctaccgatttttaacttccatttttctttgctttagtattttctacgtataaaaagttttgagatagtgtgaaacaatgtaatagaaagtatattgtaaactgctcctcttccccctacatcttcttttcatcttcctccttgttttactttccctcactgtatttttataataacaaagaagcaaaggtaaattcactcaagagactggagactgaaaacaagtcagtaatgaggtcaatatttatatggttccattgaccttgtgcagttctgagtttcaggcctagaactacaaatgtactcacagatgtatggaatggatatgcttgaacttatatgcaaataaattatcaatttctttgtaaaggtttccctggcttccccaagcagaacctctcatctcagtctctatttattttatttattgttaacttgtttattttctgtctttctctaccagaatgtaaacttgatgaaagcagagaccgcatccattttgtccctcactacattctgttacatttttaggagtatttataagtcagttgttaatacccaacagttattaaaaattaaattacataaaaatttttaactataattaaacaaattatattaaaaacaatggaaataagtattcaaaactcataacttctgaatgatttggctacattttgtattattatgtttttggggcaacttatatctactgtatctatatgatagaaacactgtatagagtactatgtctatgtatctcttgccaactccacatttagtgacctctgctgtttgaaatgggcaggtgagagaattttttggcacagaaatcagcaaatactacaaatagtgcccttcccctcccccatagagagctggttgtgaacatttaccacctgaaggaataatcttttacattctgttctgttcatttttgaatgtttaattcattgtcataacaattttagggttttgtttttatagagtttatttctttagctcaacacaaagcttatctttttaaagcttcacttcaaagctttttttttttttttggaatgtggcttacatacttgtcccctttgaactgtcctttgcatttgattggcttaacataattacagtaatatatatttactctattcacaatccatctttcctctttatcattttagtttttctcttccaaatttacactattaccagctaatgaattatataatttgagccatgtgccatggctcatgcctgtaatcccagcactttaggaggctgaggtgggaggataacttgaggccaagtatttgagacaaacccgggcaaaacagactctaaaatatatattttttaagccaggaatggtagggtgcacctgtagtcctagctacccaggaggctgtggctggaggatcccttgagcctaggagtttgaggctgcaatgagtgatgatcatgccactgtactccagcctagatgacagagtgagaccctgcctctaaaataagtaaataaaataatacattcagacaagttttaaagtagcatatagtattcttcctttgccaatggatttttcctttgctctgattcaactctgtgtgcttatataacccagccttacggaaaatcagacacctctcttcagacccttgttgaaattaaaaaggcttgtcaattatagtttgaaagtagaaaaaataatggaagttaggaggagggagagccaaggtagaaggtgggtatatgactgtggcaaagaacatgatagaagctgaggcctccagaacaaggagtaccaaggtaaagtgtatagaattgaatgcttcctcttttgtaagaagtattccttatttgctctgcccagatcagacaggctttgatccagctgctcagtcaaggtactgtctcttaaaatcacttgatgggggctcatccacttcatgacttaaggacaaatggcactcgttgaaaatcataaaatcaacattatgaaaataaatagtataaattttataaactactaattaagcataaatattcatacctattacccattcaaaaatggtatagttttaactatagtgaaaaccattaacacactgatgatcagaaatatccacagcatgattataaacccttggcagtttggagtgtcttttcttcttttgtcaccttgatttttttgtacatctcctggcattccacatttgccagagctctgtgctggtccgtagcctgcaggccaccttataaaaccaatacctttatatttattgcagagtttgtaatctttctgcctgtggttgttccatgtgctgtcatgataatacagaaaacactcaaactgtatctcccctctctatctctgtttctagtctacattgataattgagcagattcttttgaatgtttgagatggggctttccttcaattttgaaaaaaatgcatataatgcattctacaaaaatgttgtttacaaagtggtacttccttacaaaaaccctattgtagctgttgtagcaagtgatttttagacttgtaagtaaaatgtctgaacataattttacttggataagtctttctcttattcagaaacctgtccttccatggtcattgcccaattatggctcttatacactctcctgtctgcaagaagtgtgctctgaatcattcattcattttgctgccttactgaaagcactgaattagatggcatatgtattgaagtgaggggtgggacattggaacaaagattttcacagaagcacacagagccagggttctagctctgaccaggccgctatcaagttgcatgaccctggggcctttcaaggtcttcaagctcttcaatgtaagacaaatgagtttgaacaaatgaaccatcaggttccttcagctctaaccccctcttcccatgaatgtggcaaaaggaagcagagtatcctcacacttgccatgaatcggaacacatttgctaataggttcattcattcaatacacaaacgccaagcacctaatatgtaccacacactcttccaggcactggccatacaaaggtggaaaaaaggacaaaaattgctgccatgtggagcttacattctattattaataatagctgacatttattttagtgttgtctatgtgccaggcactttacatggctaacacacttaatcctcataatactccattttacaaatgaggaaactgaggcacatgaagtaacttgcccaaagtctcatagctataagtgataatgtgaaaatgtgaacctcagcagcagtgtggctgtagagctagccagctgtcaatcattcctgcacactacatttccaaggtgagcctgggttgtatgtgcaagttgcttataaggtaaccatttataagccagctctattgtactattctgtgaccaagagtggtaccaatgatgatagtttatctgaaaatgtatttcacaaaagaagcttcacaaaatttgtgaaatgttagtgaagacttggaaaatgctatgaaagagttggcaggtagtcctgcattcacgtacatgctttcatctaatctgcacaacgaccttatgaagtagatattttaattttctatttatgtacatggaaatggctcagagaggttaggaaacctgcccaatcaagaaagcagcagagttggcactgaagctgggtctgtttggctctagagccaaagttctcctcctataccatgctacctcttcctacaatgtgcaatggttgttagtagtattgttattcttagatataaatgttgtctataatttctttttgtcaatttagccaacattactcacaatttgaaatatcattaagaaacctagtttaatagtcaagactatgccagtagaataaatagacatgacacaggatggagttgacctctcgagctcagagaatcttctggctcctctgaacagctggccaaggagtaatatttggcagtaaaatacaaccacatgaccaatgtttttggccagatgaaatgagccagatggaagcccatgaagcaaaagccaggagggggcagaagcagacaatataaaataacggattcattttcctttttcttctttttaatataaaaatacctctattttgatgcttttgcttagcatttctttaaaccaacatcaattaggttagaggacagtttagatattatttaacaagtttatattttaactgattactaagccctattctataacaaattacgtggtgttctgtcttcagagaaaaattcagagttaagtagaggaagatagtacatctgttagaacaatacctctcattatggaatttttttccttgtgtgctgataataggatctggtgaggaagctggaggtgggagagggaccaggagtcctggttctaacacagacttccagaattcacacctgtgcaggtttcttaaacttgctctgcctggtttcctcatttgtaagataaaggtaatgctagatccacctcccgaggctgttttggaggatgacatgcatgagctaatgcatgtatgggattgggaatggttcctggtgcatagtaagtgtccaatacaaactagctctactgttcttactttggactttctaaccacatatatgtgtggtctctagtccctgaaccttcaattcttcttctcttatttgatactaattacactcatctttttcacttaccctaaagaattaagtgagatgagctgtggcacactaaaaacaacagctgtcacatctgttacatctgaaaagctttgaaaactaaaaagtgctatgcaacaggaggtattcttggggtatgcagaaagttacatcccagtgtattgattcactggtggcattcacttcctttctaagatgtgggtttgagacagctttttctaatgggaattgtgcagtttggttgggcaatcactgatgtgctaccactcaggttttggtagtagcaaagagtagctatgagaccacactctcctatgatccctgttcatatcagctactatacaatttccagatcaaagttgtagatttggtctttacttcctaataatataggaggtaatttagggatatctagatcttcttgtttgggcaaatattgctttatcttttcatagcccagataccatttgtacttttgtttgttgatctgactgtcattaatccttccttctactgttcagtctatgtcatatcaaataaatttactcattagaccttctacacgaggtacaagcatgcacatatgtatttaattaatcacctgtttggcagctctgctaaaatgctgggaaggaaaagatgttgaaacaattggcaaaaatgagatttggagattttctgagaatttctatcccatgacccctattactataaagggcaagaaaactagaagacactttctgtttctggcctgtggaatgctatggaataatctctgccctacattcaaatgtaccttgagtgactttctcttctatttacatagtacctaccccaaacttgtcacataaaatgttccttttaacatccttgtgatttgttctctttggaagacagaatcatctcaagaagagtaattttctatttaaagtttccttgaacactactgtagttttaagcaataatatattttaaatcacaaaattccctagtgttctcttattggagttgtcagggtccacaggcttgctaaatctttgctccttgattctttctttacttcccagatcgtttttccccatttttttttttttaggtactatgtttaaacaaccaatataaacttctccacattgttttcttgagcacatcattctcctctttcttctctataatacttgggaggggcgttgctctaaagtaattaggtgaatctttaaacatgtgtgccagaacctaggcagataaatcagcaccttgccctcaaaattagtactcatctttgtaagtggtgccctaatgctaacactgatcccattactgaaaacatggttggcaatctcttctgggctcacagagaaaaagtaccttccttattatgtaaccctctgctttctctctttttctcttcctcactcctccttccacggccctgctcccctcctctcccctgcctttccttccctctccctcttcttttctctttcaatccttctttctgcctcaatcaaacttaataagctatatattaatcttttcttataaaaatgtattttacccacataagataaaaaattgtcacagctgaaaaactttcacatctattttgagcattgtaaaactgtttcagattgtatttctcaagagtcaacactcattaaatgtatatgatttgctattactttaacaaatcagacactaattgaatttcatatcttgtacacctggctttcctttagcctgaatattaccaggcagcaaaagccatgccaaggaaaaatattccagttaaagctaagtgtacccccagtagcatgcattattatccattcaatagccaaagaaaaatgacactacaataggcacatttgaagattttacaagataaaaaatattgctcataaaaaaaattataagggagaaattcaatgaagaaatgttgtccaatgtccagttctttcagttgcttcaataatggaatcagatccaaagcctcttaaaggtcaagataagcttaagttactttcaccgcgtaaggattttgtatattttttaaaaaataagaaatgcaaaaacaaggctgtgacattatgagatattttacatgtttacatcaaatagtttaacacctttaattccaagaatgctatgcaataaaactatgctcttcagaagataattatagcatttaactgtgcgtgcatgtgcctgtgtgtggtgtgtatatgtgtctgtatatatatagagtgactcatggtgcatttgaggtattatggtatgataaaaattttaagttatatgatatgtaccttttttcattattgtcagtacattgtcgtggctgaatgcgtaatctcctttggatacatgagggacctgcagaaatgcaagagccagtggccaactgccttcctacctccctaacccttccactcaattcaacttatgatagatatgatcatatcaagttggctatgccaataaaacattatcgggtgatgccaaataagaaagggtaacagaatactttatcaaataggcattactggcatttttgctgtatgtaaggaaacttctaacctcaaagagtttgcagtgcaactggaaagataaactagaacctccaaacagtgaaagcagcacatataaaaaaattaattattctgtgggaaattgtatattcaaattaagaggaagtaaaggaaggactgagcctctcaagcttccgaaggaaactgactcatgatggatatttgagatgtcattctcacctcttaaacttgttacaaatgaaacttgttaaaattacagatgtgaggtattcaaatacatgaaaaagtcattcttagctgctaatgcttatattttggaaagggtcagaacttgaccaaaggaaccttgaaaaaatatatttatcatatagctttaaattgttacaataccataacacctcaaaataaaaatatctttgccaaattgagaaggcaaggtttataatatatttgcaaactacacagaagagcttaaactctgcatttcgtgagatttctcaaattcattagtcaatcaagctattgcttttactttattcagcagctggagatttatgatattaaggagcttgttatcagatctagtgatgaagagagcctagaagccaccatatgttggaaatatgcacagtaatgttagcaaatcattgatgttaagttctaaatgtacaatttagcatacaataagcatgagaatcacatttaacaaaatgcaaagcacataggaagcatataatttaaaattttcaactaaattttatagctgtaacaaacataacaaataaatcattattttattttgaaataaaaataaatggagttaatacctatacctttagctggcaaattatatttacctcttgccaaagtttgcttatgcattgttatacaaaatttttaaatttgatttctctgattttatagttccctaaaaattccaaggacattatcttctttagtgtctaaagcaaataattaatccttataaattattttaattcaaactttgaatgttttatatgcaggcaaatcagaacacattttaattcagtgttaatatatatttctacataggcttggcagcttccagatgtgctgcatttggtctaaataagaaagaccttatatccaaaattttgcaaacaatgtcacttctatttactattgattaaatagatacctttcagtgctatagattgtaatcaatcaaaaacagaaaaggttttctttctaaacaataataaagaataatcaatcttctctttattaacacctagaatactcaaatgaagaaggaaatccaatattttttaagtgttttctttctttccagttatttggttaaaataagctgattttgttgtaaaacagtcattgacagtttagtgaagtcatgaggtcaagatttttaatatgacttccagaaacaaaagattattaaaatatttagtttgaattcatgacatgtaattctgctgggcaagatgaacactgaattactacctgaaacagcattagtttccattttttcatgtgcatgtgccctgaaacacttatgaagaataatgtagtgttttttttgttggtcaaacaagaacccttccctaacatttagagttgactgtattaagccattagacaagttaatacactgtttttcaggtggcagtaatatgaatgctttgttaagtttgccatttaactctcagaattagcttttaaagttagtcaacttccttcaacttctgcacgtacctacatacccctatttcaaggtttacatcatcttcttggctcttatttaatatattgtcaatttaacaagcattaggagttagaaggtcaacatagggcaaaggcttatttgcaaggggcctaaggcagttaaacaattcttcctagctacaaaaggaaaagagtaatacctgtaggactttgagaaacgcaatcttgatttggctcttgtagatggtcctggcaccgtggctcccagaggatcccaaacaaaagccatttttaaggacgatgccaagatccccaggaaccacgagaagtcagagctggtgcggggctctggggccctgaggccccgcacggagcaggaggcacttgtagctgagtgagggcatttcctttgtgcagtggtatgcgctgacagagagatggcaggctggctgaggcagggctggaagggatggccaggacttcctgctgcatgacacttggcctttgcgacagagtttgcttcactcaggccttatctcataattaacgtgagaaacactccctcgaaaatttgtttttaaatatagccctgattaaacagcatagtcacatgccactcctgaaaagcacaacacacacacacgcatgcacacacaacaaaaggtgtgattgaagtgggtaaacctttatatcagtgtgaactttaaaaaatgtaaacccacagggcttcgttaaaaaattttaaaaaatacatgcctatgactgggtcatctgacaaagattactaaatttcacacagctaactgccaactataattttccttatttcaacttctcttaaaaagagatggatataattcttagccaaccttccacaggatgtaaacaggatttactcgtcttgaaaataccagcgcctctctaaaagtcagtgtgagaaaaaaaaacaggcagatcactttcagaacttttggcagctttgccctcaaggagatgctgcgtcaccttagagagtgaattacaatgcatgactctgacaacaaagatcaattatcttgtccattttctattccctagaaacatttcttaactctgataaatctgttaaaacaactttctttcaaattaaataaatgatgaaagccaaatagaatccttcatatattttatgagtccaggacattttgggaaagcatctatttcaagaaattgtacccaaggagtcaaaggaccctagtgccgtcatcggtcctcaccactgagtggtattcaatgttaacaatgcagcataatttcatcagtctgtatccaaacactgccccgcgggtgacctcaactgtaaaccaagggagagcgccacttcttcaggataagattagagaggcttcaagtgcccaagagtgaatttaaccctctctgaactggacaaaattgaccaagagttgagctcagtgaacatcaccatatctgcaaattttgagacctctaaagctcaatctgtctcttgtacaccaagggagtcttgaatattcatataatttcaataaaagctcaagacattaaacattatgcttgttttcacaacagcatccaggacaccaggggttcttaagaatgctacaggtttcatatcagctttggagacgagtaatagaaaaggtttttacagtttcacctctttcttatcagacatgagctcaaagaaagtgggtgagtgagaactgccctgaacagcagcaaccttggaggagcagagagttcaaaaataaacacaacacattctccctgaatcaacttgcaatattgtaacgcttcacaaactgtctttttgcttttgtatagagatccaaatttcgcatgagcaaaacaggtagccactttcctggtgttctcaaagaaggactgaaaaggtgcttacactgatgccaatctgcccttctggtgtatgaaatgccaccattatcatttaattctttcaaactatttaatttccattttcggcagctcttaggaaatgcacacattcctggcagagttagcactgagctgaacaacttggtgcttattagaatgtcttcatctgagactaaagccagacagtgtaagataactggtgatctgcgtaaagaggggaggagtccctaacagctggtggggtgaggtggcttggtgtgaaagggagggggagggaggccacaaagacaagcagaagagtagaagggatgttgctggcaaagatggacttttttcaccctccaggcaacacaaagctctcattttgtccagtggtgtttaaatttttgtaggtgaaacagcatcactgatttctaataaaagctacagtttatgtatacgactttggaagcagaaaaatattttcattgttatcccaattttactgatagcaagataaaccctatctttgtattcaggctaaagccagcagtatacattttcacaaataattaactgcctttgcttacaaatttacctttttaaagggatattcaaatttaatggatatctaattgataagctacaaggacatacgaataatctagaatgaatctgctagggaatgtccaactttttctaaaaatgtgcaaggaaggagaactaatcttgtctttttcattactgtcaaaaacatttcttccttcttttccccctgctttgtaaaggcagtcatctagaacagttaagcaagataaaacaatggaactgtaaatgtgaaattatgaacaagaaaattgaaactctgcttcattttcctagtgtgaaatcagttacagacacaagaagtgtctgtcaatattaatattattttttcttaaataattacttaccgcctccttttcatttcttccacacagttacacataatccttcttaggttaccaggtctcagtaaggtcatagaaataagctacttatttctgagattaatcatgagcaaaattaagccttgatttcaaatagaaatatcaatattgtttttgaagaactggctaatatttcacagacatgagaatttagacatttggaaaaaataagaaattaaataaaatgattttctaggatgaatctttactagcatttataatacaacaagctgtttataatttttacttcatgggtatcaaagagtataaaagaacaaagaagacatcttttgaacattctaattactgtcatttattaagcgtttatttttccagatgaattttagtaaaagcatgattcaatagcaaggagagatgttccatccctgagacaaattattatgtttacaagttgtgcacactaattttatatgtcctagggaaaaccagattcggaaatctaaacattgctccaatccaattgttatccatgtaagtcctaaccccactaaagtatcagcaaagtgcccgtctcctgccaataacttagctcttatgttctgcagagctctaaataaggcatcgtttttgcctcttgaatatttctgggattttggttccaagattccagatgttacaaatggcaaatttgggtttcggtgtctgacacagaaactcagaatttcctttataggagatagctactatgaataaaaatgaaactcccaaatttgagagtgggataagttaaacgtaatccacataggcattcaattacttgcgcatcaagtctctagttaacaggcatacggaagagacgagggttgagctgaacttcagagaaataagcagttacatcagtggggttgcgttaggttgaaagacattgcttcaggaaaccagagcaggcagatagtgggtttcaggatagtgctgtattttgaaatagtctctggttacagactcaaagccagcagaagttaatgtggaagcaaataacagactgttatttaccatctacttctgatgagggtgtcgttgtaattctatcttcagaatgatacattgcaaaagagtgtgacaaaaggcagtttgataacggggcttgtgtactccttaaaactaatatccattcagtacaagtaaatgtaaaaaatgatttttattacattacttatcaaaatcaactataagttatttctcaaaatggaagtgttgcaaaataataccaaaattttctttgaattgctttcaaatattcattctaaaccttatatgagtctacttgattgaaaggtcaattattccatgttctgaaatgggagacaattattttaagacttggcaacagtaaaacattaacagaattgaaggtaccccatggtcttaagaacactgggaaagcatgctctgtgttttaagcttctacaattgcatccattactcatatatgacccaggacacaaacagacacaaactgtaattaaagagctaaaatcaggatatagactaaaacaatcaataagaggcatgcttaaatataatgataaaaaatcaatatgactatgattgtgaatcaaaatgttttactagacacttaaggtttccatctacattaattttaggattttttttagcaatttggaaaacaactaagtcaagcttttctattcactaaactaacaaagctccttctaaagctttgttggataaagcctacttggataaatgggattgaaggaaagaaatcatggaggaagaaatggaaggaaaagaaaataaattttatgtttattgaatatctactaaatgactgacaagttcctaagagatttttctaactattcaaaaaatatttctagactcaaattctttaaaaatcttgaaatcaatgtagactaatcatttgaaataaataatttgacacaattttctaacaagtgtgtaaaagtcttctggtgtcactgattgtcttgttcaattctctgtatatgaagattttaaaagtcataaaaattctttctatttaatattctactcatgaatacagtcttaaataaaaatcctacttagctattgactggtgagtgaaggagtggtggatataggattacatcttgaaattcacttcctccggaagtcttccctgcctccccataccaggtgaggtctccactgcactttgtacttcctctttgtcaatgtcatcacattagtaatgacttatttggtatctggctcccctgatagacctaaacactatgagaacatggataacatctgctttccctctgggtactcagtgcttagcaaacagtctagagacataaaaaccacaattatgtttgtttaataaatggacaaaccaatattttcagggcatcttaaaaataagatggagcatttacattatattcttatatgtgcctaaataggggcagaaatttcagaacaggtaatttaggtagggcttatttagtttctttttcctatttgattgattaattaatttttttaatcaaaataccattgggcaagttttcagggcagcactgtataggggattagagattagagtcacagttatgccatgaacttgccatgtgaccttgaagattgttgcctgaccttgctgagtttcagtgtcttacccatttggttctcatttgagagccattgcaaagagttttggagagggctgaataaggcaatttatataaaaacattctgaaaactggacaaaattttaggcacacactactgatgtttgtaagcttttgggagaggtaggaaaactatttttatactgttagaaacatctttaagttctaaaaattgccaattggttacttcatgagcatggtaaataggcataccactttatcagtttcaaaaagaatatcagtcctcagttttgatagataacacttttctctatttgaaatctttatatcccatgtgtgtaagaataaaatattagctgttatatcttgaaggttaatcatatgaagaaatgttaatgttttatttgcagcattaaaaccctctaagaactttgtttacaagatctaaaaaaaattaggtggcaagaaattttacaaaaattaggtgatagaatttctcgattgctcaaaaccctaagcttctcctaaatatagaaatgtttctacttattttttgaaaacttatgggatcctagagacaggttgtttaattgggaaaccagttgcaacactgactccaactcatgctacccttattgttggccacgtaccaaataaggacagaaatggcttcttacaactttttagaattatgcttacaaataagcaaaagcagtgatgaaattgctaggctgagaaacaaaatcactcccttgggagaaagaaaaaagacccccaataccaagaatccctaaataaaaatctcatgtgctaaattttggtgctgtggattttttccgtgactgttcaatatcttgctaaatctggttatccatttgttggagccaacagtcataaactttcccattcctgagtacctgtcatcctcagaccccttccttacttggacacttcctgtgcactgaatgagtttgtgaaccaaacatcaccataatgtcgggttaacttttctaattcctcattttactatgatgatatcaaccacttatttggtgtttattctgtggtgtttattgaccttgctgagttataatgtcttatccatttggttctcatttgagagagagccattgcaaagagcttttgagaggactgaatagggtaactaacatgaaagtgttctgaagactctgcacagaattttagggtatactatatattatcctcataataatttatctgtgtgctttgtgttatttttattctgtatcaccactgaggaaacgaagacttacgaagttgaagtaacttgcccctatgatcatacagccaatgagtagcagatctgaggttaaaattgaggtccctcttaattgcaaaatgtatatcttaaccaatacatgcctggaatataagtaaatacaggaatgaaaaaggtcaggtcaccttccttgaagaattaaatcataagagaagttttgaactttcacaggaaaaacaattggtgtcaggtataagatctacatgttacttaatcttccaactcacgagcagacattattatcaccactttatagatgagaaatctgagactcatagaggttaaggaacttggctaacaccacagaggtaatatatgacagacatgtgagtccaagtcagttttgcttatctctaaatcttgtctccattgtggctggcttacctgagatctttcaattcctaattccaggacaaaattggcctgtgagcctggggtgggactgaggctgcaagtaggggctgagtgggttcaactgtggtaactagagagagaggaggcctagagtatagttcagcttgaggaaaagtgatcctgtcaatgtttgtatgcattgtgcactgccctgcactttccctctgaatattctacataggagaaaaatcacaacacttttcagtccatccaaccaaaggtaacaatgtgctaggggctacaatagaaatccagatgtttgagtaacagcaaaagaaaacagcttattgttgttatttgtttttgttttgtaacagaatatataaaacttagggtgccatttactagctatctctcagaaccagctaagaaatttataacagacatttacacaattaggctattattaataagacaattggactggttctggtttttgctttcagtgttaccactaattttatttctactggttcagtggagttaagtgaccttcccaagtttggaaagtgctaaataatggggccttgatgaaaactttagcttacctctaaattttagagaataagccatttttatattagagatttttaattaaacttactaccttaaaaatgtagaagtaaatttgagaacacacaattgttatttcattggtcagatgatatccagtaaaatcatttatccagcaaaattctgagttaaatttgacgtgtttttgtttgatatatatgctataggtgagtcttaagggattgaatttatatttgaaaataaaacaaactttggtcaaagaaacaaaattataactatgggcttttaggtctcaccaggcactggatggtgaaatgcatgaggcagcaagtatttttctaaatattctataagtgaccctaacaaaaacacacaaagctttgaaataaacagagctaaaagatatagactagtaagctactttctatatggaattttgttcaacagctaatcaaaccaaccagcctcccttcctttttttcttcctccctctctcttgcccacccacctaccttccttccttccttcctacctaccttccttccttccttccctcctttcttccttccttctactcacaaatgcatgtttagcatcacctcacatgtcccaggctatgccagctgcctgctagtagtcaatggtgaaaacaattcatgcccaaagagaacttagggctgaatgaaccaaaaactgaaactcaagggtaatacaaaatttgactgggcttaggtttatttaaagtatcagggcaataagaagagaaggaatataaaatatttatagaaataaaaaataacatgagctcttatttaagaaaaaatgtatataattaagaagaaggtagccaggtatgaagctcatgcctgtaatcccagcactttgggaggccaaggcggacagatctcttgagcccaggagttggagaccagcctgggaaacatggctagatcccatctctacaaaaaagagaaaagttagccaggcatggtggtgcatgcctggggtcctagctacttgggaggccgaggtgggagaatcacctgaacctgggaatcgaggctgcagtgagttgtgagtgtgccactgaactccagcactccagcctggctgacagagtaagaccctatctctaaaaacaaacaaacaaacaaaaacaagaagatgatttttcagatcatcaacattaaaaacatatcaaatgagttatttttggtgaaacgccagtttgtaacactggcctgggggaaatatttgggctcaaccagtcaattctttctattctgttaaagtggaaagagcacaggagagatacatttgtacagaagtttctatttcagcccagtgtgggtctaaataagggctccgtggctgggggtacagagatgggtcctggtgcctccttacaaaacttgcaaaccagcaagaatcttacctcggaaaaatatctctgtgatctgtggcagtaagctttttctcaataaaacatatcagtagtgctcacacattaaaactgacaaacggtccctttgaatccttcttatacacataaagaaaaaaataagcatgccttagtagggcaatcagtcctggaatagtccagaatgagctgaattagggatgtctaaaatataaacttgatagagcatataagatctgtttcagtagaatatggttcttgccatgtcaaaaagaggctttttccccccaagatggtattatgaacattttcaaaaatacagaaaaattgaaacaagtttacagtgaacacctgtgtatctactgtttagattccaacagtgacatttaagaaactgcttcttaacaggtgattatcatattaggtgagcaattattcaggtaagactcatctgaatactatttaggattgtgcctatgtttaacctaagttataagtctctatgttttcttctggagtctattttgaagggtggactttgtacaggaaagacaatttgtttttttctatgtcatataaagcacaaaataaatctgaatttctaaatcttactaacaaaaataaattcaggataaaaagtaaatctaaagatatgctcaagattatgagttatccaaatcaatacccatttaattgataaaagctatcaaccatgaagttttattccaggttagtcctaggtaatatgtttttgggattctctgaaataagaaaattgttggtaagttatgagtcagtcaagcacttgggaatgagataattgggagctttccacagttactgatattgtacaaactaaactataatatttataaatcaagagatgttttaataggtgagttgtttttgggttttctgtgggttttattattttgttttcttttgatatattttaaatgaacattatataaatgttaggccttgtttgtcatgaacaagacattgtacttttctataaatgaaaaaaattcaacttcaataactctatttttaatcaattatttctgatgtgcctagtgtaaaagtcagcttgctaacttctcagcaatttgaaatgcaggtcaaggtcagatgacattacaagagtgacagagaaaacctaattttagtctccatgaaactgaagaactcaacacaaatgattactgaacactcagcccatgtttggagttgtacgcttacaaaggcatcctatcaggaaggagcaagtactgcagaatcgtggaagaagctagtgtgttctcaggtgctccaagagctgtggaaaatctcagattcagactatcgactcctcaagtacattcaaagaacgtgtatttgcaactctagtataaactcattacagcagaagttctgagaaaatagccaatacagctataagtagcagaaagtggcattttccaaaaaagttaatgttaatactttgtttaaaagcatattataaaattgtcaatactaagtagaatctaattactcctgaaaagcatttctcatttaaaaatctattcattaaaatatgcaccaaaatgttgatcaagttatttctgggtaatagaatgatagatgtttttaaattttattttccataatgtttatattttctacaataaataaagatgacttttataatcagaataaatgaaatacatgttattaaaaaactagagtagtcaagtttctttttttcccaccaggaattttaggtttttagttgattagacttcaaacaaaggtcaagagtaaagacttttgaatcatattaaattaaagatgtctcatagatattttacacattggtgagatgtaaagtagtgagagagaagtcctgagaagccagataggcatacacatcatttaacacctatgatggtattatttaaaatcaaatcattaatagaatcagcatgatgcagtttgcagaagcataactagagaagacaagaagtctgccttacagagcctaagaagaggcatggcaaggaaaaagcaagagagagagaaagaagcagagctcttagtagatgtaaagaaatccacttcgtgccagtttgcaaggaaattttcctttatgaagagcagagcacttaatagatgtaaagaaatccacttcgtgccagtctgcaaggcaattttccttcacgaggagctagctgtttgcacagcgccctcttgtgaagagaggttttcgtgactgtaccttcaccccaagagccaaaaacttcaagtatccttccagagcaattgcttagctttcatcagctgaggattaacttccaaggctttttgaggatgcatgtatgggtatgagtaacacacagacttgacatccgaattctctattattaaatgtgcacataaatattccacagagttgtgcttcttaatgataatactttaaaaagaacttcctaaaataggaaattagcatctatgtttgttcccatgacttgtgaaacttgctcttttgctctgatgaatgctgtttctccattcggtaaatgaaaattgaaaaattgaaaattggggactacattaaaaatcaaaaattgtccattcatcttaaaaatatggagacatttatttataaaacgttagtatgcttatgagtgccatttgaaaatgcattaggcacctgaaatttcatatgatagtcactgacaaaaatattgccatttgagtaatataagaattagagacatttggtgtgcttgatttagcacgttaattagaataaaaatctttattcatgtaaatgattccactgatttgcaattatctggataactgctcagcaggaaaaaccaaattttggatacttcttgcaaaaaagtaaattactgtggaatatgatacaatgtatgcaggaagagttgtgctttatgtgatattctgactcaaaacaggagagaaaatgatttcttctcacattcagttgaacaattgattgggaagtgattacaaacttcactttgcctgtcagtgtctgtgctatgtatttattgaggagctcattcattgctactcactttcctaaccaaaccatcatgaaaaacatgcttagaaccctgagctaggtaaaatgagaatgtgtggcttagcacaaatcataattaaaaagcaatggcaacaccaaaggatgggttggggtgcccctccataaccgctacaaggttttccaaacccaccacaaataaatatgtgtcaaacataaaaacgatgtgctttctatgtaaatgcaaattcaagacaagtccccaagatcccttagcttccaatcaaattgtcatcacttctcaatctactactatctagaaattctactgtggcctttgctgaaagttcagagcattcattgatgagtatcattgtattcatgtggaagagatgacatgaggcagacaaggacggtaacaagtctgtgtaggaatctacacatatctagtgcttgtgcaatgggcttttgaataggcttgtgaaaaagactaacgcctcccaactgtatctccatccctgacattttgcctggttttcagaatagtatatcaatctccttcttggagattgacatatgggtatttaatagtcttaggtttaattccttccagggagactgcaaaatattggagtgcgtagtttatttggagaagaggcaggaaggcgattctaggaaatcaaagttaggtgatggagaagtgggatagcaaaggaagaaaagttaatacagtgtgtattaataagcaggggcagatggggcccaatctccccagggaccttttgtgggaccatatatacacatgcctcaggactgtcccactggagaatgtggaacctggggtatatgagcaccaactctggaccctcaatgttggagtgttgccactgggaatgttaaaaaattctgtaaacggtctcagcaggctcctttgtactgcagaaagcccccaggtgcctgagatgggaaactgactgagtctgccatagcctcaggtgaactctatagtgggtggagggaaatggggcagcactccaagcattttccacaaacaggactatcaaactcaaaatgctcaaacagaaccaccccaccactaaacctactcctcccttgaactcctcaagctcaataaataaaaacacacatttccaatttgttcaggccaaaaacccttgaattatctttgactcatctctttttctctcactctatgtaaaaatccgtcatcaaacacaattagctctggtttcaaaacattgccagaatctgatcacttctcgccatctccactgccatcacccgggtccaagtcactactgtctccttccaaggctattgcagtggcgtcataaccattttccctgcttctactcttgctcctactctattcttcacagagcacccagagtgatcctttgaaaatgtatgccatttctctgctcaaaaccctttactagtttccctctccatttgggataaaatccaaactcttttccatggttttcaaaagccctctcctctctttatggcctccttttctattctctttcttgcttactcagttcccacaatactcaacttcttcctgttccttaaacacaatgtgcctcctcctaaggagctttgcacttgctatttctttttcttgaaacactcttcctttggaaaaatgcataattcactcattttgttaagatttaaatgtcagtttaacagacagggatacctattctgactttttaatctaaaatcacactcgtattactatttctttactctgcactaatttttttcatagaactaaccatcacgacacacattttgaatgtgtttatgtatttcatatattttgtactatcctccccacaaaaaattaaattctttcagaggagagacatgttgattcactgctgtttggccaacaactagaatagggccagatagtggtaatggttcaatatatatttgctaagtgaattaattcactgttctgagagccatatgagataaatattgatacttattaaacacttaaacgttatgattgatattggcctataaaaagtgtaagcagcctctgctcaccagaagtatgaatatccaaggtgtagtgaaattatcagagtttagacctgtaagcttgtccaacccgtggcttgtgggctacatggcccaggatggctttgaatgtggcccaacacaaattcataaactatcttaaaacatcatgagactttttgttttgtttttgctcatcagctatcatattggtgtattttatatggggcccaagacaattcttccaatgtggcccagggaagccaaaagattgaatactcctgggagggtatattactgtattatgaacaatgatagttaggaaaagaaaggaaagaaaggttgagactggactgtgaaggaacttgaatgatacgttaggagtgggacctttgttccatttagaagtgaaaacttaccaagtttctctgaacaagggagtgaaataataaaagcagaattaatttcagaacaattgatattttgattctacttgcaaggacttgagcaggaaagattagaggcagagagacaatgtcgtgaactttcccccactcgaatcctcctttttcccagtattcaagacactggcatatgtactggcatatatgtactatttgcatcttttaaacttagtttgaagactactgtatcatcaaatatttttcatactcagttaaggtggtttttgatcttactgcgatgttaaactaccacactttgtttagctgaaaaaaaggtctgtccatggtttctctggattggaagtgaacctactatagatatgaaaagctcatattcattcttcttcaggttacctaaaaactaataactaaagtattagaaaaagataagtttcggtatgaatatactataggttatctggtgagacacagttatgagtcaacgggaataaacacgtcaaaggcatctgtagtgcttagcaaagtttctttacatctctaatttgtttcttacccagggcaaaatgcaaactgcagtcttcttttctctaaaggagtattgtaaagaaaaagagtggtatatgctcatgttctactggactctgaacctcctggggctgtataaccctgggactgcccagcacagtaggagtgaaataaatgtatgttaaatgaatccatcaaacctcttagaagacagactccagggaaatttcattattttgttctaaattatgctttccctcatgtaatgaatatttaattctgttttgttccagaaaggactcaaggcttctctatttcctttagtaattagcttaaataagccaagtcatccatttctctacctacccaatggacaacagaagaagcttacgtgtctcatagctttatctgtaccttgatatgtttgagaatatttcatatacataaaccagcaatgatcatttgaggaaataaaccagtaaactttacaagcaattgtaatttgaggatataaactttaaactctagaatgttggacacatctttgaaaataattccaaataactaattgaatctattagtttatgttacaagccaatttggttcaaagttttaaaatgaagaaaaaaattgtataaattgaagttttaagcatagtttaatgaaatcagctagtctaaattcaatattttcactcagttcatcaaattatttgaaaagtaaacacgtgggctgtacagagaacagtgaatcctcccctaccctgagctatcactcctgcttgtggggcacagagaaggcattcagacctgtgcctgccaccaccctacccccagccaacaccacctccagtgtgactgtgcacacaggctccagcaagggcctcctgcccacctctgtaagctgcattgcctctgccactctggtgaacatctgcaaggaggcaggcacccccacacccactagcacttcactgcagctgtcccatctcagcacccctagctgagtggattccaaaacttgaagaatgagaagacaaagtttgggcctcatacaagtcccccagagttagtgcacacagtccagaagttgggagctgagtgttggacccctaaaatcttccagaaatgaagccaatcagctgaatccacctaataccacaatcaaaccctcaaggtcatcaaataggataaaaggaaaaaaaaaacattcaaatgtcagcaacctcaaacattaaaggtagaaaagtccacaaagatgagaaagaatcagcacaagaaccctgaaaactcaaaaggccagagtgccttttttcctccaaacaaccgtgtcccttctaaagcaagcttctaaaccaggctgagatggctgaaatgacagaaatagaattcaaaatatggattggaatgaagatcattgaagtacaggagtatgttgaaacccaacggaaggaagctaaaaatcatgataaaacaatgcaggaactgacagacaaacagccagtatagacaagaatgtcaccaacctgatagaactgaaaacattattagaatttcataatgtaattacaagtactaataacagaacagcctaagtggaggaaaaaatctcagaaatctcagagcttgaaaactggctttctaaaataagacagtcagacaagaatagagaaaacagaatgaaaaggaatgaacaaaaccgagaaatatgagattatgtaaagagactgaatctacgactcattggtgtccctgaaatacatgaggagaatgaagccaacttggaaaacatatttcagagtgttatccatgagaacttccctaacctagttagagaggccaacatttaaattcaggaaatgcagaaactcctggtaaggtacttcacaagaaggtcatccccaagacacacaatcattagattctccaaggttgaaatcaaagaaaacatgttaaaggcagctagaaaggtaaggtcacctacaaaaggaagcccatcagactaactgtggacctctcagcagaaactctacaagccagaaaagattgagggccaatattcacaattcttaaaaagaaattccaaccaacaatttcatatctggccaaactaagcatcataagtgaaggggaaataatatcctgttcagacaagcaaatactgagggaatttgttaccaccagacatgccttacaagaactcctgaaagaaacactaaatatagaaaggaaagaccattaccagacactacaaaaacacactgaagtgtacagaccaatgactctataaaacaaccatataaacaagtctgcaaaataaccagctaacatcatgatgacagaatcaaattcacacataacaatattaaccttaaatgtaaatggactaaatgcctcaattaaaagacacagagtggcaagctggataaagaatcgagactcactggtatgctgtcttcaagagacccatctcacatgcaatgatacacataggctcaaaataaagggatggaggaaaatctaccaagcaaatgaaaaacagaaaaaagcaggggttgcaatcctagtttctgacaaaaaagactttaaaccaacaaagataaaaaagacaaagaagggcattacatcatggtaaagggttcaattcaacaagaagatctaattatcctaaatatatacacacccaacagagagaaacactcagattcataaagcaagttcttagagacctccaaagagacctagactcccacacaataatagcaggagactttaacatatcactgaaaatattagatatatcatcaagacaggaaattaagatattcaggacttgaacttagcactggaacaaatggatctgatagatatctacagaagtctccaccccaaaacaacagaatatacattcttctcattgccacatgccacatactctaaaattgatcacataatcagaagtaaaacactactcagcaaatgcaaaagaactgaaataataatgaacaatctctcagaccagagtgcaatcaaattagaagctaaggctaagaaattcactcaaaaccatgcaattacatggaaattgaatgccttttctcctgaaatcctgaatgccttttgggtaaataatgaaataaaagcagaaatcaataaggtttttgaaacaaatgagaacaaagatacaacataccagaacctctggaaaatagctaaggcagtgttaggacagacatttatagcatgaaatgcccaaatcaaaaagttagaaagatctcaagtcaacagcctaacatcacaactaaaagaactagagaaccaagagcaaataaattccaaagccagcagatgacaagaaataaccaaaatcagagctgaactgaagaatattgagacacagaaaaccattcaaaagatcagtgaatccaggagttgttctttttttgaaaaaattaataaactacatagaccaccagctagattaataaagaagaaaagagagaagattcaaataaacacaatcagaaatgataagggggatattaccactgaccccacagaaatacaaacaaccatcagagagtattatgaacacctttatgcacataaactagaaaaactagaagaaatggataaattcctggacatacatactctcccaagactgaatcaggaagaagctgaatccctgaatggactaataaaaagcactgaaattgagtcagtaataaatagcctaccaaccaaaaaaaccccaggaccagactgattcacagctgaattctaccagatgtacaaagaagagatggtaccattcctgctgaaactattccccaaaactgagaaggatggactcctccctaactcattctacaaggccagcatcttcctgagacaaatacctggtagaaatataacaaaaatttaaaactcagaccaatattcttgatgaacattgatgcaagaatcctccataaaatactggcaaaccaaatccagtatcacatcaaaaagcttatccaccacaatcaagtaggcttcatccttgagatgcaaggttggttcaacatatgcaaatcaataaatgtgattcatcacataaacagaactaaagacaaaaaacacatgattatctcaaaagatgtggaaaatgcctttgataaaattcaagatcgcttcatgttaaaaactctcaataaactaggtattgaaggaacagccctcaaaaaataagagccatcaatgatatacccacagtcaacatcatactgaatgggcagaagctggaagtattaccattgaaaatgggcacaagacaaggatgccctctctcgcctttcctattcaacattttggaagtcctggctagggcagttagataagagaaagaaataaagcacattcaaacaggaagagaggaagtcaaactatcccagtttgcagattacacgatcctatatctagaaaaccacataatctcagcccaaaagcttcttaaactgataaacaacttcagcaaagtttcaggatatgaaattaatgtgcaaaaataactagcattcctacacaccaacaatagtcaagctgagagccaaatcaggaatgcaatcccattcacaatcaccacaaaaagaataaaatacctaggaatacagataaccagggaggtgaaaaatctctacaaggagaactacataacactgctcaaacaaatgagagacgacacaaaaaaatagaaaaacattccatgatcatggacagaaagaatccatattgttaaaatggccatactgcctgaagcaatttatagattcagtgctatttttaataaattaccactgagattcttcacagaactagaaaaaactattttaaaattcatatggaaccaaaaaagagcccgaatagctaaggcaatcctcagcaaaaagaacaaagctagaggcatcatgccacccaacttcaaactatactacagggccacagtaaccaaaacggcatggtactggtacaaaaacagacacatagacaaatggaacaggatagagaacctaggaataagaccatatacctacaactatctgatctgtgacaaacctaacaaaaacaagcattggagaaaagattccctattcaataaatgatgctgagatagctggctaactatatgcagaagattggaccccttctttataccatatacaaaacttaactcaagatgtattaaatagttaaatgtaaaacccaaagctataaaaatcccagaagacaacctaggcaataccatcttggacacaggaacaggtgaagatgtcctgacaggccaggtgtggtggctcacacctgtaatcccagcactttgggaggctgaggcaggcagatcacgaggtcaggagatcgagaccatcatggctaacacagtgaaaccctgtctctactaaaaatacaaaaaatcagctgggcgtggtggcgggcgcctgtagtcccagctactcaggagactgaggtaggagaacggcgtgaacccaggaggaggaggttgcagtgagctgagatcatgccactgcactccagcctgggtgacagagtgagacacccatctcaaaaaaaaaaaaaaaatatgtcatgacaaagacaccaaaaccaattgcaacaaaggcaaaaattgacaaatgagatctaattaaactaaagagctcttgcacaggaaaggaagctgtcaacagagtgagcctataaaatgggagaaaatttttgcaaactattcaacaaaggtctaatatctagcatctataaggaacttaaacaaatttacaagaaaaaacaaccccattaaaaagtgggcaaaggacatgaacaggcacttttcaaaagacatacatgcagccaacaatcatatgaaaaagtcttcaacatcactcatcattagagaaatgcaaatcaaaaccacaatgaaataccatctcacaccagtcagaatggctagtattaaaaagtcaacttatacactgttggtgggagtgtaaattagttcaacaattgtagaagacagtgtggcaattcctcaaagacctaaaaaagaaataccatttgacccagcaatcccattactgggtgtatacccaaaggaatagaaattattctattataatgacacaggcatgtgtatgatcattgcagcactattcacaatagcaaagacatagaattaacctaaacgcccatcaatgatagactggataaaaaaaaatgtggtgcatacacaccatggaatactctgcagccataaaaaagaatgagatcatgtcctttgcaggaacatggatacagctggaggccattatctttagcaaactaatgcaagaacagaaaaccaaataccatatgttctcacttattagtgggagctaattgatgtgaacacatggacacaaagaggggaacaacacacactagggcctaccagagggtagaaggtgggaggagggagaggatcaggaaaactaataggtagtaggcttaatacttgggtgacaaaataatgtgtacaagaagcccctgtgacccaagtttacctatataacaaacctgcacatgtacccctgaacttaaaagttaaaaaaaagaattcagaagaagaaaatgaaagaaaagtaaacccgagtgtatagtcctccatctcctaggttctaaggattaaaagctccaagaaaagtgttagaaaaatacatagtgaattaagaaaaaattattccttatagttccaacgttgtgtctttgcttatactatgttcacccttttaggtatgtttgtacaaaatgaaaaaggaataaaaaccaacattttagaggataattcatgctactcaaaacaatcacgaggaaaagctgggctgaaactagtgacaagcttttgcattgtgccacattgctgtcacatttttgcccatattatttatgagatttcttcaaaatttttataccaggtcattcttaaggaattctttgctcaggaaaaagtccaagttagcatccttcagacccctgctgtctctccagctcctctccacacacatccatttatagggaaaggcaagggcagaaagcagatttagaagagaaaaaggatagaggagcatgagtgtgtgtgtccacgtgtgtgtgtttgtgtgtgtgtgtgtgtgtgtgtgatgtgtcctgctttaccacagtccagggagcttacagggaagtccatgttcaatatcagcactgcaggcctctccagcaggcccttgttccttcctggtcttcactgcctagtgcacggcaactaagccacaacacccaaacctgagacaaatcatcccatcccagggctaaaaaagtgactctaatgatgtgtctgcgtaacaatcaataattcatttaaattgattgcctgatacataaataatttccttataaccttctgacttttagcaccactgatctaagaatcacacctaaaaaagtgctgtcagaatgcaaaaatagttttctgtttgaataatacttattttttatgaccatatgaatgatgaatattcatgatagaaatttggaaaattcagaaaattaaatttttttaaaaatcatctataccgagaggcaacttgtaaatctggctcattttctttatttttatatgtatatacatatatttacgcatctaattttaacattcaattgagatttgatgtacataatttttggattctgctttgcattcatggtttactataagccattttctctatcacttaatgtcatttgaaaatatatttaatggttgacaagattctattggctgggtctaatatgaaaatttatttaaacattagttcatgtgaaatacatagaatatacctaggttctcaatattataggtatttttacggtgaatatctttgaatataaatattttaatatcccaaattacttccacaatccaaatatctacaagcagaattactaaattaagaggtaggattttaaaaatatcaatgtttattttagatttaggggctacatgtacaggtttgttacatgagtatattgcgtgatgctgaggtttggggcagtgctgatcccatcacccaggtggtcagcattgtacccagtaggtagagtttcctcccttattcccctttcccctcctggcttttggaatcctcagtgtctactgttaccatctttgtgtccatgtgttaaagggtaggagtaattttgaggcttcaagcttctgctgatttttaagcatttttctgaaataaaactttcaaattagttcataaatcaatgtaacagatgacatctgtcaatatacattattatatgcataaatcatatgcataaataacatgcattattttattatgattttataaaagattgacacaacataattcaaaataacttatttactacaaataggactcaccacatgaaaattagaatctaaagcaattaaaaaaactattaggaaatgaaaaaaaatcccatcatataaatcctcaattttggccatattttatgaaagggccaaaagcaatcaaaaaaaaaaaaaaaaaagagagagaaagaagtgagaaagaagtaggaaaaaaagaagaaagacatgtggctattattacagcaacatgaaggtggtcaaccacttcaagtttttgtggtcagtgaggtcacaagagctacaggctgacatttcaaacaaattatgcacattgaggtcacatcgctctacttcaggcagtttctcataattgtagtgttctgtttacaagaggtccttgacttaaaaatgtccttttgtgccctctagtgtttaaattcatcaaagcttttgagaagttcatatcttgtttctgaactccagttgaacaacatttcattcttagaccaagtgtttatctgtatctgaagggggccaacatacatcttgttccaaaatctctaaagtttacttaattttttttttatttcaaagggagctaggtaggggttggaaaactaccacagagcaaatcctgcccactactttttttcattttgtaaataaagtttattggaacatattatgctcattcattacagattgtctacagataactgcatttgctctgcaacagcagagttgagtagttactacagagttcttgtggccccaaaaggctaaaatatttactatctggcttgtcacagaaaaagtttgctgaccctggagctagagctctgataattagattggatgccatgacattttacaatgccctttaattccactccctttccatcaacccccggaatactagttaaaacaaagaccattgtaggccagtccattagctttgtggtccaggtacaaactttgcagttttagtgaaaccatttgttaatttttatttttctaatatttacttagcttgataatatcaactccgttctgatgacttcgatattaatatgattatattggagagaatataatgagatcaaatcgctttacccatcaagaccaggaactgaagaacttcttcctcctttgctacctcatctcttagctagaacttaggtgagtagattagtatcctcattcctctttatttttatataattaataataatatttgcaattattttgagaaacatatatctttttttgaataaagtaaacataccgtttataattaatatggaatttagtttaagttcatgcttgatttaaatctcacacaatcacctcttttatatactaatgaaagcacggtgcacaataataaagccgtggtcctatgtggtcaacttacaggctaccttctttcctcagtgcaaatatcacgtctttctaagtccctctaatattttatcctctcttttgtgtatctagaagctttactgaaacttcctactccttatctgaaatagttgacatatagttaataagagcttttttccaggaagtggatctattttattgctttctaacttaacatgtttcagaatagttacagccattttttttattcaaaggtacatgtcagcaatagtctggccagaaattttgcacaataataggagaaaacaaaaaactaggggcttagaaaagtgaatgaaaacagttttcagttgattattttgttcctgaaaaggcatcttttcctcatgacatgcattcatggccattgtagattacatgcctggagctgcccttctcagcctttcaacctctcattacatgcatattctttcctctgttctttacagtcccccatttccctgacacagaccccgcactacaatcctcttccttatacttgacacagaaataatttaaacacaaacccaaatacaaacactgcatagatttaccatatggaatcacatatgtaaaatttctgaatcaaataacgcaaacccacaatgttactttccaaatatatacaacaacaacaaccgaatgggtggtgaaacatattacttatgaaaggtgctcaatgttaaaagcaattaaaataaaattcagaaaaaagtgataccatacctctattccacaagcaaaaaaaatttccaaacttacctgcaaaagaaaagaacaataaatctcaaatcagaggatattttatttttttctagtaaatttggcaaaattgtcatcataaatatagttatttcttaattatcactgtgtatatcactctctgtaaataatgcttattggttcttatagataccaacagggctggcagtgacattctctaaaggccaattctcatagtccatagggtcattttccatatgtaatctgcttcataagaaagtttttagaacaaaaacttaaacaattccctggacccaggaaatctgcattacaagacatttttgggggtgctaaatccaaacaatgaaaaaagaaaaggttttggggtcagactgacctggactgaaatcctagttctactgtagcctggtaactcaagccattttatgtctgttgagcctcagtattttcgcctataaaatggggacattatatttatgtaattcaattattctaagcattgaagtcattttgtggcatgctgtagacactcaaaaaatattgccttcacaccatcctgtaagctttattttatgccaatactttgctgaaacataaatgcttagtgcggtatctaaagcatggaagagctttaagcaattaataatggatagaaaagtaacaagttttacatttccatcttcatagtgtgaccaagttggtttacatgaaatattaatcatcttctagatgctgggcaatttatttcccggtgtaaattcaagtgtttcactcagagttcaatcaattaactgagagtatggcagtctttagcacggtctctacatcccatatattcacatgatgccccctattatgtccccattcacgatctcacttatgtcccctcactgcagcctcactagccttccagccattcctggaaaaatcgcaagcctgctccagtctcaggatatttgcattccctgcccatttgcccacgaatctatccccactccccttcaatccttgcctcaaagggccctttctaacctgatttccctattgcaaattctaaccatattctcagcctctgtattgaactcccctgctattgcactatttgttccctagcactgagagccttctaagacgctacacaatgtatttatttactatgcttactgagtctctctgtccctaccactccatataagctacacagaaataggggtgtctgttttgttcactattgaatacccagaacctggaacaatgcctggtaaatagaagctattcaaaaaacatttgtttaaggactcaataatacacatatgaaaaaaccaaatataaaaatataaattatacatatataatccatatgtatatttgtttatatacatattttgcttatatacctacatatttatcacacaaatatttacatgctgattatccataggaatttttaatttttaattaaatttttagctagaagtaaaccatttttgtttttgtttttgtatttgttttgagatagggtctccctctgtcacccaaactgaagagcgagtggtgcaaacacggctcactgcagtctcaacttcctggactcaagcaatcctcctgcctcagctttccaagtagctgagactacaggcccatgccaccacacctggctatttttttatttttttagttttttttattttttgaggagacggtgtcttgccaagttacccaggctggtcatgaactcctggactcgagcaatcctcccacctgggcctcccaaagtgctaggattataggcgtgagccactgcgccaagccctattttatttttacttaacaattattatgagagaaattgaggcaaccattagcgatactggctctctctttgtagctctccaccctcaggacacatgtagatgcacttaataaccctcttgtagttgaatggagccacgtgactaattctggccaatcagcagccaagcgttgattcgctggtgtgagactctccatctcttcccctttctccttctgccagaaggatcaacaaagtccatgatggtaactctgtcagtttctgtaccagagtgaggaggctgtgcagcagagctccctgtcgatgatatgtagtatgggaaacaacaatcactatcatctttgttgttacaagatttagaggttgtcagggcaatttaactcacccatcaggataaatagagaaattatgcacatataattttaaaattatactgaaaaccttattcaaaaaacagtctgcaaaactatactatatatattcattgtgaatgctctttctcaagtcattttgtttctgctggtaattaactctataattctaagtaatatgcttatactgggtttttttttcttgattttcatttttttagccattatctattcatttcttatcataataaacatttaattatcttatactgatctccagttcccttttttcacctagttacatcacaatttttagttaaattaacaatcactgtttacatatttttactatatataaatcttatttactatgtatgtaatatatacatatttgctttacggctcaacttctgttttgctagtagttaataattgctttggttcttttccaaatggtactcatatctgccacccctctcagatgctctagcaaattggataatctatcaatttcattttctcttttcagcctcctcctcaacaccttgtactcttgcttcaatctgtacttctcagctagttgctttctaggcccgctagaaatctgacatcctaagcattctttctgttatttcccgtgttgattattggatctcatgatttcctttttgatagcttcctgctttttgtgggtcacattttatagaagctcaagtggcaaatgaagtgaatagtattaatattttacattttttggatcttgcatcactaaagatggctttattctgtctttacactagttcatagtttgacttgctaaaggagtctatgttgaaatgtaaattccttcaaaatattgaagccattactctattgtactccagcatctatttttttaagtaatttatcattaatctgattactttcattttaggtagagggtggggtaggaggcaaggtttcagcattcatgatgctgactcttctggatgttgaaatgcactgcccagaatcccctcagcatgtgtttctccagtagagggtatactgctcttgcccaagattatacccatttatacagagcagtctgcagacaatggctatttgataaacgggaaggagatagtatagagtcctaaccccttcctctaagttttagaaaccccaactgaaccagaagaggcctccattgagcctttaaccctgttcctactcttcttcctgtggtgctcacactgagaacatttccccacaaacaccctgcatcccaatctctatctatctcggagtatctcagggaaccagatctgcaccacagacattcccttcattccttgtttcagccccacacctcatccctgcagggtgctacatcttctctctcagagtcctgaccctttctgagaacatttctctagaaaataaatcttgggtatttctgtggtagggtgtgcgggtagaaacaggagccttggataggatgtggggaggcagccttctcttccattctcacacctttccttttaaattcctccatttaattacagataatatgaacatatggtccattcactacaattgattaggagtccattcttttagattgttggttcatctctgttggcatgaattaaaaacaattttatctattaaaagtagaaaaggtataagaacattttccaaactgttacattgaatactagtttttgagatgttaagagtccagttgaataataaaaacaagaaaaagactagagagtcaaataatttgtaaatatggcttcaaaatcttaaagaaaatatttctttttattacgtgacttctaagagctttaaatatactaattggaatgtgactattctagaaggtggagagcatttgcagagtaattagaccattcccctgtagacggcagttaatatcagagtaagccatgttttagaatatgacttgggcctgggcatggtggctcatgtctgcaatcccaggatttctgggaggctgaggtgggaggatagcttgagcccaggtactccagcctggggcacaaagcaggaccttgtcaagaaagaaagaaagaaaaagaaaagaagggcagggcagcgcaggaggaagggagggagggagggagggagggaaagaaagagaaagagaaaagacaaaaagaaatatgccatgggaattgctgcacaaagcatcttaatctaagttttatactaatcacagggcttctattactcctacaagaattcctttaccttagctggagaggtaaaatgaattgctaaacacttaaaaaccagcatgactgtaccaaggaataaaacatgttaactctgtttcaggtgagtgctttctccattacatcaaattgcctgcttacttaaaattaatcataatatttgaattaggatcacgtaatgtaaaaaaatctcatttcccagaatattctacactagaaatcaatttctcactatcctgctgaaatttgtccaagcaatctgcatatatttttaaatctatcttttttatctctagttcagcatgtgccataatgttctctgtggagcacccaaccccattactctgtaagcaaacaaaaagttaactatttaataaagtttggaatattttgcctatgtatctccttcctggatatttacaatatttatttagcttccagtaatatatcagtttaattttatgaagctcagcttatttgaccatgcaaccattttgcaggtagtacctgttgatattagcattccacaaaacctactttgggaaatactaacctaggttactaaggttcatactagcaagagatgaataagactaactattataaataataatggagaaaaaaagagctccaatgatctgacacagagaaatggattttatgaagggacatgatttctcaatgagaaagaaagaggaaacagaaaactaatagttccattgtatttccatagttagggtggcgtatggttaggattctttgttcagttttataaacctcgtactgtcatgacttcattaacccaaggctaagctgtaattctaaaaggtatatatatatttaaaaattgacaaataagaatgtatatatttatgatgtaaaacattttatttacatagatgtatacattgtgaagtggctaaatcaagctaattaatatatacattacctcacaaacttatctttttttgtggcaagatcactaaaaatctactcttttagctattttcaagtatgcaatgtattgttgttaactatagtcaccctgaggtacaatagatctctggaacttattcctcctgtttaactgaaattttgtgtcctttgactaacattgccccagtcttcagcccccacccatcagccctggttaacaaccattttattctgtttctatgagtttgacatttttagctttcacatttaaatgagatcatgtggtggttgtcattctgtgcctgacttatttcacttaacataacgtcatccagattcatccatgtgatcccaaatgacaggatttccaaaatatataaggaactcaaaaaggtcaatagtatgaaaacaaataacttgattaaaaaacaagaaaaggatctaaacagatgtttctcaaaagaagccataccaatggccaacaggtatatgaaaaaaatgttcaacatcacttaataatcaaggaaatgcaaactaaaaccacaatgagatatcaactcatacctgttagtacaaaaaagatgaaagatggcaaggatgtggagaaaagggaagatgtttacactgttggtgggaatgtatattcacatagccattatggaaaacagcatcgaggttctttaaaagctaaaaatagtactaccatattatccagcagtttcactactaggtatatatccaaaggaagtgaaatcagtgtgtcaaaaagatatttgcactcccatgttcattatagcattatttacaatagcaaagatacagaatcaacctaagtgttcatcaacaatgaatggataaagaaaatgtggtacacacacacacacacacacactcacacactagaattctacccagccctgaaaaagaaggaaatccataataacatcttttattttggatagaatggacatcaagggtatttgtgacagatataccatgaatgacatgaacctaatattaaatatttatttttgttgatgtaaggaacattaatagcctagaaactataagttttaagatttagcttaggaactcaaacgatgtagcaaatatatttcatcatgatttgatctatctatatcaatcttataaaattgtgtgagcatgaggttttggggatgaagagataatggaatcaaattttagcttttacccccaaaccttctagactttaattgtatattatgtaaaatgtaagtatttaaaatatgaagttcatgaatgggttcatgagtcaaccgcaggggagttggtgaagcccctgaaactatatgaaaaattgtgtgtacatttacatttttcaagagagatttgatctagtcaaattttcaaagcaccctgagatacccaaaaagtgatagaccccttaaagagataatctctaagaattctgtctcctttttcattaacagttttataagctttcttatgaaaagtatgtcatgtttatgatatttagtaatttctttgctgagccttcatttttagctattcaagaaatttaaaagtaaattgtaaatattacaattagtttctaaggattgtttaaaatatcattaattatataaaattttaatatatattttcagttcttcagctaggacagacagagcctctttaaaagattttatttgatgctgggaagggtgctgggaaaagagaactcctatacactgacgatgggaatgtatattagtacagccataatagaaaacagtatggaagtttctcaaaaaactaaaaataaaactatcatatgatccagcaatcccaccactaggaatttattcaaaggaaaggaaatcagtatattaaaagtacacctgcacccccatgtttattgcagcactattcacaatagccaagatatggaatcaacctaagtgtccttgatggaactggaggtcattacaataagtgaaatgagccaggcacagaaagacagatatggcatgttgtcactcatatgtgggagctaaaacagtggatctcttggaggtagagagtagaatgatggttaccagaggctgggaagagagaggtgggatgaaaagaggttagttaatgggtacaagcatatagttagatagaagaaataagttctagtgttcgataacacagaaaggtgactatagctaacaataatttattgtatatttcaaaatatctggaagagctgaagtgttcccaacacaaaaaataataatcgtttgaggtgatggttatcttaaataccctgatttgatcatcacacattgtatgcatgaatcaaaatatcacatgtacctcctaaatatgtataattattatgcatcaatacaaatatttacagtaaaaaggagatttgaattgtaagaaaaaaagagaagaaattctatttttgcaacttataatagttattatttgtgtgagatactcacttgcccacaagatggcgctctctaattttggatatactattttcccaaaccaatttctcaagaagttatttctaaagtgttctcttccctgaaaaataatatttacaataaattattcttcactactgtttgattttcatgcttgaacatctaacaatgcatgacaaagtatatgttaatgtttttgtgtgagtggattgatgaatggatgtttcagacattcacagaatgtttactaaatttctgctgcataaacagctttgcacagtggatttataaacaaagaaacaaaaggtgttaaagtataaagagcaaatcagggttactatttttcaagttaatatttttatatccaagagtttcatatttaaatgaaaaatgattgttatagacatgtaaatgtacagcaaagagaagacatcggttcagttaggtaaaagaccttataagttgttgtgacttatgaagaactttaaggtttgtatgagaaggaggtaaggggaagatatttaagaggcggcaaataacataagaaatagcttgaaattatgtagtcatgccatcccaaaataaaatggcctcccattagataaggctagatgagttacagagggtggtaaaagtcactccaagaggaagaaaaggtaactaatatttactgagaacataatataactcatactgttatttaatgatctttccccacccttgaaaatacgtggatgtgcctcttattagagtgttagaattatggtgctatatttggatattttgagtaggttgcacttccctaaatgttgtactaaatcccagtatacagtcaccagaggaatagagatttcccagagaggaaatcagagttaaggaggtgagccttaagtaagcataggaggagactaaacttctctgtcttgattctcaatctcttgagtaatgactatgtcttgtggagccctctcttgtgggaaagttaaagatggcctctgctgtccagtgtgaagagggagtcagaagaagagtttctcctaggggacttcatttgaataagatatctcctatgatagaacaaattatctagtttcatgttactttgattctacatagtttgtcagtaaagtgttgctttaaaattcctgctttgtctcagctgttaaacaaagaaaaggatttttttaaaacccacatttagatcaaattgacttaaaaagagtacctgtctgtccaaaggatgatggtagtgagaacaacaatgagaaagaccctgaaaaaaagaattctgcttctcactgatctctctttcttcccttattcccctaaagtcatctccaaattaggagtcagagggatcttgttaacatctgtttaaaggtctttgtttaataaggcaaagccactagtaagatgaatagagctctgagtccccttctgtttcatctccaactttttcccttattctccactttgctacttcactccagccaccaggaccttcttactgtccctccatgatggcaggaggactttttgtacctccttcatgtttgctcacatgctaccttctgaatgaggtctttcctaacaccacttaaaattccaccacccaccacacacacattcgttaacctcttctctaatacacttttcttcatggtatttatcacaaaatcttccccatacatatttttaaatatagatatataaataaatatatatttctatatattacatatatatataatatataaattattttcatctttcactcccagctggaatataaactccacaagggtagaatttttgtctgtttcattcactgctgtatttttttttacagtacagagaagaaagctcagaacatagtatgccttctgtgataatcctgagtgtgaacttgagtggatggaaggatacaaagtattgatcctgggtgtgtctgtgagggtgttgccaaagaagattaacatttgagtcagtgtgcagacccactcttaatctgggtgggcacaatctaattagctgccagcgctgctagaatataagcaggcagaaacatgtgaaaagaaagactggcctagcctcccagcctacatctttctcccatgctggatgcttccttctctgaaatattggactccaagttcttcagttttggaacttggactggctctccttgcttctcagcctacagatggcctattgtggaacgttgtgattacgtgagttaatacttaataaactaccctttatatatatgtgtgtgtgtctatatatatatatatatatattccattaattctgttcttccagagaaccctaatataccttgtcatatttattgaatcaactttttaaaagtctaatttctgtgttctcttgaaaaatcagaaagcctgccaaccctggcctatattttcacatgataacaactgtgaggagctcagaagtcactgcgcatgcaggtgaggatatatctataccctccttgcccaggatccccctgccttctccatttgaatagctcctggctcctgcagatatgtgagttgtgacctgctggaagagtcctgaaagggagagtgacaggatcaaatgaagactttcagtaagtcacctggaaatagtgtgtaggattaatttaacgagtctggaggttgatgcctgttagtatctgctgtcgaagtcctggcatgaatggatgaggacctatgtgatgtgaactcagctgaagaatgaaagacaggggaagtagagtttgaagaaaggattaattgaacctgaggatggattggatattaaaaatgaatgaaaagaaaaagtaatgatgactaaaatttctagactggataattaggaaaatgttaatttctgatgtaaaagggaactcaggaaagagtcaacctaggacaaaaatcaaaagacctacatatggaaagaaatatactgatttgagtgaacccaagcagagtttgaagacacagattcaaaggtatttgacaacaaaaaaaggactttgagatcaatgccagagatggggactcaattttgcatactgcttatatactgcctacgtaaaggcactttatgataaagaacatctcaaaaaaataacatatagaacaaggggcaaaaataggggataaaagagatgattcccaattattggtcaagtggttggagtgagaattaaaggcaaaattcctcttctccccctcaaaattacacacaactacacaaacatatgtgttaatgattttagtgtgttgaatctggctgcttccacactgcatgcatcctacctttctccattcacacctgagataatctcattctagtgaagtcttacattataaatgacaacaccaatatttagggacgttcctcttttttcttcactgactttgcctttccaaacaatatactttgtgaatcctctgagaaaaaagaaagtagtttgatctgctggtttttaggacaataatttttaaaggacttgttatttttggttcagacaccatgcaaaactcatcttcaatcaagggcaggtgccaggtacagcatcaagaaagtaacaggtggtttctcttcctctcctttcctctaaaacatgaataaaacaaaagttttagcatttcagaaataatctttttaattaaaagtggaagataaatgtgataaaagttttctttgagctcttgaaaacaagttcattctataagggttagaaatagtattttttatctgtcactagagccattgtactgtggggcctaatgtttcagattttggatactcatttctttcgattgaaggtgtcatcaggtgttttccacctttagtgatctcaagtggttccccttcagttgctaaaatatactgtgtcgtttgagcagtccaagacccacagagatctgctatctatattggcagataaatgacagcagatggaattgaggctgtgttctgtctcatcggcaagcctgcagccttagaagaagagatgtgcccctgaagcattatgcaggttgctcatccagaatcagtgtcactgtcatagtttgtgaaagggaaattggcaaatctctatacataataggcaaaatgcaaccctctcaattctcaaaggcatattctcttcactcacatttttgtctttttgctgaagggaggtttctgggccaagatgttctgacagcctggtattttctttttttgcccaatgtgtaagaagataattaatgttaccattaatgcatgcaatgacattagtatcaattcccttagtgatatatatgcactaggaaatgaacacaaaagttaattaacaatttattgagcatatactatattacaagtttactatacaattgtgctttattactattggtgaaaataatgaaagatggcacttttctattcttcaccatatacaaggcacagttccaaggatttaaaatctatcaactttatgaatctttacaacaggaggagccaagatggccgaataggaacagctccggtctacagctcccagcctgagcgacgcagaagacaggtgatttctgcatttccatctgaggtactgggttcatctcactagggagtgccagacagtaggcgcaggtcagtgggtgcgcgcaccgtgcacaagccgaagcagggcgaggcattgcctcactcgggaagtgcaaggggtcagggagttccctttcctaatcaaagaaaggggtgacggatggcacctggagaatcgggtcactcccacccgaatactgcgcttttccgacgggcttaaaaaacagcacaccacgagattatatcccgcacctggctgggagggtcctaccccacggagtctcgctgattgctagcacagcagtctgagatcaaactgcaaggcagcggcgaggctgggggaggggcgcccaccattgtccaggcttgcttaggtaaacaaagcagccgggaagctccaactgggtggagcccaccacagctcaaggaggcctgcgtgcttctgtaggctccaactctgggggcagggcagggcacagacaaacaaaaagacagcagtaacctctgcagacttaaatgtccctgtctgacagctttcaagagagcagtggttctcccagcacgcagctggagatctgagaactggcagactgcctcctcaagtgggtctctgacccctgacccccgagcagcctaactgggaggctccagcaggggcaggctgacacctcacactgcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaatcagagcgcctctcctcctctaaaggaacgcagctcctcaccagcaacagaacaaagctggatggagaatgactttgacgagctgagagaagaaggcttcagacgatcaaattactctgagctacgggaggacattcaaaccaaaggcaaagaagttgaaaactttaaaaaaaatttagaagaatgtataactagaataaccaatacagagaagtgcttaaaggagctgatggagctgaaaaccaaggctcaagaactacctgaagaatgcagaagcctcaggagctgatgcgatcaactggaagaaagggtatcagcaatggaagatgaaatgaatgaaatgaagtgagaaggaaagtttagagaaaaaagaataaaaagaaacgagcaaagcctccaagaaatatgggactatgtgaatagaccaagtctacgtctgactggtgtacctgaaagtgatggggagaatggaaccaagttggaaaacactctgcaggatattatccaggagaatttccccaatctagcaaggcaggccaacgttcagattcaggaaatacacagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattctcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcaaaatgacaggatcaaattcacacataacactattaactttaaatgtaaatggactaaatgctccaattaaaagacacagactggcaaattggataaagagtcaacacccatcagtgtgctgtattcaggaaacccatctcacatgcagagacacacataggctcaaaataaaaggatggaggaagatctaccaagcaaatggaaaacaaaaaaaggcaggggttgcaatcctggtctctgataaaacagactttaaaccaacaaagatcaaaagagacaaagaaggccattacataatggtaaagggatcaattcaacaagaagagctaactatcctaaatatatatgcacctgcaggagcacccagattcataaagcaagtcctgagtgacctacaaagagacttagacttccacacattaataatgggagactttaacaccccactgtcaacattagacagatcaacgagacagaaagtcaacaaggatacccaggaattgaactcagctctgcaccaagcagacctaatagacatctacagaactctccactccaaatcaacagaatatacatttttttcagcaccacaccacacctattccaaaattgaccatttacttggaagtaaagctttcctcagcaaatgtaaaagaacagaaattataacaaactatctctcagaccacagtgcaatcaaattagaactcaggattaagaatctcactcaaaaccgctcaactacatggaaaccgaacaacctgctcctgaatgactactgggtacataatgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaagtaaaagaactagaaaagcaagagcaaacacattcaaaagctagcagaaggtaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaacgatcccacagaaatacaaactaccatcagagaatactacaaacacctctatgcaaataaactagaaaatctagaagaaatggataaattccttgacacatacaccctcccaagactaaaccaggaagaagttgaatctctgaatagaccaataacaggatctgaaattgtggcaataatcaatagcttaccaacaaaaagagtccaggaccagatggattcacagccaaattctaccagaggtacaaggaggaactggtaccattccttctgaaactattccaatcaatagaaaaagagggaatcctccctaactcattttatgaggccagcatcattctaataccaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacacaaatcagtaaatgtaatccagcatataaacagagccaaagacaaaaaccacatgattatctcaatagatgcagaaaaggcctttgacaaaattcaacaaccctacatgctaaaaactctcaataaattaggtattgatgggacatatttcaaaataataagagctatctatgacaaacccacagccaatatcatactgaatgggcaaaaactggaagcattccctttgaaaactggcacaagacagggatgctctctctcaccactcctatttaacatagtgttggaagttctggccagggcaattaggcaggagaaggaaataaagggtattcaattaggaaaagaggaagtcaaattgtccctgtttgcagactacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaacacctaggaatccaacttacaagcgacatgaaggacttcttcaaggagaactgcaaaccactgctcaatgaaataaaagaggatacaaacaaatggaagaacattccatgctcatgggtaggaagaatcaatatcgtgaaaatggccatattgcccaaggtaatttaaagattcaatgccatccccatcaagctacccatgactttcttcacagaattggaaaaaactactttaaagttcatatggaaccaaaaaagagcctgcatcaccaagtcaaacctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaacggttctgggaaaactggctagccatatttagaaagctgaaactggatcccttccttacaccttatacaaaaattaattcaagatggattaaagacttacatgttagacctaaaaccataaaaaccctagaagaaaacctaggcattaccattcaggacacaggcatgggcaaggacttcacgtctaaaacaccaaaagcaatggcaacaaaagccaaaattgataaatgggatctaattaaactaaagagcttctgcacagcaaaagaaactaccatcagagtgaacaggcaacctagaaaatgggagaaaattttcgcaacctactcatctgacaaatggctaatatccagaatctacaatgaactcaaacaaatttacaagaaaaaaacaaataaccccatcaaaaagtgggcgaaggacatgaacagacacttctcaaaagaagacatttatgcagccaaaaaacacatgaaaaaatgctcaccatcactggccatcagagaaacgcaaatcaaaaccacaatgagataccatctcacaccaggtagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaacgatagactggattaagaaaatgtggcacatatgcaccatggaatactatgcggccataaaaaatgatgagttcatgtcctttgtagggacatggatgaaattggaaatcatcattctcagtaaactattgcaagaacaaaaaaccaaacaccgcatattctcactcataggtgggaattgaacaatgagatcacatggacacaggaaggggaacatcacactctggggactgctgtggggtggggggaggggggagggatagcattgggagatatacttaatgctagatgacgagttagtgggtgcagcacaccagcatggcacatgtatacgtatgtaactaacctgcacaatgtgcacatgtaccctaaaacttaaagtataataataaaaaaaataaaaaaataaatctttacaacattcctatgagtttagcatttaccaactgcattttagatatgagagaaaatgctaatagttattattcatagtaataccaacaaaaataatagctaacatatgagtatttgctaagttttaggtaccattatgtatgttacataaatatgcatgtatgcatatatacaggttgagcatccccatccaaaaacctaaaattcaagatgctctgaaatccaaaatgctccaaagtctaaaactttttggtcactgacatgagatagtgactcctttgctgatggttcagtgtacacaaactttgtttcatgcacaaaattatttaaaatattgtgtaaaattaccttcaggctatgtgcacatggtatacataaaacataagtaaatttcatgtttatggctgggcatggtagctcacacctgtattctcagccctttgggtggccaaggcaggagaatcatttgagaagaggagttcaagaccagcctgggcaacatagagatatcctgtctctacaaaaattttaaaaattagctggacatggtggtgcacacctgtagacctgcacacctgtagatcgctggagcccaaacgttcaaggttacagtgacctatggtcatgccactgcactccagcctgggcaacacagactctgtttctaatacatatattagagactatctatctatctatctatctatctatctatctatctatctattttgatcccatgggggagatcactcctttaataatgcaagagagtgaataagatgggggagggtggcgtgcaattgagagatgagctttatactggaataccaagtttatggtgtggaactctggggtattacactgaaatgttaggggttctcagtgggttatttgtctctttctattaaactccatttacatttagctctgctgatgttgctcttgcagcaattggttttctcaattaacagaaaagggagagggaacagcttaaagccttggctgttgccgctcagcaagggaactgtgctgctctggagagaaaggtctggacattgtgagtttctgtttatttactttgtttctgacacacctgtctttcaggaagcctggcagtcctaagctgaatgaatagcatgctggaaagcccttcttttgaactaagttcagggcttttcttctaaactgaggtgccctcacaacacatgttctgccaaccacccgaaggtcaaaaagattttctggatgtttttgagacaaagggaattcaaaatctgcaaggaatggcctggggcatgataattctgagagacaagattctccaggctatgcacagaaaaccaactttttatgttagtatttaactcaagtagaatcaacaatggcatggaaattcgttttattttgcttttcctaaggaggatcatctcgtttaaagtgtgaattcaaaaactcactattgtgatagagtgacctcttttcatcctaattattttccataagtatcctgcttgctagtgaaaagactgaaagtgaagaatactagttataaatcatctttagagtgagagctgaagtgagataatttaacctgaacagcacaagctgtccctgacatctgcaacttcactcatcaccagcagtgaatctgctggtctgattggccaggtgtacatgtctcctctcccgaacggtcaggggtagccagtcacacttctgccaataaagagcacgacaagtccctactctacagttagtgaccatgttaaacctatcaaagattaaaggggaaatggggtattccattcaaatgttaaaaaattccaatccaagatgtctacctattatcatgataatcaacacaggacatttatatccagaaatttggttgctttggttccttttatatttacaaaataattattaaactaacccacacaccccaaattgtatgcacagggcttagaacaagttgcaggagtcttttgtgccaccctcttcataaggctctcaaactatttttttttaaattccatatttctaactgactttctattatgaatgatgaagatttcacactctttcaccatttcacctctctacttccctctttctatcctcccattacagttatataacaattattggctaaataaacattcagtgttctattgtatcatccctgcaaagtaacgtttactgataaaccaaatgatgtgccataattatgttttatttatggaacaactttttgttttttctggagttatatattaccttctttatttgattatgtgacattatcaccaatttttctagacgtctccaaaacataattttttaaattttaaatttctgttggtacataataggtaggtaggtagacagacagacagacagacagacagacagacagatagatagatagattgattgatttatggggcccacgagatattttcatacaggcaagcaatgcataataatatcagggtaaacagggaatctattactgcaaacatttaccctttaagttacaaacaattcaattatattctcttagttattttgagatgtatgataaactactgttgactgtagtcaccctgttgagctatcaaataccagatcttatttgttctatctaattatatttttgtacccattaaacatccccacttcttacttcctcccatccactacacctcctagcctctggtaaccatcactctaatctctatctccaggatctcaattcttttaatttccagctcccttaaatagtgagaatacgtgaagatgatctttctgtgcctggataatttcatttaacataacatcctccagttacatccatgttgttgcaaatgacaggatctcatttctttctatggccgaacagtactccattgtgtatatgtaccacattttctttattcattcgtctattgagggaaacttaggttgcttccaaatcttggctactgtgaatagtgctacaataaatatggaagtgcagatatattgatttcctttcttttgggtgtatacctacctagaagtgggattgctggatcatatgggagttctatttttagctttttcgaggaacctccaaattgttctccgtagtggttgtactaatttacattcccaccaaaagtgtaggagtgttctcttttctctacatccttgtcagcatttgttactgcctgtcttttggataaaagccattttaactggggtgagataatatttaactgcagttttgatttgcatttccctgatgaccaatgacattgcacaccttttcatatgactgtttgccatttgtatgtcttcttttcagaaatgtctattcaggtgttttgcccatttttaattggattatcagattttttttcctacggagttgagctcctaatatattctggatattaatcccttgtcagatggatagtttgctaatattttctcccattctgtgggttgtctcctcaccttgttgactgtttcctttgctacgcaggtatttttaacttgatgtgatcccatttgtctattttcgctttggttgcttgtgcttgtggggtattactcaaaaaatctttgctcaggccaggcgcagtggctcacacctgcaatccatgcactttgggaggcctaggcaggtatatcacttgaggtcaggagttggagaccaacctggccaacatggcaaaaccctgtctcaactaaaaatacaaaaattagcccagcatggtggtgtgcacctatagtcccagctactcaggaggctgaggcacaagaatcacttgaacccaggaggcagaggctgctgtgagctgagatcacaccactgcacttcagcctccagtctgggcaacagagtgagactctgtctaaaaaaaaaaaaaaaaatctttgctcaggccaatgtcctggagagtttccccaatgttttctttcaatagttttatagtttgaagtcttagatttaagtctttattccattttgatttgatttttgtatacggcaagagatagaagtctagtttcattcttctgcatatagatatccagttttcccagaaccatttattgaagagactgtcctttctcaatgtatgttcttggcacctttgtcaaaaatgagttcactgtacatgtatgaatttgttcctgggttttcatgccagaaccatcctgttttggttactatagctctgtagtgttatttgaagtcaggtaatatgattcctccagttttgttctttttgctcagtatagctttgagtattctgggtcttttgtggttatacatgaattttaagatatttttctatatctgtgaagaatgtcattggtattttgatagagattgcattgaatctgaagattgctttgggtactatgtacattttaacaatattgattcttccaatccatgaacatgaaatatctttccattttttgtgttctctttaatttctttcatccgtgttttatagttttcattgtagaactctttcacttctttcagtaagttaattcctaggtattttatttgtagctattataaatgggattacattcttgatttctttttcagattgttcaccattggcatatagaaatgctactgatttttatatgttgaatttgtgtcttgcaactttattgaatctgtttaccagttctagtagtgttttggtgaagtctttaggtttttccaaatataaaataatatcatctgcaaacaagaataacttgacttcttcctttccaatttgaatatcctttcattctcctgtctgattgctcaaggggtaatggacatccctgtcatgttacagatcttggaggaaaaactttcaatttttccccattcgatatgatactagctgtgggtctgtcatatatggctttccttgtgttcaggtatgttccttctatcctcagttttttgagtttttatcatgaagggatgttgaattttatcaaatgctttcccagcataaattgaaatgatcatatgtttttgtccttcattgatatgatgtatcacactgactgatttacattatgttgaaccatccttgcttccttgggaaaaatcccacttggtcacgatgactaatctttttaatgtgttgctgaatttggcttgctagtattttgttgaggatttctgcataaatgttcattgggagtattggcctgtagttttctgtttgcaatgtgcctttggtctgtttcggtatgagggtaatactggccttgtgcaataagtgtggaagtactccctcctcctctatttttcagaatagtttgagtaggattgatattacttctttaaatgtttggcaaaattaagcagtaaagccatcagatcctgggcttttctttactgggagacttttcattatggcttcaatcttgatggtattggtctgttcaggttttggatttcgtcatggttaaatcttggtaggttgtatttgtctaggaatttatcatttttttaggttttccaatttatttgcatatagttgctcctagtagcatctaatgatcctttgaatttctgtggtattgcttgtaacgtctcccttatctttccttatctttccttccccccccccccccccatagagtcttgctctgtcatccaggctggagtgcagtggcacaatcttggctcactgcaacctccgcctcccaggttcaagcaattctcctgcctcagccttctgagtagctgggattacaggcacgtgccaccacgctggctaattcttgtatttttagtagagatgggatttcaccgtattggtcaggctggtctcaaactcctgacctcatgatctgcctgccttggcctcccaaagtgctgggattacaggtgtgagccattgtgcccagcaacatctcccttttcatctctgattttatttattagcatcttctttcattgttttaaattctaactctcttttgttcttacttgataattttgtatagtatccttttgtttcattaatgtgataacttgtcatctgtctagggctacgaagtttattttttctgaaacgtctatttgtttcttaaactctttttatatcaacctaatcatcatcattattttcatttgtttgcattaggctttttgttgaagaatttcctcagagttttgtggagacttggctatctattcatattcaacagggagacactaaaatactgactgggagccttgaatgatttaactggacttgtagagtcttggggttcattatagggtggtgttccttgaatgtcccctccaattctcatgttgagatgtaatcctcagtgttggaggtggggcctggtgggaggtgtctgagtcatgggagtggttcccttatagctttgtgagcaagttctcataaaatctctttgtttaaaggtgtgtaacaccttccttcccgctctctctcttgctccccctattgccacgtgagatagctgctctctcttcagcttccaccatgattgaaagctccctgaggcctctccagaagcttagcaaatgctggcattatgcttgtacagcctgcagaactgcaagccagttaattttctatttcttcataaattacccagtctcagatatttctttattgcaatgccacaacagcctaatatagaagactggtaccaaggagtggggcattgctataaagatacctgaaaatgtcaaaatgacattggaactgggtaagagacagaggttggaagaattgggagggctcaggagaaggcagggagatgaggaaaagtttgaaacttggtagagactgattaaatggtcatgaccaaaatgctgatagtgatctgcaaagtaaagtccgtgctgacaaagtattaggtgtaagtgaggaacttattgagaactggagcaaaggtcacccatgttataccttagcaaagaacttggctacattatattcatgcccagggacctgtgaaagtttgaacttaagagttaatgacttagggtatctggcagaagacatttctaagcactgaagcaattgagatgtgacctggctgcttctaataacctatgctcagatgcagaagcaaagaaataacctaaacttggaatttttacttaaaagggaagcagagcttacaagtgtggaaaatttgcaacctagctatgtgatagaaaataaaaggccatttttggggaggaattcaagcaggctgcaagcaatcatttgctagggaaatttgcataactaaaagagaacaagtgctaatagccaaaataatgggaaaaaggcctttacagcatttcagagatcttctaggcagctcctcccaccacagtcccagtggtacaggaggactaaatggtttaggggataagcacagggcaccactacactgtctacctcaggaggctgctccttgcatcatggtccatccagtccagccgtggctcaaagagcctcaggtatggctcaggttgccactctggagcatgtaagctgtaagcctttgtggcttccttgtggtattaagccttcagatagaaagaatggaaagagtgatcctagtctctgcctagatttcagaggatgtatcagaaagcctgggtgtccaggcagaagcatgctacagggacagagtcctcacagaaaacctctactaaggtagtgcagaagggaatatgggattgaagccctgcccacaaagaatcccccctggggcattgcctagtggaactgtgggaaggaagccattgttctgtgggtcccagaatgtagatccactggcagcttgcatcctatacctgggaaagccgtaggcactcaactccaacccatgagagcagtcatggaggcttcaccttgcaaaagctgtagaggcagagctgcccaaggccttggagtctacccttacatcagtgtgacctggatgtgggacatggagtcaaaggagattattttagaactttaagatttaatgactgtcctgttgtgtttcagacttgggtggggcctgaagtcatttcttttggctgatttcttccttttagaatggaaatgttggccaggcatgatggctcatgcctgtaatcccagcactttgggcggctgagacaggtgaatcacctgaggtcaggagttcaagacaagcctggccaatgtgatgaaaatccccatctctacaaaaatacaaaaattagctgggcatgacagcgggtgcctgtaatcccagctactcaggaggctgagacaggagaatcgcttgaacccaggaggcagaggttgcagtgagccaagattgcaccattgcactccagcctgggtgactaagcgagactccatttcaaaaaaaaaaaaaaagaatgggaatgtttacccaatgcctgtacctctattgtaccttggcttggaagtaaataacttgttttaattttacaggctcataagtgggaggaactcatttccagacaagattttgtatttggacttgggacttttgagttaatgctggaatgagttatgactctgggagactgttgagaagagatgattccattttgccatgtaagaaggacatgagatttagggggccaagggcggaatgatacagtttgggtgtcccctccaaatctcatattgggatgtaatccccagtgttggagatgggccctggtgcgtggtgtctgggtcatgtgggcagatcccttatggcttggtgagtgagtgaatgagctctctgagatctagttgtttaaaagtgtgtgctaactcccacaacccccttactcctgctctcaccatttgagacacctactccccttttgtcttctgaaacaactacaagttccctgaggcctccccagaagctgagcagatgccagcaccatgcttgtacatcctgcagaactgtgaaccaattaaacatgttttccttataaagtacccagtctctcaggtatttctttatagcaacgcaataatggcctaatacatggggtaattgaggaataaagacccttggcttctttattgggcaaccatctaatgccagtactataggtcttttctctgggtggtaattccatttttctgaagaagaattcttcttggttatttttatttttaattttaattcttatgagtacatagtaagtatatgaatttatgggtcacatgaaatattttaatacaggcatacagtgtgtaataatcacatcaggataaatggaggagccatcatctcaagcatttatcatttctttgtgttacaaacattccaattatattcttttagttgcttttaaatatgcaataaattattgttgactgtagtcaccctcttatgctatcaaatactagatcttattcttcctccccactacccttcccactctttgataaatggcatcctactctctatctccacgagttcaagtgttttgtttgtttgtttgttttgtttttttcttgagacagtctcactccatcacccaggctggagtgcagtggcacgatctcatcacaacctctgcctcccaggttcaagtgattcttgtgcctcagcttcccatgtagctgagattacaggcatgcaccaccatgactggctaatttttatatttttagtagagatggggtttcattatgttggccatactggtcttgaactcctggcctcaagcaatctgcctgcctcagcctcccaaagtgctaggattgcaggcgtgagcccctgaacctggcaagttcaagtatttttattttagttaccaaaaattagtgaggacatatgcagtttatctttctgtacctggcttatttaacataatgtcttccagttccaactatgctgttgcaaattacacaatctcattctttttttatggctgaatagtactccattgtttataggtactgcatgtttttttgcatccatttgtctgtcgatgggacacttaggttgcttccaaatcttagctattgtgaatagtgctacaataaacatgggagtgcagatatttttttagacaatttttatagaaaaacaatttttctatctcctctcttggcattataaggctaactgacagagttcttattcccaggtgctactagagaagtcagaacttcactattcagttgatagactttcatttactctctcaccttccaatgtgcctagtatccccaggttaagacttctcttatttatttttatagcataaatttccattctaatgaggataaagtggcactggtctcctagctgagcagggtgagaggagaacctatggaggactccccttcatatgcagatttctcatccaccttcccccctttttaagattcttggttcctcaattgccatctttcaagattttgacaaagggaatggtttgctggttttgccctcctctgtgggcactttgtaattagcattctcaactttgttgattttttcctctcctttccatttcctaaattggtcctctcacatctctagttgtttcttctcgtcaccctttattactgacactttattgtcttctattctttaccgtcatttgacaagagggctttcaaaggtagcaaataaaaaagactgtattaattttccagggcttccataacaaaataccacagattgggtggcttacacgacagtaatacgttttgtcagtgttctacagtttggaagtccaagatcaaaggcgtcaacaggtttagtttctctgagacctgtctccttggctttcagatggctgccttcttaccatgtgtttacatggttgtctctgtgtgcatgtgtctaatgtctctttgtgagtccaaattccctccctttataaaggtatcattcagattggattaggggccactctaaagacctcattttaatttaatcacctctttaaagaccttatctccatggttacattctgaggtaccaggggttaggacttcaacattttgagaggacacaattcagcccataaaaaagatcacatttaaaacattttaaaaaattcttaacactacgccaaatgtattgcaagtattctctatccttttacttaatgacgctgggaccatctatctaaatgaacactgctctctgaaatagcactcttttcattaatggattcgctcacttattaaatatcaattatcgtgcatctatttttgcaaggttcttggtttatcagcacaacaggatacagaggtaagccagactcaatatctatatacaagagggctttgttgagaaggataagaacaggaggctttttatttctgtgatgaacttttataggatactttaaagcataaaatatttgtcaactccttaatggtggttattctgaaaagaacttgaatgttttcaagggttgtactaatgcagtcatcttttacattaaatgcaacgttttgtacttttattttttttaagtcacttctgttacccagaagtcaggcacttataaaggctacttctgttactttctcttgtcaccatttcatttcaggaaatctaacagctcaactttcaattgcagaagagaaagtgaagaattgaacaacataaaaagcatactcccctctgcggtagttacacatccacaattacgctctgcttagggcaagttgggagcactggagtgggggaagaactgattatagaggggagctgagggtctgtagctcatggcacggctcccaacaatctggcccatggctgttcttacttggcaagcacatgaaattgaagatcactgctgcatctcatgcttctacagggtattgatccatggaaaatattaatgattaacttaagcaatacaatgagaggttgttactttgtactggcaatctttgacttgatcccctatacaaatcacatgcagaatgagtataaagcaaaaagaaaatgattgtttcatttactggtaagttattctggtccttcaccaaaatatgggaaactattttggtctaacatgagactactcaatgagaagtcataactgatatccctgaattttttataggtataaggttaagcttaagatgataatttatccgaagtcttctgaactctgtttttcttaggcagttttctgtatcttggcattgctggtactatattatggtagatatgaaatcagccaaatttaaacttgtctatcttttgttagaaagcatttggaggaaaattatctacattttaggattttccagttataacactgttgcctgtggcaattgcacttgctattagactcttcctgccctttttcaggaaaaagaaactcaagtgtcatttgttattcttgataccaatgctgagtgacctaacaaaaaatgccatggttggctgggcgcggtggctcacgcctgtaatcccagcactttgggaggccaaggtgggcggatcacgaggtcaggagatcgagaccatcctggctaacacggtgaaaccccgtctctactaaaaatacaaaaaaattagccgggcgtagtggtgggggcctgtagtcccagctactcaggaagctgaggcaggagaatggcgtgaacccgggaggcagagcttgcagtgagccgagatcgcgccactacactccagcctgggtgactgagtgagactccatctcaaaaaaaaaaaaaaaaaaaaaaaagaaatgccatggttgtcttgttgcaggtattctgtatttgcctaccatactatgcagtgtccttcttacaaccacctaacctttctccctcccacaatccctgaacctgggtacaattgcatgtagataaagattgacagatggttagcacatatattgatctaggcagataatctcacagatgtgatatgcgggaaataataacatcaaacagctttggaaaagatgtgtaaacactgtgaattttttgcttctatcactttaagagttggactgatttgggaaggactcaaactcttcaagtctagagtcttcatagataaaatagggacattttcaacttcctcctagaatgatgctttcttgtggggactgaatgaatcaatacacatgaaagtgcctctctcccttgatatctacaaatacatgtgcacacacacaaatatacacatacacacacacatatatatatctgtgcatatctgctcagaattctattatgcatttgtttcagtccagacacttgcagtctagtttagaaatcaagcatgaattgtatagcaatccaaatgacaacaaaatcttacaatgaaagacattttagaagctacatgattacatatcctatgactgtactgaaagtaacagagttcacgtgctccatctgaaccctcactgaatgccagtgcacacgttattcttaatactcaagatagttctgcaccttatgttttgttactgtgatttcaaagatatggaatgtgaacctcagagagggtaggcaacttggcggaaaacagaagaaacagatccacttggaccccaagcctggcctccttccatcaggccacccaatcctgaatttgaaacacagtgaattgcatcatgctccgcagtcttcatcatggaagagggagggactggaccttgaagaaagggtagaatttgggcagatcaagaagaatgcagggacacttcagaagaggagaggatgcgagccaaggcatggagacacaaacattggggacatatttgtgagacagtaatacaccagtttgtctataccagaggatctgtgtggatgaaaagcaagagaaggagccagaagagtcaagtggagctaattctgaaggcctggaatgccagacaaaggaatgtcattcactagctcatacagaaaatgagaaactgtcaagaaaccactgtgctctgttacagagatatcaagatatcgaacaaacaacaaaacaaaacaaaaataacaacaacaaaatagtctgtgtagggcttagagcccatgtactcctatatgtggactaggactctggggctatggcagaagtctgtgtggagggccatgacagcacaaggaagggagttgtcatttggatctggcatggaagttgtcaaaaaaggtttcacagaggacatggatttatgctggaagtgacgggcagtgaagaaatagtttgaactgtggagagtatgataaagataccattttcagaaaatgaactcagtagcagcatccagagggcataatgtggagtgatggctagagtctggagactgaggctaattaaataggagatcattgcagctatccatgcaaaaggagagggtagtggcagtggaaatgaagtcacaggaaagcatgagattttacagtgtacatctcagaggacttgaccttctggcagataaagctgatgagggagaggaggattcagtgatcactctaaggttctgagtttaagtggaaaaatagcaatgtcctgaagaaaaatacgggattttcttcaggagagcttcttcaaggaaaaaggtgtgctcaggtgaggaaactgaagcataaaaagagaaaaaacttgcccaggttggcaacaacttgccaatacagtcagtgagtggcagactctgagttcaaacccagataatctaaatatgaactgtctaatacggcagccaatggccacaagaggctgttgggcacttgaaagggggttagtatgactaaaggactaaatttttagtcttacttaatatttatgaattaaaagactgatagttgatttaataatactatatttggaacaacttgggaagtgaatctatatttctaattgtaaatcttatgagatctaaatgtccaataaagatccagtataattgaggacaattgggcatccaaattaatatgtgatgtaagtaaaaaatacatacaggatttcaaagacaaagtatgaggaaagaatgttaaatatctcattaataattatatatattgtttacaagttaaaataatctgatacagtgagttaaataaaatatatccttgaaataaattttacctatttctttttaccttttaaatgtggtaccagaagacctaaaattacgaagtgtctcataatatttctatactccagcgttggtctatatcctgagaaatacataaatgagaggtcacctgcatgagatgagtgacgtagttaatgggataggctattcctttcctaactctaaatctctattttcggaagatgactgaggagaatgccaacattgtcttaattcagtggcacagtgggccctgaacatgatcacattgttaatctccctactctcttgtccgggtcaacaatttcacagttgtcagaaaatgaacaactcaaattcccctttcttggtatatcttacatttttttatgtctcaaaggagaattatttcattcacatctgtttctgtctttcaatgaccagctctatcttcacgtcagtctcaatctaaagccaattttatcagagaatcccagagacaagcccaaagaggacttcttggatctggcctgagaaaatagtaaccagaaaaccaggggctattcaggatctgggtgtagcctgtatgcctgaatttttttccatgggggttcgttcgtagtctgatagtgaaatccaaatggtgtgtttgagaactgttgacaataatccagatgtttgctctactaagagtcatatgtgtaataaactaaaggtggacaacttcaattgaatggaataaaaggtcagagctaagcacttgtaactctctaggtattgcaggaattcgggtagtatcatttataaagaaaaagaatctaaaattctaccaattttcaggcattcagtgcatatgaagcaatgtgtccccaaagttagatcatccagatgttttatgttaatcagagtaaacatatgattcatcacagattcaacaaagtcaaaggcagaaaattcacatctacttgcaagctaaggggtgtagtgctttttccattttctatgccagctctcttgacatacttagcacttacccatagaataattgaggtcattggatttataataaaatgccattacaagaaatgctaataaaattatatgttctgtacatatagatgtatacatatacatatattttatataattctgtgtgtacatattgcatgtatgtacatacaatacatatatgaagtatttcacccaagagatattcccacttttcgaaatattgtgtatgaagtcttagtacaacagataaactattctactttactcctttttaatttctaggtattattttaacatattggctgtatatcctttgttaacaattctctataaaagaaaacttaagcaaaaattatctataacttttcatttatacattatatttggtatatatcatattaaaatgtacagaatgctaaagtactatatctattgattatagcaatgaggtgctcacaccgataaggcaaataaaaagtaacatctccagccaagagcattggggaagagataaagaaatccattacaaaggacattaaatgcatttgaaacagcttcaataaaatacccaagctcctgggaaaataatgtatctaaagataaaatggttttcagaactactgaaagggaataacacacaaatatccatgtctagccaaacaaaacaactgtacacctattgaacttccagtaagaaatgtttggttaaaaagaaaaagctgttaccttttttttttttaataaacaaacaacataatgaaaaatgatagagcactcaagctcatggctaactttcactgtgtggccttaaacatacttctttccagtgacagagtactagtactattttttgttggtttcttctctgttctcctctacaattccaaaattatgtagttctatccacagccaacaaatctctaacaattatgccaaactttggctgatttctggcaattgtaccacttaaacattcatatttattgctgaggatgtaatagtagggcagatcagtccatcacaatgtctctagcaaacattcgccgctatctactttattcctagcatggaccattccacgttaggccctaattacctgcactttttgaaaagcaaaaacaacaacaataacaacaaaacgctttacttttcctgataggtttgcatttagccattgcagaaacatagaacttaaaagaatacaaaatttaatattgtaatccatcatcttgtattagttaccaccttattacctgcaaagcaaatgattgctataagtcccctcattagtctccttactctagtcttctggtattccaaggtgtgtcttcattgctgccacttcattctttcataagcaaagctatgatcataggactccctctcttcaaaatctttaatagctcaccttagtttagaaaatattcctttgcttaattttcatgaccctaaaaatatagtctcattctccttttcctgttttatctcctatctacatgattgcctctcaagttcaataaattctgaccacactcaattttttttctataaacgttcatgtattttcctacatccacacctttgtgagattgttctcccagcctgaaatgcccttcatcttcaactctgcataactgaatgcaagctgcaagaccaaatgtcattttatctacaaagcattctctgatactcccagttgaaagtaaattctcccttctcagagctgccaaaatattttactcctgctttctccatggtacttaacagaacacatgggacaatatttagagaacagatgactggtgcctgggtcccaactccaggatttacctaacaattttttttttgtttttttgagacagagtcttactctgtctcccagggtggagtgcagtggcacgatctcagctcactgcagccttcgcctcccaggttcaaccaattctcgtgcctcagacacaagagtagctgggattacaggtgcatgccaccacacttggctaatttttatttttggatttttagtagaggttttaccacgttggccaggctggtctcaaactcctggcctcaaatgatctgcccaccttggcctcccagactgctaggattatgggtgtgagtcactcactgcacctggccacatttaactaactttatggtcttcagtaagacctttgaatctgctgggtctcagttttcttatcagttgatgtgatagtcaaaggaaacaatatatgactatctactttgcaaactgcaaagtgctatgtaatgtgagttcattctctgccagccaccctctttttaggcactgcctttcaggagagtacttcatcctctttcatgaccttatttgtaagataatccctgaatagcccagctggtggtaggtgtttggtctaatgtactcctagaggactattaaagtccttatgtagttataatttatttttccctttgaatttttgtctgagcagttcgactttgatttttttgaaggctaagaatttttctctctcagttttgcattcctagctgaaaattttgaaatcagttcctattcagtaaatgtttgctgcacaagtgaatgtatgagtgaattaaatgaatgaatgaatttactgatatcttaatgttgtggacagttatttatgtttagcacttatcatctgtctttagattttaagctccatgagggcaggttctttgtatgatccatgtttgtatccttatagttacatgtgcattatataaaataaatacttgcagaaagctgaatagaaaaaggtagctgagctggatgacatggtaggaggctcctgtgcatagagtttcctgtacaacagtttttttactgacgtgcatgcaatcttaacatctgtttaattcacaaatgaggctaatatttattattgacattgaaatttcttttcaaattgaataaaagaatgtctgtaaacatagatacatcttttgatggtagagtaacacaaacttcagtggagtcatctcttagattatgtggcaagaatctgacatagtcacttttaccgtggagaaccccttgaatcacccaatgtaaggcaaaatgttcacactcaacagttcaccaaaggaactgagatgggaagagtggtagatccacatctcctacctcaatcacacttactagtgaacatagatccattgcacgtggtggcagatggggcatctggaattgctctattggaatttttatatctcccttgctctatctctcccattttacttagcacgtgtatttgaatttgcatcggtaagtccttggatggtgaaactgtactgaattgctcttttacagtatcaggttctcctcagtcacagtacgtgtaaaatttctcaatagcttagaaagattaatgggtctgtgtaaatctcattatcccttaagtaatttaaccccaatgatccccattgtaacccaaatcctagtctgacttggagaatccagtgtggtaagtaaaaatggcaatttacctttaaaaactgccagtgatgtgcaggttaacactcatcttcctactttattttgagatgactttgaacatatactgaagtcagagacaacagcaaccccagggctggaatgtcctgcttccacaggactcatcatatgggattcccagcatctatcagccttagaattcaagtgggtttttccccagagggaagactttgctgacgaaatgaaacatcagggagaagcaaaatctcttgcaaatcaaaatggccaagaactcccttgctagcagagtatgaatcctaccacaagcaacagaaggagaaaattagattgtgttactcttgatgtcatagccactggattactgcacaagaaaaaaaaaaaaaaaaacaagaaaagaaaatggaaacttgaagagaacaaagagctgctggtattcacagtgttcttgctatatacatgatggattgccatggtaacaccagtatcatatgaatcatcttacatcggataccggcatacattgttcaaaaataacagcacaaaccagagcacatattttcagtcagggtagcagggggcaggagggcgatttaggaaaactgtttacctatcataagggtgagttaaataatttattatcgcacaactgactttgagacctccgtacgcgtatgtgtttgtgtatttctaacttttgcctgaattaaaaatcaatgagtaaatgccgtatgcttcagtaattcctcatagactatgacaaactgaagtttatacattttgtgagctggtttattgtgaattctcatacaatcacaagcttggatttcaagaaatcttaggagaattttgaacgttttcatcatgaaaattaggcaaattcattgttttttgattcaaccattgcttagaaagaaacatcagagcagtagaatttgtatgtttatactcgaggtcaattataaaacacagtacgttttagtgtaatttactagtactgcagaaatgtgaatattgctatagcaatgaaaaccaaccaacaaacacaaagacctttggggtggattatatgaaaaccagcaatgtggagatcacttcagaggctcttacagtagttcacatcagttggcaatattaataaagacagagtggaagggactcatataagaacattataggtaaaagaagacttgatgatgagagacagtgttaagataaaggaagatgactaaggtgactcctgtgtttctagtttagataactctgtagtaatcaatccaacaaagaaatagaagaaaaagaccagatggtaagagtaagatgatgagttcaattttggccatgagaacaactgaaataatttccaagcagttagtaggagtctaaaggggaggagtggtcagagcttgagatgtacatttggaagttgctgaaagaacttttttttaaataaagaactcattgcctgctaatggaatgaatttaatgtttctccaaaagggtacacatatatttactgtctgattacttttgtactctcagttgaaaaaaaatgaattttacaagaatttattgaatatctattatgtaccaggacccagacaaagcaccagacacataatggtttaaaacataggcttcaaccttgtttccatggtcctatgattgaacgtgggaggaagcccttaggccaataaaatacataaatatgtaattgcaattgtgacaactgctcaaaaggagacaagaacccagtaagagtacaaaaataggcacctaacatagtctgagcgtttggagaatatttccctggggatgatgaggcctgaggatgagtaacaacatgctctactgagaaccacatgaatgaagcactgaccatcttttcaaattcaatgcacattccatcttgtctgaggagctgattaccttttccttagacacctgtaacatccttctcatcaaatttcttcccttaggggcccttctctccatcaccactaaactattttccttcctagagcaaccttcttagggcaatatgaaacacaacattatgggccaagtccaaagtcctgactattgtttcaaaggctgttagtagattgttcaccttcttttgcctttgaaaggtgccatcctgagcctggaatgctttgtcagcattcgccacttcatttatcatagtttacaaagtacgataaaaggtgataacagaagctttccgtttgtagttcatccatgtaataattttcttcaacttaagagcaaagccatgaaaaactaaaaagaaagttccaaagaattattaagtaatttaatgtctcttattggatatagaaatgggactatcatataaaggtcatcaagattgtgtagtgtcttgtactttgctgacagtaaacattccaagtactctaacaattctcattccactccttttggcaagcgagaggctgcatggttgggtgatggataaatgctgaactgattgcagaacaaaggtcaacatttatgacagtttttattaaactctagcagttgggaatagatttgaaaactgacctttttcttttttaaatctcagttggaaaatattacctattgtttatttcaatgttttaaaaacctcaatgataaataagacacaaagaatatgtttttaaattgcattgccaatgaataaattaataaataatcacttgtttctctccaaaatgaaataaagaattattgggttaattagcatgtaagaaaacagtagtctcccctactcatcttctccagtttatttttgccactctcctctctgcctcattacacttcagacaccttatccttttagtttaacacatcagggcttcattcatgtggttctcagcagagtatgttgttactcatcctcaggcctcatcatccccagggaagcattctccaaacactcagactatgttaggtacttatttttatactctcactgggtccttgtttccttttgagcagttctcacaattgtaatcacatatttatgtattttgtaattgtaatgaaattgtccctgtcaggatttcacactgcttccttctgttggtgtagggattcattcttttccattccaattaatgcagcattccattgccaaattttttctgaaacaactctttccatcatgccactcttagggaggaggaaagatagaaaatatataaattaagatttattatgatagtgcagtaacagacacagaagaaaagaaaaacagctagttaaggaggcacttccatttggaaatagaaaattatgaaaggtcttctaggaaagatctgtggaatgatgggattcatcacaaaatgaggagagaatggaactctaggcaaaaaataggtatagctagtagttatttatacctaaaatacacagtatacatgggtgacaagggcaatttacaaggatgcagagatgtggaagggaatagatcatgatggctgggaatgtaacctttttttttttttttggtagccactgaaaagctagtggtataagcatggaagcgtcatgatggcattttagaaagtggatctgtggatgacagtcaggaagaggatgttgatagaacagagactagttataaagttagcggttttcaggcaagataacatgagggttggacccaagatggtagcagtggagatggcatcaaagggtgaggtgaaggaggaagagtgtacctgcaactggatagtggtagagtggttaggctgagggagaggaagcacttaggaggacttccaggtctgggccataagaaaaaaggacatgggagatggggaaggtccctgggtaatttttgtttcaaatctattgagtttggcagcactacatagagaagagaatggggaactggagatatacattcaagttaaatctgttactgctaataatttttacccagaagtagggagaattagaacaaattctgaggataatttgaagttttgtttaaagtgaaaggaagggcctctcatcaaagaaagtagtccctttgttttcaaagtttttccttcataaaacgtgttctttgctgtattcgtctgttctcatgctgctatgaaaaatatccaatactgggtaatttatatagaaaggatggttaactgactcacagttccacatggctgggaaggtctctggaaacttacaatcatggtggaaagcaaaggggaagaaaggcatcttcttcacagggcagcaggaaggagaaagagtgccaacaggggaaatgccagatgcttataaaaccatcagatttcagagtactcactcactatcacgagagcagcatggggaaactgcccccatgattcaattacctgctactagggtccctcccacagcatgtggagattaagggaactataattaaagatgagatgtgggtggggacacagccaaaccatatcatttgctattaggatgagctggttatgatgaaaacacacaagtagtcacacattcacaatcgatgggtccatgcatttaggcaagagttcagcagagcttcacataccaggccaacaggatggtcgcttaatatatgtaagtgtatgtgtaattttgcctagtattttcaccactacttgaaaagcatatctcaatgtttattacctagtctggagctacaataatgtatttgatcatttattcagctatctttaatgaaatcttagtagtctccctactgaaagaataataagccctgaaaatgcagtaaagccacactaattcagacaaatcagaagacaggatggtttgaattactgaatgctttatattattttaaaagtgtagcagttgtccatttttaaccaggcaagaaagtgttatcttgtgcttaccacaagaaaggtaaaagaaagtattttcatgaatacctaaaaaatatcaatcatctagatataaataaaggtcttaaaaaagctctgaagttctccctgatttaattgattcacataaggttttttccaccttagcactactgacattctgggtcaaataattttttgttgtgagaggctgtcgtgtgtattataggagatttaacatccctattctttacctacttgaaatcatcagctacttcccacttattacaataaaaaaagtccctagacattgccaaatgtcccctgcatgagaggtggagggtagaattgcgtcagttgaaaatcactacacccctcaataataattttaatacctccactcctcttgataaaagctataaaaaagcaaatgttagtctaggccacgtttgaatgattatagagttcaaaataaggtggttgaatttgataaagatttattgtttgcaatgtgtacttgtttttctttggtacagaaaatgggacgtattcttctccgcaatgcctccctcgtgcaggttcatgcccattattgagtccacttttatgaacatgaagccactaattattcaggattcacagtcggattactatctctctccacaatcattattagtaaatcatttcatgagcacaatttgttatgggctgaattgtgtctaccccaaaatttgtatgctgaagccctaaataccagtatctcagaatgagactatatttggagataggaccactaaagaggagattaaaatttaaataagcctttagggtgggccttaatccagtctgactgatgtccttataaaagcaggaaattttgacacatacagagatcccagcgatgcctgcgcacagaggaaaggccatgagataacacagtgagaaggtggccatctgcaagacaaccagagtcctaaggagaagccagacctgctgacaccttgaccttggatttcacagcttttggaattgtgagaaaacaaatttctgctgtttaagccaccaaatctgtagtattttcttatgaccgtcctaacaaattaatacaccatttgagtaaattaatagcttgatgattggtcataaatctaagtgcatgaccttgtgatcgttccacaagaagagagcaggctggtttaccttcactcacacttactgtattccttcctgtcttctggatcttcgtaccctgctttttttctgatcccagcgataatagggagagcaagcctacctaaaggatttagaaaaacagaggccagagagtataccagaacagctgcatcaccagaaagagggagcacagagcaggcagcaagggaaggaccctcaccagcactcccacaagcacccccctaccaccccaccctgccccgacagtaatggtgtcaagccaccaaaatgcagggaagaaggcggctgggtgaggtaaaacatgacacccggctgtgaaaagtagtgctcaagggcacttgctttccattgccttggggtgccagtggctactgtctcaccacattcactgctactagtttttattttccattttgattaaaaaaaaatgtgacttttacattatagcaagacaacagaactggggcttatatgtcataatttttataactgattttatgaaattttgtgcttctatcaaatttcttacattttcttacagttgcagtattgtttccctctaggaaattcccctctgccacctcccacagtgactttttctcctcctttctacaacttgaagctatacacacacacacacacacacacacacacacacacacacacacacacacacattacatatatacaaatatatacttttatgaatacagaagtgaattatttcaggttctcctttgctgacctggtaatgacaaaatgcatgatccccaaccacttaagccagtaatctaaagtcagtgctacatgcagtttctacagggaaacaaggaaagggaatttaattgatccaaatgaataacagaagcaaaaatcttgccaaagactccatactgtggcatacagggaagtgattttatacacacacacacacacacacacacacacacacacacacacacacacgcccctatgccaaaatatgtaccatgcattttctaatcatttatttattaaacaaacatttattatttaacctgttctgggctctatgctggacactggggaagtaacaacaaccaagacgtgatccacacactcaaaaactttacagtccaattgggtgaggatgggttagaagagccagattaaatctgatttttaaatctctgtatgaagggccaggcttgattgctcatgcctgtaatcccagcactttgggaggccaaggcaggagggtcatttgaggccaactgtttgagaagagcctgggcaacacagcaagacccagtctctctaaaaacaaacaaaaaaattagcctggcacagtgacctcaactacttggtaagctgaagtggatcatttgagcccaggagttctaggctgccctgatctatgattgctactgcactccagtctggccaacagacacagaccctgtctcaaaaaaaaaaaaaaaaaagaaattgctatactaaaattgagacataaaagcttcataaaattgaaagaaaattatatttcttacaaaagaaaaagtgggacagtacaatttacagaggctaccaaaaattaaaaggaaaacatttttaaatcgcaaatatagaaagtaattataatcacagatggtagggttgtcattctcgtcaacattgagtttacttaagatttagtatgttaactgctttcttgatgtcttcattgctgctcttgaaataaaaattgagaccaattaaatgatcatgtggtcatgtgtctaatctaggtgattttctaataatttgggaattatttccctgttttccaagaaaaacatgctgttctttcaagaagtcattattttataaggatatacttagctttaaatcgagctatgttttgcacttatgcatttgatttcctacttcattttctctatggattttcgtgaaaagccaattttttttatcttttattttttgtcccgcaatctctgcttctttgggtaggctgaaatatcaactcatagctactcttctttagatgtctttccctccctcccttccatccttccttcctcagatttttttaagtaattagaaaacaattttctttctgccaaaaaccacaaccgagatgatatgaaaataaacataaacatgctactttagataaatcttagtcccagcaagcattctgaaaaagaaccattcaaaacttaggtagattttagtgaatctaagatgatgactcaccattccaagtgtattgttttctcaacagattcaaaagaagttgaggttttaaaatttacaacttaagaaaatgagtaacagaataaaaagacaacctctatgatttggatgttcttccattcattcatccacccctctaactattgttttcattacatgtttgttgtcatatttatcctttcgtagaatgaaagctccagatgtaataagttaactttttatataaaatttatttaattgatttactagccataggtaagtaatgtattctactgaaagaaaagatggatctggtatttttacaaatcccaagacctatacaattaaatactaattattgtaaaatgcctttcaaatatattttcttgtaaaatacactgtgatgcccaattttaagcctaaataggtatatgtctgaaattttctgggtctatgcatatacacaatatacataaaaacataatttgactgacttgtacaaaaagttgattactttaaagcagaaaaattaaggtaatatgaacagggacattagatattcatgtggattttgcaacttgtatggatttgtagtatcgtcccaccaactaaagaagggaatgaggtaactgacagcaactgagccatgttgggtgtcttaggacacacttttctgaatgtattttaaaatagttgcttggtgctgctagccggtcataaagtcaaatagtgatagagctggacagaaaagccttgatactctggagaaaagaataaaatattgtctcacaaaaatcagaaagctttctgaaggtttagaaactttttaatcacttaaacatcccttcatgtttataataaggtgaaatctggcaaaatgcatgctttgtgagtttgtgtagatataattagaaaaagaaaagtagaagagtaagatagtaatgacagtttccaagtaaaatacattgcttttagaattttggattttcattatgtggattcataaaattagggagaaatggaattttcacagagagaatggaacatctttataaatgcttctgaagttcattgttaattgctgaagaaaatgacgttgtataaaaccaaaattgaggggtgacttttggacatattagttaactatatcatcgctattctgatactacataaaaagggtgggtcgggggtagaacacagatctaaaatgacaacttttttataggaaaaatacataaccttgttcttccctccctagcaactacaggaaaacaaatgtttttgtagaattataactcatttattgcattaatgtgttatgatgcattaaggaatgtcacatgtagattatgagttactgggcatctggtataaacagccatatagccatcaataaatatatccattatttggctaaatcctctttcaaattctcatcatgggtgattttgatggcaatacaagcactgacaatctctcaaattcttaaaatctacagaccttgaaaccagatcagcttttgctaaatagctaaactatttccagctttcctctctggttaatttttttcccaactatccagtgtgttgaataaaaactaacttctcaccctgaccctcccatttcagcagacatccaaagcagttaccaaagggcaacaaaacacattttcactgacaaacaactagaggaaaggaaagcagttaccgtctcctctgtggcttaatatcaattggcatgttgatcgcgtatggtgatccatgaacataagcgcttcggaatctagccaccttccccagagtcaggtactcacagctgcttggcaaactcattatatccaaaaggcaagaagtaaaagcaaatctgagtagtcagaccagcattcctgggaaggctggaaagaacatgtcagataatagatttcagacatatgctgctcactggttgcccggtgcttctttgcttcaaaagtaaacgcgtgtttctcggaggctaaatgtactaccttgttttctgttcattctgttcatggatacaagaagctttttgcttatttctaaccaggctcatgctctgaccaattattggctgagtagataaagcagaaattctgtagctccacaaaagcctatttccactcagaccaaatctctgagtaggcagcaaggttttatccatttttgtctaacgttgaaaagaacatcaacctaatgtaatagtagtttggtaatcagagttatttacctgtaaacaaagcatgcatatctgataggaaggaaataattatttgctatattttcgaagagggaatattgttcactaaactgttatagatacttagaaaatgagatgggtatatggaaatgttatgggcggttttccaattctctggtaaaaaaattgtgggttcttattcataaattactattcatgatagaactgaacttagcctctcaggaacataaaaacggtaagcaatgtctttattcactaaaacgttgatgatgatacacattttttttcctcgtttaaaacactctttgagaaatgcaccttctacctgcactttgaacgaagatctatggaatcattgatagtgaatgttactaattctttgtaagctgttttttcataacagtgaaaaataagttggagaaattagaaaggatattaaataattctactgaaggcagcagggtcttagagaaatgctgtatctttatcccacagtttttctagcctttatgccatttgctagagttatagcaacaaaaccacaagtgttcagggtaatgagagtagcaggtgttcagagtattctgtgagataatttttattttgaaaaattatttcttatccaggatttgaatagacacgccagtttatttaagcatcctgggacctgggtaaacatacagtgtgctgaaaaagggctacattttattcttcagtagccaaattcagacactgtttgggtttaaacagcagacactgttaaaatccagaaattttaagtttgaaagagtagataattttccttttttttaaatcttgtattttaggtttgggggtagatgtgaaggtttgttacataggtaaacttgtgccatgggggtttgttgtacagattatttcatcatccagatattaaacccagtacccaatagttaccttttctgcttctctccctcctcccaccttcaccctcaagtagaccccagggtctgtgtccttccttgtgttcatgagttctcatcatttatctcccacttgtaagtgagatcatgtggcatttggttttctgttcttgtgttagtttgctaaggataatagcctccagttccatccatgtccctgcaaaagacacgctctcattcttttttatggctgcatagtatttaccatttctattcaataattttctttcttatattttaggtttcaattacaaaattatacatgctatttttttaacatgccaaatgacacagaaatgtgaagataaaaaagattgctgtcttttcccttccttggtaggattaatgggagggaaaagacagcaaactttttatttatacaaatataaatataccacacacaatacacaaaccctcacacatgtatagggattctccttcctttttgaataaagtgggctcatactatgtataatcctttattaatattaagtcaatcatgaaaaaattatttttgtgaatgcacagagacctagtgagttcttttcaatagttatataagattccatggcataaatgtaccattatttattcaatgagtcctttattgacggacatataattttggactcatataaacaataaacacatttgctaatatattcttactgattggtgcttgtatttctgaaaatggattgctagcttacaaattgtgaacatttttccctttaataggctatggcagttcatattcccacagtcatgttggaagatgtcaactcctccacactcctgccaagactatccattgttattcaagtttatttctttatagtatgaaaataaggtaggcagctctctgaaatatccagtgattgcatacagttccttgatgaaataaaactactattaaggtgtcgcaaaagtaagaacagcctttctgaactgaaatatatattgggacataaataaacagcttagaaaggctttgcacaggtgtacaaaaggcagaagtctggagtctcatcagaatgagagaacactcaatgcaaagttagtaaatagtaaataatttttattaatttgcataattatgaagagaataaatatagcaaaaattctgttatgtttttactcttcagtatatttttcttaatgggaataatatttcataatttgggagaaacatcactaattttacaatatggatgtaatgcctaatgactgccaactaattgtgatgtatgactggggtgtaatttgtagattttgcataaagaggctctttggacatactccttcatttgagagtctgaagaacaaaagctcaatgaagcattttcacatgccagctaatttaggagattgcccagtagaagagaataagatttgcttcacataagaatttcctaggaggggtaacaatcagaaattgaagaataagatataaacctctatggtagagacctatgtgtcctatgatgggtaaaattccagagttttcttagcaggggcatttttgcttgtacccaggtaattatttaccaaaagcctggcaggggctcctggggattacctgtacttaaatttggatgagagaggattactgttaaactccagcctgccaagaattcagagtctgtgagaactctggccaactagcaggaggtggcccttaagggaagaaaatggaatctttctatcgtcaacaattccctttctctggggctggagagaggtagttggggacttgatctttaggaaaataagaacacattggagagtttaatttcatctaaagattagagctaccatccataccaggcctacctccaaataaggctcaaatcttattaaggaatggccatgattacccatctatgttttgtttgtttttgcatactgggatttctatggaagacaggtatagagtctagcaaaaatctcacttatcatccccatgattctatgctcttgagaacattaaaagaaaaggagaactcacatgaaagcatctggaacatcaattttcatcactatgctagacgttgcaacgttaataatgccctgcacagcaattaaaagtaattgccagcaagcagcaatttcaatccataggacttttcttctaataactggaataatacatattaattaaggttctttcagcctttaactctaccctggcctacgtttagcaattttaaatgctggaggaacttctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgaggttatcatctgttaatgaccacatcagagcataagaattgactgaacgatttcccctggcttatggcttggaagactccttccctccccaaccctcgtgttttctgctcatacctggactggagacccacaaaaattggggtttgcatctgctctcaattcttggagttgttcttgattttgatctctacacttactggtcaatgcatccaatgaattggctttaaatattctttatgtgctgaaaaactcccacctctttattcagagttcacatttttctgctgttaccatcagctgcacatgagaaaattccacttgtaagttccatagctagttcatttgagcatttataatgtaattcaaatcaactgtgttcctcccctcctccactccctctccccacatttcttcttatattccctagtactggccaccattcagccaataaccagacaataactgctaatcaggtcacaaaccctagagacatgaatactattgatagtaacaataatattaatagtcaatagataatagctaacactgatcagatgcattcaatgtgctaggcactgtggttggcaggttgactaattctcataaaatatgagttgggccctattattatactcatttttcagatgagaaaaacaagacactgagggataagatatatacccaaggtcacatagagtgttaagtggtggagtcagagttaggaaccaattcatctgattccagagaccagactatatcttctacctctctacacattctttaatctctctcaattatctttccccctatgttttgcctagagttaatatttccattttttcctcctcaaatctatccttcacttacctaccaagattatcttaaaatggaaatcttagcaaactcatgcaaggacatgaacatgtgagtcctttgcttgaaattatccaatagttccacattatttagtaatgaagttcaaaatttaaattccaatactcagcacagagatgctctattgttttgctctcccttcctctcctgtatcagccacaaataacacttggtagtgtctttcctgtacacagtctgttcttctggcccactggggcttcccaaatgataggtactctggcaagaacatttttctctttcttctctggctggctaattccttttaagcgtaatctcttccaaaaaacattcttcattcctcagttttacttagaagcctctcatctattttgccaactcacatgactttaccacactgtttcatagctgttcatgcatttacaactcttccccatgacttttcttgagggcaggaattctgccttctttgaccttgtaatccaggaacctaaaacaacatttgcttattgaacaagatagctgaaattgtaaggtcctgatgctccaaagaactgtccaagtctttcctgaactcccttctcagttactttcccaagaataataattataaatatttgacaactgaaatacattggaagtagtggagctattcatcatatgcaatcaaacagaaatactttgcaaagagtgcccaaaggaacatgagagcaacatcttttctcaggaagcaagggatgaatgtggattttaattagaggtgttggagatgtgcctgcctgggctatcagtttcagttcagtaaagaaaagttatccaaatacttgaataagctcagtataatgccattatttaatcaagctctgtgttttgagagtgtactggcaaattcaaaattaattaaacactcttctattaagggtcagctacttatgttcatacattagcttttcttgttaatctactcttaaacactgcatatattacactttgcagtcttacacacaatggctacagtcagaaggaaataacagtgcaaatgaagatttaactatcatgaaggtcatcacagtgtcttacaaaataataaaaagatgtaaatatctttaatgcccaactacttaaaataaggaatagccaatcaatgtgaatatcatgaatccattaaaataatgatattgaaaaacttccttggtatttatctaaatgagttgaaagcttacatccaaacaaaagtcttcatcaactgaaacaaacatactattctagtaaaagatgttaacattcagatggataagtagtttctcagaaattttattagcatgacctaatctctcagattgtaaaaactgttgagactgaattgtatgtcttcttcgaagttaaagaacataaaatcccataaatcagctagtcagcaggcccacttaattttataacaaggataacttttgatcaaatcaatcaactgttttgtttttataagcaggtaagtttgagatgaatgaagcataaggtctcatctttttaaaaatgctttattctccagctaatggagcctctttgagagcggtttctctcaaaatattattttactattaactgtcattgcctccaaaacccaacagaaacccgttggtcacataaaggcaagtttattaaacctacttaagtaaaggagaaaaccacatggacggataccttagaagaggaagttagtgaatcaggtatctaagtaagttttgtttgttctgctttgttaaatacaaggacagtaaattaggcctggtccaagtgccatttaacaggtaccggaaattatgctggtttcaattctcccatccaacaaaagcccttagctactggtaatcttatctcaacaaacctattatatatccaaagtttaggctgagctaaagcagcaacaaaaccaactgaataaaatgatgctcattcattgaaatttcaggtaggcccacacaattcatatttccaagctctttataagctgtttgaatgttaaatggagtggcattttgctttagaatgtatagaaatggaaacaaatgagtttaatatacacaacaggctttgacaacatgacttcttcgacagatgtcctatactacttcccacactttcatccttaaaaagcatagtctacttgccaagatacaaacggttgccaatattcagctgcaaaagaatttccaacagtaggaaccagtggaaagaattaaaacactttaaacttatttccaaataaccaaatgtatcattataaagttgtaagataaaaaataatcatgctgcaagttcttactctgtcaactagctagttcagcaaagaggaggggtctttggcaaacaaggctctatatttggttgccagatgacttttttaaatctatcaattcatttttctaccccaaccagccagccagcattaattgagcatgtactatgtatacacacaagaagtagatggcataactcctatctaggaaaaaaaaaaagcatacaattcatttgatgtgcaattcatgcatcaagacaggactgatttcaattgacaatattatgagatagaaataaaagtggtacagcatcagcgtattagtctgttctcatgctgctatgaagaaatgcctgagactgggtaatttataaagaaaagaggtttaattgactcacagttttgcatggctggggaagcctcaggaaacttacaatcatggcagaaggcacctcttcacagggtggcaggagagagaatgagtgccagcaggggaaacactagaagcttataaaaccagcagatctcatgagaaactcactatcacgacagctgcatgggggaaactgctcctatgattcagttacctcccaccgggtccctcccacaacacatggggattgttggctgaactataaaattggaactataggaattatagaaatgaactataattcaatgggaactaggattcaagatgagatatgggtgggtacacagccaaatcatatcagtaattctgttggaaaccttgtggctggctaacatcacatcaagcttaattcagcttgcaccatcatttactgctttttattgtatttttaatgttctctgtcctaaagtgaattctgaaccacaagataggaagatatatgacttgtctttaaattcaccacagtgccctgtacactgttctatatatattgctacagtgcctagtatgtgtctctgaaaatagtagatgcaaggtaaatatttattactaaaaagatgtgcaagcatattttacgtttgtcgagtttttaaactaggggactttactcttcagtttgtctgaatagtatacagctattgccctggaatgatgattaaatagtgcctccttttacttttgcaatattattgcttggattataaattatctggttatcttctggctctggaactgcacacttacaatgttgcctcaaccacttctgaatgcatctcagaggcaaagactgaggcttactcattattgcttctccaaatctatttctgtactccacctcttctagggtctgcatcaatgatccaaggaaaaaaaaacaaataatagagaaactcataataaactaaatcagattgaatacatctagaaaagaaacaaaagtgatccacatggagataaattaggcaggcaaatattgacctgaatgttctcctaaatgtaaatgatacaaaagttgtctccttgtatttaaatccatacagcagtgaaatatcattgtcattgtcaaatatctctagatccctgagtttattcagcataatttcaaagttatttgcttgcagggagagatcaagaatgaatatgttggggctgggtgcagtggctcacatctgtaatcccagcactttgggaagccgacgtgggtggattacttgaggtcaggaattcgagaccagcttgaccaccatggtgaaacctcgtctctaccaaaaatacaaaaattagctgtgcatggtggcacacacctgtaatcccagctacctcggaggctgaggcaggagaattgcttgaaccctgggagccagaggttgcagtgagtgaagatcgtgccactgcactccaacctgggtgacagagcaagactctgtcaaaaaaaaaaaaaaaaaaaagaatggggatgttggtttcagagccaagtgactttgggtcacaatgctgcgctgccataaatggcttcggtaaccctggggaagaaataacacctttctggtatcagtttccatgacacttaggccttattcactcattcaacaaatatttatcaagttactattctaggctctgggtacccagtagcaaatagaacacatgcaaatattcctgcctttatggagctgacattccagtagagataggtaaatggacatagtaagtaaaatatataagagaaatgataactgatacagaggaaaatacagcagggaaggagcccaaggagttcagggatggggtgagaagagggactgctttgctgccatggagcccttggggttgggatataggggacataggatgactgagaggctggtcttcctgtgatgactgactcaaaaagggataaaagggtagaaaacactctgtagaggtaagcagctaggtgcaggcatgggcagtggttggtacactgcttgttaaataaattaggaagtgagtgaatgaatgaataccttcaatagatattagctgccatcctaagatgtagcaaatctgtcacctgagaaaataatccaatgaagctaacgtcacctagagcttaaccattaagattctgtaagtttctaaactgaaacatctctcttaattaatgaaagagattcattttttcggtcatgattcattcctttcttgatagactattgctacgttatcactagataatttaatatatgcaattgtgatttagcagtcacttaaagttttcatattaaatttgatgaattaatcccaaatctaggtaacatagaatgtaaaggcaataatggaaaacataaagtggtgacaaattaagagtaaattagttacaagtagcctaagaccttactaactaccttaattatttagcaacagaaaccggtgctaacattttaaacacctttacttattcccatccaaaaaataatcagttacaaatgcatagaatagtcactactgataacaattacaactaatatctattgaacatttacttggtgccatcaagcactattctaagaatttttcatgtaacactggtcgcggtggctcacacctataatcccagcacttggggaggctgaggcgggcagatcatctgaggttgggagttcaagaccatcctgaccaacatggggaaaccccatctctactgaaaatacaaaattagctgtgcatagtggtgtatgcctctaatgccagctattcaggaggctgaggcaggagaattgcttgaacctgggaggcggaggttgtggtgagccgaggttgcaccactgcactccagcctgggcaacaaatgcgaaactccatcttgaaaaaaaaaattttcatgtaacagatcctcatagttaaaaggttcattagaagccatgggaaattcagtcttcccctaatgcatgaacagccttgaaggaaaaacaaatatctggttctggcatgaggagccctgcttcatggtatgcttatctttgagcagatttaaatgcttatctttgagcagatttaaatatcgaaaatttaaatattgaaaagtttgaagatttaaatattgaaaagttctttgtatcaaactaaatttcacctttctaaaagtgctattctttgatcatagtcattcaaaaacaagcctgagtcttatttatttatttagaagcagggtctcactctgtcacccaggcagaagtgcagtagtgtgatctcggctcattgcagcctccacagcctgggctccagcaatcctcccagctcagcctcctgagtagctggaattacaggtatgggccactgcacaagctaattttttaaaaatttttaggagagacagtgattcaccatgttgcccaggctggtcctgaactcctggactccagcgatacacctgccttggcctcccaaagtgctgcgattacaggcgtgagccactgcacctggccctgaatctttttaatatgaaaacctcagattatctaaacaggagtttttattctctcccttttccaggccacatcagtctcggttcttttggcagttccgaagacatcatgattcccagatgcttcaccatcctggcaacacccttctggactgattgctccttgttgatttcctcttaacctgtggtatctgaaatgaatcccacaccccaggtgtgatatgacgattgcagggcacagaatgtcagtcagcttaatttctctgctgtacatctatgaataaggcttaagacagaattcctcacatattcttcatttacatgccatcacccttgggcctctaccatccaattctaattaactgtgcacttgaaattgcagtcatttttattagcaagcttaaataactattgactctgactttgcattccagtgtatttactatctctttatgtttctgtatatttgtttgattggatgaacggtcttccatccaggcaaatatttagtctttactcagtattctttatctatgttgttcaactaggaaaaaacacacttaatagtatttttatccaattcacacatccattatagctaccacaagatacttttgcaaatattttaccaaaataaaaaatacactatttatacagcatattcctgagttaccagacaagtgatagtgagattatggctagttttgtgtaaagtgggaaatgcaaatgataacaatgggctttgggaccattttttattaatgaaagataaggctttgtgagagagaagtaaaagaaattataggcagtatcttggaagatcattcagatattaaattgactttgtaatatagaaaaccaatttagttgagaccaaggcagtgtaacttgtggggaacatcaaatagtgaacacagactggggaatgaaaatgtggtttgacaacatccaagttttcataatagataaactagggacaaatcagcaagttaacagcttaatacaaactcaaggaggtcaagttgcaacatcagggtctttgagctcattttcccttgaaagagattaaatgagagctcatactcactgtgaagagtgacacccagagaaaattcacaggagcacataatgtgagtgaacaaatatttaaataagttggtacctttttgcctggaggtaagaagacagcggtgatttaacaacatgttttggagactttctgcaaaaattaatgatgcctattacattctaccttctcttaggaaatataaaagtatgtgattttaaagaaaagcagagggaataggtgcagcaacctaggaaggttacctggcagtagagggtcattaagcactgggttcttgttggggaaattttcaaaatatcttcaaggacccatttgtccacacccaattgccatagaagttcacagaggaaaagcccaagctaagagtatatcatttatatcaccgaattagttgttggtagaagtcattggcccataccatcttgctacgaaaagcaactctttttaaccttttcccaccactatacaacattaaaaagtcaatcacttaattctaatttattttgaccttagaaaaacccagcagagtgggaaatttcaacagatacaagagaaaaataaaatggcccctgtcctcacaaagcttacaatactttttagaagaaatgacttaaacacaataaattctcagtcaatgtgagatagtacctactgtgtggctcaaacataaaatgttataagagttcagggaatgtaaaatcaatgctcgcatgaagtaaactaattcagtttacacaacgactcttttgctaatctcattccaggcagacgacagaatgcctgaaaaaaaattgattgcgtagtttctagaatatgaatttgacaatctgatcatttttcttatgaatagacacaaagaaatagataaagacagcaaatgttatactcaaaggcttacataatgttaccttcaaagatggcatatgtttgcactttattttttatttccataaaagaaatggcagaattcctgaacagcatgttccatttagaaataaaagcatgtactctctcgttctcctttccaatactggaaaatcaatagtgtgattatatggagacagaaaaggccgggtcatctgaactaacaatatcattgctattattaataataagagtgcagtatctagaatttatttaacgtgattattttgccatcatgaacaatgttaatccccacaagaacagatggtacaaccatattttaaattattcaatgaagtgtgttttttaaatcacaaatgtgtatgagcagagtggatgcatttgaaatttaacccttgcttatatttttgctgtcatacagtctaagagataaccagtcaatggagaagtggccttttctctctcttgaccttttggatacaatgatgatagaaaataggtaatgaggggaaaaaaaatcacagaatttcatatggaaatttttttaaagagagaaaacaagagaaataaatgacttgtttagggtggtacaagagggtaacactaaggtggcagtctcttctcagtgagctagtaaacattaaactattgagatcaaacaggaaggtatctaagcccactctccagtgcttttctgcaacgacacgctcttcacagggaactataattttagcgagctccatgaatacttagaagatcatgatagtcagggtacttgtcttttttgctttgggctattcatacttacagcatagtgagaaaacaagagaaagcttctctggggtttttctaaagatatcacatgcaaaccctgggcttggctacagaccttgggccttgctcatagatatggaaaaattggaatatgacattaatgccgaaagataacaaaggaaaatgctatgacctgaaaggtgtaggatagagtgggtaaattggtcctccttggatcaaatatggacagcaggcctgagtttgtccaacatatttttaattttgtttttccttttgatccaacatttaaagcacacagaaaatgtcacattaaagttgagatttgggcttcttttgaatgtttaggaggtttaaaaccttcagttcccagtcgggcgcggtggctcacgcctgtaatctcagcactttgggaggccgaggcgggcggatcacgaggtcaggagaacgagaccatcctggctaacacggtgaaaccccgtctctactaaaaacacaaaaaattagccgggcgtgatgtcaggtgcctgtagtcccagctactccggaggctgaggcaggagaatggcatgaacctgggaggcggagcttgcagtgagccgagatcgccccactgcactccagcctgggtgacagcgagagtccgcctcaaaaacaaacaaacaaacaaacaaaaatacctagagttcccctccctacatattgccagctatctccttcagatggggcaagcattctccagtttgacaatccccattcaagttctgtaactcagatacatttcttcctggttctgtaagtatttaatctgaaggcctttcaagtaaaactgagttaggaaaaagtaaatctgctaccacctggtcaaactcttaaccaaaacatctctaaaaccaagcacttttagagaatgtcctgtccttcccaccacaatttacttacctaccaggaactattttcaactctttacgaagcactaaacctgaattccaatcgatctggaattacctcatttgttatgtatcaaaaattctctaatatattatgaaaaaacctaggttttatttaccaatgtatgcctatatttaaatcaagataaataagtcaattttagtgaaggaagaatcattcagtaccacatttttcatgcattcaagaaacatatccagtttatgctggcaaatactcccccaatggtactgacatatattgttcatctggcttatggtgacatatctgaagtttctgataattctgttcccaacatttatatggtattaaattgaccctatgcaggctgaactgcctgaaaatacagattctgttgcaatttgtctgtagttgtaaagaaagtcgattatttaatcagaatttaagaagacttctacatgaccttgataataccaatgatttagtcaaaattatttgacataatacagacaaaaataacacagttaacagaatgtagcctttttgagtagtttccggcaacttgtaagcatagtttaaatccagtcttaatcaaatgcttcagattagcagaaattcatagtctgggaattatgtcatgttgcttatatagaatttatttatttatttatttacctacctatatggggaaacaggatataattcacttttgaaaaatatattactgccatctgcctcacaatataatttctttttgatggctagaaatactaaagaagaagaaaaagcatgatacacatcagtgatttttaaagcagtcttttgtctgccccatggtcatacatacctgagtgttgagtagctataaatgaattcccatggttggtttaaagatagagtccccagtaactaaataactgagctaatataatttgccagttttggcttctgatataacagaggcaattgtttaagaaagcgtaatgtgaaaatgttttaattaaaaatagctgcaaagacaatttaatttggtcattgtgctatatgtatacacatatattatataacatatacaatcttttatgtataaaaatatatagacaaatatcaatggatcattttatttatattcattataagtacttaagtaacttgataattttaacacttataagtgttacctatatagtaacaagagtgattcttcaaacatgtataccatatgcaaattcaaaccaatgtttcctaaatatttatttcaatgaaaaaaatatagtgaattctattaggattaaagacatttttgacattctctttgggaattatcattacagggcacttccagtgtgcataagaaaactgcctcttaattttatagttacttctcattttgactcaaaatagcattcgctaactggatcatcaactttaatcatcaggcttaatgccaaaggacttttggcagcttcatagaactagataaaccttcaacagatggagatttgtcatcaatgaatttcaaaaacatgtagcaaaggctcttttgaaggtaagttcaagaggggaatccctgaaatgtttgaacaatggcaatatccttgagatattactagtacggagctccccacaggcatcattgagaaaggctcaaactccattacattaatgggtaagttctgctgtgttctagccagtctttctgcctcttttctcttcggttcatgtgtgtttttaaaatagtaaaacaaaatgtgtgtaatttccagagtcaatgtcagaggttcacgctctgtttagactttttggttgtgcagattttaacataattgctaaaatgtctcatcagaaataatgaaaaatagttatcgctttcacattcctttagtgcacattcctttgcagcatccatgcaggtgcattagagatttgatttttggggaacctaatgagggtcagactggtcagcctgtgggtgctacatctgcagtttactaccccaatcctctggtgctgtgagatgggtcagacttggcagtggccaagattgatgttatgtagactttcgagttcatgaagcaaaatccaagaatcttaccttcactcaacatggctacaactgaatctatcagctgttcttccctgatttacctccctgtactttctcatctggtaaccttctagttattcttcaagattccactgtgatttctactccatgtgcaagattgcttgctggaatggagaaaaggtgagtgtagggaaggtaaagaaaacactccctcatttagctattaattcattaattatcaataaacactttttagggtgtccattgtgcaccaatcacacacttgggtctcatggatgaatatcacattgctcctgccctccaagggcccaccactgagggaaggagagagacaagtaaaccaagcacaatacagtgtacaaattatcacaggatagatgtatgggcttttaaacacagctaagaagaaaaggaatagtaattcatcggaatgaggaagtaacattagatatagctttgggacagtgcacagaatgtatgtaaaaaactttaagtacttttgtaattaatttgaaagaatctgattgtgttattgtaaaaatgtttaacagctttccaagcccattattgtgccaggattatacttcctgccccactgacaccaagctgatcttgcaacccactttggccaatggcatgtgcatggaagagatctgtggcatttctaaacagaagttttaaaaaatcactgtgtgcccctgccatctcccaatttcttctgccttctcaggatgggcagctcatttagggttggttccagaacaaaacgaacatatcaatatcatccagccaagaacaagtaatgagagcaagaaataagactgtggctgtagcaactgaaatatcagggtggtttgtaacctcagcctaattagtcaaaataagctgaaacaaagaagctcatcgtagtcaggggcagattttaagaagacgtgtatttctttattcaaagcaggctgacacacggatgttgagctggtaaaggctaaagtattttgtaaaataaaatggtaccttctctaacctttcataaggtttttgacaataagctttaagattctctggctgccaagtgaggtgggactctccatgccatgccccaatattccctcaaccacactgatgaggagattttgcctatttcccttctccatgttcatttccctggctctggggtctgttctcacacctgtctcttcccattgttactcccttagtaagcagtgcttgagagtgcaggttgagctggcaatgaagtcttttgaattttcaatacatctgggtattacttcaagtatcattataacaataatacactaaagtttgcaacagaaataattgcagccacaattcaaagaacactcttttgcagtggtaagtctcaaatgtgttttgttttgtttctgtatcaatatggagagtaaaaaggaagaatgtagaataatgtagtagaatgttgtagttttggaatatccctttttggcgggggaggtggaaggacatccaggctagagtgcagtggcacaatcgctgcaaccttgacttcaggactcacacgatcctcccatttcagcctcctgagtagctgatactacaggtgtatgccaccatgcccagctaatatttttttaaattttgtagagatggggtcttgctaagttgcctaggctagtcttgaacttctgggctcaagtgatcctcccgccttggcctcccaaagcactgggattacaggagtgagccaccattcccagcagctagggaatatcaacaacaacaaaaaactgctccccaggtgagtctgttataattttctgcctcccatccacatgttgtcttctgaccccaaatccagattgaaaggccctgcttcacatatgtgagagattacaaatcaaagaacaatgcttttgatgcataaaagcataaaaataccattagcagtcctgtgttccactgtgaacagcattaatgcccttcacccagagtgttccagcatcttcctgagttacctgagatcatcctgctttgtacatgttgctgggtttatgcctgtcttcttgtgaagttagtaatagtcccccttttactacttgagacagcaaattatttgatcactccaaatctaggttcattaccaagaaatgttgaggcccaggaaaagtttgtgctggaaattttccacagtgctccctcacattaagcagatatagtttttctcccaaatcgattccttctaacgtcgttataaaactttaaaaatgctctacccagtaaaaccttgaacccattgtgcaaaagtattccttatttaaccttggagcctttatatgaatttttcatattaaactcccttacttaactccctcttcttacctgccacaaatatctttactcatagcattcatggcttccttcataggacagagaaatgtatcaaatgattttagtttaggaaccaaaagaacaacactgttttcagcacgttaaaaatgcctatattctaacattggttaaattatgtaggttttctcagtctgaagtcttatgttggtgggggatatggcagggtgtgtaattagttaagagtggcaggaaaaaaaaaaccacctactttatggtccacccccattcccaatctccactacaaaacagggaggaagctccacagaactatgatttccttgaatcacttcaatttgtacaacactatatgcagaacttttatgaagcaaagatttgaactattaataatagctaacattgcagctacccaagggcacacatatctctaccaaatggaagctgactagcagaattcagtttctatgtgtttgccatttagcagttatttttccaccacttgggttataatgcaccatactgacatccagagcaatgccatttctgccttattttaagataaaatgctaaaccaaaagctctattctgactatgtaaatgatcgccttgtgccaactgattagcatttttaaggcaaaaaatttcaaagagatagcatgttacacacattacacttagcgtgaaagcaaataatatattggctaatgtttttgtagcaccacagtctttctctgacctatgaactataagtaagatggaatgtgttatttaagattttttctctaaaataagtttcaattcataacaataagttcacaactcaatcactctgtcagtattggctggtaacaaaaggaacctggtgggtcagcagtttagcactgagtacactgtgtccatctagtggccaaaaggtgactgagtgctctaaagaggtttcacagcataaagaataaaaggcaaggtggctggttttttaaaaacaactttaacccaaacactgtgcacacatttttaaattctaacaactattaatcaaatcactttcattttctgcaaagactacagcaaacgtccttcttctttcttctcaaatacttgagtccccacttcccacacacagcagatgatattcctactcaaagagaaaatagtaaccatcaaaaaggaacattctccatgtccagccatcaaaatgacaaacacatctactcccacagtcatcatttccattttccctcctgttaccaactcgggcaaatccttccacctgtgctttggttctttgtccttctcacattctctgatacgcagcttcatccatttttcccttactcttttcctcctctttaccaaatcttttccataagcacttatttttcactgtacaaaataagatccctctcaattcctacttccctatccagatacttcttacctcctcctcactctgagcataatttcttgaaataattttgtttatattcactatcttgattctccctttgtacttacacctcaacccacttcaatctggtttatgctcctactatatggaaatttctcccattgggtcaccaactgacttgtgtttcactaaaccaatgaacatttctgaagctattggccactccctcctttctgaaacactcctttcctttggcttccatagcacctaactttcttggttttcttcttaagtctctgttcatgtctttcatttcagctttgtcttcaaatattggcagttcttaggcttgagacaggactctcttgttctcctaatcttgcaccccctttagttgattttattgactcaaataacttctatgaccatctgtagatggatagctccccatcaatttctttggtctgcatctgcctcctgagctccagacacatacagcgcacctgactcctggacagctctccctggggataaccgacatatacctgaagttcaaccatggaactcttccttctccaatattccttctcactgtgattagaacctcagctacccagttgctctgttttgaatcctgaaaataatcctaaccctttcctcaatcttgtttcacagagtctctcaattaccaagacatgcagactccacctcctacctctatctctcagataagctcactttcctccattgcctctgctatcattctgctccataccaacaccgctgtctgtaataatcttctaaatggttccctgcttgcatcccaagtaattctatacaatgcagccactgactttaaaaaacacaaatgcccatgtcattccactgtaatgtcttccaatgagcttgacagccctcaaacattcttgaccttctttctcttgtatgtcacattccagttgtctacatctttagtttctaaaatatgcctcattttccttcccattgcacatgatctagaaaaaccttgtccaatccatgaggcccaggacggccttgaatgtggcccaacacaaactggtaaactttcttaaaacattgagattttttgtttgtgattcttttttttagttcatcagctattgttagtgtattttctgtgtagcccaagacaattcttccattgtggcccagggaagacagaagattggacacttctgatctagaatattcttcccctctccattgatacatttatattcacacttgaggttttagcctaaattttactttctcagtaaaccttcattgactacttctaacataagatccgcctctgccactcctatcaaggctttatcaaacagcttccgactaagctaaaagaaacactctatgcattttaaaagtagtgtatttaatagatctgattcattgcactggtgatggaagagttgaaatgccaaataggggactgtgaggcaacttaggggttagaaacaacaggaagcaactaccgcccctggactagagctaaaaaggagggctgatgtatgcaaggattagggtcacctagctaagggtgaagccatggaggagacacagctactgcctgaggtgctgcctcaggtagagagagtaaaacactctggcttctctctttctgcctctccccaaatgtccaccagtgcctccaatgtgctacatctatctaacaaaggacatggaagtcttgagaccacagccttcagagcgtagcctccaactataaagggcagagaaagggcaatatgtggtctgagaataaataggtaaaaggccaacacaaaaacattcatcacatttaatgtctttactcctaaagattttcttccagtccaaactgtaagaatcatgaggacaaggactatggcttaacagattttctcttttaaatagcaaagtgactgaaacaggcatatctcattttattgtgctttgttttgttgtgctttgcagagatggctttttttttttttttaacaaaatggtttgtggcaaccttgtgtagagcaagtctatgggtaccatttttctaacagcatgtgctcacttcatgtctctgtatcacattttgataattcttgcaatatttcaaacttttaaaattattttaatacctattatggtgatctgtaattgctgattgttgatgttactattgtaattgtttaggagtaccataagccatgcctatataagatggcaaactcaattaatgggtgttctgactgctccaccaactggccattccctatctctctctttctcctcagtcctccccatccctgagacacagcaatattgagattaggtcaattaatacaatgacctctaagtgttcaagtgaggtgaagagcagcacatctcttactttaaataaaaagctagaaaagattaagcttgcttagtaaggcatgtcaaaagtcaagacagacagaaagctaggcctcttgtaccaaacagccaagttgtgaatgcaaaagtaatattcttgaaggaaataaaaagtgctactccagtgaatacaaatgataagaaattgaaacagccttgttgctgaagtggagaaagtttgagtagtctggatagaagatcaaaccagccacaacattcccttaagaaaagcctaattcagaacaaggccttaactctcttcaattctataaagattgatagagatgaggaagctgcagaagaaaaggttgaagccagcagagactgtctcatgaggtttaaggaaaatgccatctccacaacacaaaaatgcaaagtgaagcagcaagtgctgatatcaaagctataggaagttatccagaagatcattgaaactacattaaacaacaaatttcaaatgtagacaaaacaaacttttattggaagaagatgccatttagcactttcacaactagaaagaataagtcaatgtttggcttcaaagattcaaaagacaggctgatcctcttgttaggggctaatgcagctgagggctttaagttgaagccaatgttcatttaccagtctaataatcctggggccattcagaattacaccaaatctattctgcctgtgcttgtgcctgaaacagcaaagcctagatggcagcacatctgttgacagcatgatttactagatattttaagcacactgttgagaactactgctcttatataaagatttttaaaaatatattactgctcattgacagtgcacctggtcatccaagagttctgatggatacatgatatggtttggctgtgtcgccacccaaatctcatcttgattgtaactcccacaattcccacatgtcgtgggagaaacctggtaggaggtgattgaattatgggggacaggtctttcctgcagcattctcatgatagtaaatgagtcttacaaaatctgatggttttaaaaacagaagtttccctgcataagctctctctttgcctgccgccatccatgtaagacgtgacttgctcctcctagccttccgccatgattgtgaggcctccccagccctgtggaattgtaagcctattaaacctctttttctccccagtctcaggtatgtctttatcaggagcatgaaaacagactaatagagtaaactggtaccagtagagtggtgcagtgccgaaaagatacctgaaagtgtggaagtgactttggaactggataacaggcagaggttggaacagttaggagggcttagaagaagacaggaaaatgtgggaaagtttgaaacttcctagagacatgttgagtggctttgacaaaaatgctgacagtgatatgaacaataaggtccaggctgaggtggtctcagatggagatgaggaactttttgggaactggagcaaaagtgactcttgttatgttttagcaaacagactgctggcattttacccctgccctagagatctgtggaactttgaacttgagggaggtgacttagggtatttggtggaagaaatttctaagcagcaaagcattcaagaggtgacttgggtgccgttaaaggcattcagttttataagggaagcagagcacaaaagtttggaaaatttgcagcctgacaatgcgatagaaaagaaaatcccattttctgtggagaaattcaagccagctgcagaaatctgcacaagtaacggggaaccaattgttaaccccaagacaacgaggaaaatgtctccagagcatgtctgaggtcttcatggcagcccctctcatcacaggcctggaggcctaggaggaaaaaaatggtttcatgggtcaggcccagggtcaccatgctgtgtacaggctagggacttggtgccctgtgtcccagccacttcagctgtgactaaaagtggccaaggtacagctcaggccatggattcagagggtgcaaaccccaagcttggcaacttccatgtggtgttgagcctgcaggtgcacagaagtcaagaattgaggtttgggaacctctgcctagatttcataggatgtatggaaatgccaggatgctcaggcaaaagtttgctgcagtggcagggccctcatggagaacctctgctatggcactgtggaagggaaatgtggggttggagcccccacacagagtccctactagggcactgtctagtggagctgttagaagagggctaccatcctccagatgccagaatggtaggtccactgacagtttgcgccatgtgtggaaaagcagcagacactcaacaccagcctgtgaaaacagccaggaaggaggctgcaccctgcagagccacaggggtggagccgcccaagaccatgggaacccaccctttgcgttaacatgacccaaatgtgagacatggagttaaaggagatcattttggagctttaagatttgactgccctgctggattttggacttgcatggggcctatggcccctttgttttggccaatttcttccatttggaatggtatttacccaatgcctgtacccccattgtatctaggaagtaactaacttacttttgattttacaggctcataggtagaagggactccccttgtctcagatgagatgtaggactgtggacttttgagataatgctgaaatgagttaagactttgggagactgttggggaggcatgattggttttgaaatgtgaggatatgagatttgggaggtaccaggggtggaatgatatggtttggctgtgtccccatccaaatctcatcctgaattataactccaacaattcccatgtgtcgtgggggaaacccagtgggaggtgattcaattatgggggcagctctttcctgtgctattctcctgatagtaaatgagtctcataagatctgatggctttaaaaatgggagtttccctgcacaagctctctctttgcttgctgccatccatgtaagatgtgacttgctcctccttgccctccgccatgactgtgagtccttcctagccatgtggagctgagtccattaaacctctttttcttcccagtctcgggtatttctttatcaacagcatgaaaacagactaatacaatacacaagattcatgttgtttttatgcttaacacaacattctttctgcagccatgattcaaagagtatttcaagtcttattatttaagaaatacatttgggaaggctactttctacagtgattcttctgatgtatatggataaagaaaattaaaaatctggataggagtcaccattctagatgccattaagaacattcatgattcatgggaggaggtcaaaatatcaacattaccaggagtttgagaaaagttgattccaaccctcatggataactttgaagggttcaagtgaaggaattaactgcagatatggtagaaatagcaagagaacaagcattggaagtggagcctgaagatgtgactgaattgctgcaatctcagcaacaaagagatgagcagttacttcttatagatgagcaaagaaagtggtttctcaagatgaaatctactaatggtaaagatgctataaaaattgttgaaatgacaataaaagatttaaaatattatataaacttagctgatacagcagcagttgggtttcagaggattgtctccaattttgaaagttctacattcggtaaaatcctatcaaacagtatattacatgttgcagagaagtcttttatgaagagaaaagtcaataaatgtggtaaactttattgttgcctggttttaagaaattgctacagcttctctgaccttcagcaaccgccaccctgatcaatcagtagccatcaacgtcaaggcaagacttcccaccagcaaaaagattactacttgctgaaggctcagatgatcataagcactttttagcaaggcaatattttaaaattaaggtatgcacgttgtcttctagacatgctattgaatacttaatagactatagtgtaaacataacttttgtatgtactggaaaaccaaaatgtgtgtgactcactttattggaatattcactttattttggtcatctgaaacccaacctaccatatctctgaaccctatacttaagagatgttcaggaaaagttggctgaatgggtaaatgaacacaataccattgttcacatttgcagatggtgcaaatgagacctatagaattcacgtctgtaatcccagcactttgggaggccgaggcaggtggatcacctgaggtcagaagctcaagaccagcctggccaacatggtgaaaccccatctcaagtaaaaatacaaaataaaaatggctgggcatggtggtgggcgcttgtaatcccagctactttgggaggctgaggcaggaaaatcgcttgaacccaggaaacggagtttgcagtgagctgagtttgtgccattgcattccagcctgggcaacaagagtgaaactctgtctaaaaaaaaagaaaaagaaaagaaagaaagaaaaacagaaagacaaaataagacaagaaaataacgacctacagtcccacagctaggaaaatgtgaaccgttaatgtgactctaatctgactccttattcttgttactggaccatattgacttctgatctgctttcttattattttgccttctaatacactatgatacatggatttaaaaagaacactcagccattctgtggttttgatacatagtgctgaaatcacatctttgattcttttactatttatgcacttaatgaacatttattaaacatgtaataaatttgataaaccaaaaactgtgtagaaagaaactattaattttgttcatcattgtattaccagaacttgggacatgtcttgcacatcataagccttcaatacatatttggtgaaagaatcattgcataagtaaatttcaatgacactaactgcttaagatacagagagagctcttgacattaaggaattctcagtgaaacctcactggaaatagtctatgaattaattaagagatactgaaggattttgaactgcagaggacataccactgaaacaaagtaggcgctacttgcctgctttctgaatctgctttgtttgttctctcaggctctgtctgtggctggaatccctacaccttctatcgttgttgaactgctttgcatgttaaaaaataacacattttgggaattaactgtacgattggttaagcaaggggataaaaacaaacccagattggtaccttgttaacctacaacgatttctggaccaggtaaatcctcaatctctcctctgccaaaagaaaatgacaacgcataaaaataatgcagaaagcttaactgacatagttctgtcagtgttactactctggatctgcaatgaaatctgattgcttgcacttacatgaaactttctcatggatattgcagcatccttccccaatctcatattttattggcaatgcaagaagacataatttgcatgagatgcagaaagtggtaaattagaaaaattaactacgaagttgtttgccaatagaggtttatatttatcttagtataaataatttaatgtgtattttccttcatgattgaatttataatgaatattcgatgattaatttatttttatagaataaaaactgtttttaatggcccttttaactgtactctctagctttggtttcagtgttatcaaagcagaaacatttactccatttctaagtattttgagaagataattctgttaaagtttaaacaatagtgtttttaaaaaccaggtgaactttttctccttaccctgtcttatgtactgaaaaaaccaggttaatttttaaaagtattcatttgggaagcaactttctgagaggcgaaatattcttacatcagaaaagacagaagcagaggctagtgcctggaatgtgtttgtctctatctcggtagttccaacagtgcttacctgtttcacattctatacattttggcttcaaatccagtggttgtcaactctggatgtaccttgccttgaaccctaactctggcaatttaatagaatcaaaatctctccaggctggggccaggtatcagtattttaatattacccaggtgaagctaatgtccagccaaggtttcactctaacaggaatttgagacagcttgtttggtcagatgatcctatgatactgaaatcatcccaaaggtagctagcagatattagtagtccaaagccctgtattagattttgactctaattctaataaactttgtggagctaatgaggcatccacttaatttactcaatctgttcaattcttttagttacggaaggaagctaattcagtcctgtgtggttgttaactaatcacagatctctaatcatctgacaaagttagagacacacatgccagaatactaaacatttctacaaaattttacatggcatcccctagagcatgtgaagtcagatatcaattcctctaaggttcgaggaggggatgccttgttaagacataaaaccaagaacaataactgactttataatgagtcaaactagccatcagtataaggaggccttctaacaattagaactgccctgtaatgttaagaagacattaaatgtgaaaaatgatgtccatatggaaaaaatacagaaaatagacataagtagaaagaaagtagaaaacagacaaaattatagtatatataccatatatgcttgatatatattgtatatacttttattaaatgtatatgttatatgattataaatgggaaagaaatattacaaaatgaaaaatccataggaaaatggattaaaactttactgtgaaagtattttaataaaagtataacaaatttttaatgtaaaattaaagtagacaaacattatgctaattaaaaagattttatcatcttccctttgtggaagacatagcaggataagacaatactaaattacttgggaaaaggcattgcagaaaccaactgtgttagaaaattaaacagttgtcacccaaccaccagatgatgtcaagatatcacatttgttactattcaaggctactcaggaacaatgatttaagcaagagaacaccatgagtggtactgtctgaacatgacctagatagctcatgctgggtcgtctggacaatatgctaacagttggcagtgtcccccagcccatctggagaggcctccctgaaatacagcttccaagaagacgggtgactgccttttcctggaaaaagggagctgcagctttccatgcttccttaaggtctccaagcctggacagctgactttcctagacaattcctataaagagttgacatctaaaccccaacagtctggtaaccaaaaggtttatctgtaccccaactgggcagattcccctttacattcaccctaaagaggagagcaagaggcatgatgcagggtcggggtggtacaagtctcctctcttctagccaacacttgattagtaaatcactcaaatcctgttcctaccccatactgtgtgctgttgcagcacatgtgctctgccaagatatgtgtcagccatgaaggaacacacttgtcctcaaggcaggatggagaggatgttagtttcctcaagcaaagtcaggaatgaatttactttaccattatgggctactttcaaatatctaagagtcctcttggggagcacgctgctttgttctgtttacaacttcatagagcaacatgtactgacataaatagctaagaaattttaggtaaaaaaaaaagtttgtttaaaagcatgttgtaaattaccattttagtaaaaaagattatatatatttacatgtatcaaaaatctaaatatgtatacaaaaactcttagaaatagttatctaagagagaagcgaagattataaacatctaagttatatttctgtagtgtttggatttttttttacaaaatgattataatatataatcaagcaaaaataaaagaaacatcaaaaaattaaatcaggttctctttagacacagttttaaaacttggtttcctaagggacactataaaacacagtcatttggtaattaagaaattatctctagaccatctggctacctaggtaggccaaaatgttttgacctttttgcctgtaatcagttaagaacaatgcaagttaataaaagcctagacagcttacagcctgaacttcataatttttccccaggagttgactaccagtgtaattattctcagttcagtcaaaatgttgtaattggtttatttgtgtaggcttcaactaatcattgcctcaaagaaaaccagatttttttcctgcttattactctttagacccccaatttatttctcctagtatgccatcctggaagttgaacagatttttctggaatctagttgtcctttccataggctctcagtagaaagggactccttctactcatgatatatctggcccttacttattgtccattttaataggtcttaatgcaataatagatttaatgtttaaaatttaatgaacaaaattactagcattttgttaacagatactggcctatgtgactggtagttgcaaactctcattcttaagaagtattcttagctattctatgatagtcagattaagtaatggaggcaaataacataagacaatattcatcacctgtttagaatgatcaaattaatgcatcaaagcagtgattttataatcaattgttcttcttctaaatgtgaagaaaacacttctaagaatagcaaatagaacaacttagcctaaattatctccatttcccttcttcaaattattttagtcttcattatcttattatatcatccaccaattgtgtcacttgcaaaactatttccttggattctaccaatccaccctggcaaaattagctagggtctctaggtagtaccaagataccccaggtgtgtcttggctcaagttgttggccaagcagatgatagggtggcatacatcattccaaaggacatgcatgctggtcctctaatttcctaagtagcatctccaacacatcagtatagttctgagcaccctggggttttgtgagaatcagatgagtacaaccccatattatcttatgaccatcttagttaagcagatcaatatttcttcctaaacatcaaaaatataccaccagcaacacttttctggccacagatggagggcccttgcaggtgtttgacttgtttagtccagcaaccagcatgaaatctactaaatggagcagagagcaaataggaagttgggctgggctggtaaatcaaagatacgtcttaggatttaaacccttcaatgatgtaatatttaacagtagaatgaactgtgtctttcatatgtactattttctgacattccattactgacagtagtatgtcataacagtgtttcaaaacaaagggagcagaatggaatgagcctaaggggataataacttgtaaaaagttaattgtaaaaaaaaaaactgcagacaaatttttcttttatcattaagtatttatttaaacttcatactgagagacccctctatttattcctgaatcctttacatataatcttgtaagcagttgcaatgactaaaatgtccttggttagtcattaaattcaattattgactgtatattgagaaggtgtaaatcatagttcaaggttaatttaggggtctcttattaggagttggatgaaatgaaatatatgtgttacataaattgctgactgagggaaaaatatacagttaaaataataatttggatggagatgcattcatatcatattgaaacatgacgtttgtttgtgaggacacaccatatggaaattccccaattccttatactttggttataaatctttactgattatagtaaccactgtttcaggtggttaacctagaaagcttcaagaaggaatggaaaatgagattaaactcacatacatagcatctccaaataaggtttcttaccagcgaaagaaaatcaaagattcacattataaaaattcattactgatgcaaacctggttcccatgatgtttctaggattaagagaggtaacagtccccgcactgaatcacatgctcattaagctttcccttaaagccaggtggccaaggtttcatctctgctaacaaaggtattcaaaggaatttatgataatcattctattgtttgaattttccattgctagataatgcaagtgctcagtgcagagagatttccttaaaaaatgtttctgctaggtcaaattagcacctgtacttggatgttcaagtcaacatttctttctaagtgtcactgatttagaacataagagtatgttagaatattaaaagatctcgggtgtggggaaaagcaagagagatcagattgtcactgtgtctgtgtagaaagaagtagacataggagactccattttgttctgcactaagaaaaattcttctgccttgagattctgttaatctgtgaccttacccccaaccccgtgctctctgaaatatgtgctgtgtcaaactcagggttgaatggattaagggttgtgcaagatgtgctttgttaaacagatgcttgaaggcagcatgctccttaagagtcatcaccactccctaatctcaagtacccagggacacaaaaactgcggaaggctgcagggacctctgcctaggaaagccaggtattgttcaaggtttctccccatgtgatagtctgaaatatggcctcgtgggaagggaaagacctgaccgtcccccagcccgacacccgtaaagggtctgtgctgaggaggattagtataagaggaaggcatgcctcttgcagttgagacaagaggaaggcatctgtctcctgcccctccctgggcaatggaatgtctcactataaaacccgattgtacgttccatctactgagatagggaaaaaccgccttaaggctggaggtgggacatgcgggcagcaatactgctttgtaaagcattgagatgtttatgtgtatgcatatctaaaagcacagcacttgattctttaccttgtctatgatgcaaagacctttgttcacgtgtttgtctgctgaccctctccccactattgccttgtgaccctgacacatccccctctcagagaaacacccacgaatgatcaataaatactaagggaactcagaggctggcgggatcctccatacgctgaacgctggttccctgggtccccttatttctttctctatactttgtctctgtgtctttttcttttccaagtctctcgttccacctaatgagaaacacccacaggtgtggaggggcaacccaccccttcactcgggtcatgcaggaatcatatgtgcaaaaataatgtgataaaaacacacctataaggtgaaaaacatctacgtatttgctataaatacacatactttgaatttctatattctggcaaaagcattggaggacaaaaaaaaaatcttttcaaaatacaaatttgaatatgtatgggcctcacttttccacccactaaagccaacctggttagcaggatatttcgaggattaagagcggtagcagtccctgcactgaatcacacacatccattaagctttctcttaaaattaggtggcttcccattgttcttagggtagaagacctaatatgtctataaggttttgctccagttggcctctgctctcctctctagcctcatctcaagttactggcttcctgttagctctcttcatctcagcctcaccagccctcccttggtaaaccgtactgtccattcagtactgtttcctacatcaggactttgcacatgctgttcccagacactcatctttttatttatttcattctcttgcttctcctaccaccatcaccacctacaccaccactaccatcaccaccttaaccactattacttttggaacacatatccatacatgtgcacatacacatatgtgcacacatgcatactctgaaactctcctcattgttacatcctaggagaaatatttcctgacattttacacataccctccctgttataaaatctcctggtactgtgtatatttactacacaacactgattttttaaaattttatacatatttttagacttttaatgtcaatttctccattaaagttggagttgtctgtttcttctcatcattatttacccaacatccagcatgaaaccaggatacagtggataataatacctaaacattgtttaaatggggcaatgaatgtttcaatcaatgaatcagtcacatctgcacacctctgtgatagatggattatctactgtgcaaaattcaacctgaagagagataaagaaaaagaccattcattgggctcaactattttgacatgactgggctaactgctttgcttatttaaatttaatatcagcaactgcccaaagtaggtattctgattccttttttacagatggagaatctcagactcaggtggacttagtaacccacccaaagacacgtttggtacgagagcaacatggttattctgttttgttttgtttttttagaattttctataaaattgtggcaccatgtttatatctgcattcaatgacatttacatataatttgaatttaggatgatcctattttgaagcacagaaattacttttgaatgctggctctagaaattatgaaaaatagaatataacaaaacctgaagaaagtaatacaacaaactgaaccagcattttagtgttgaaattttaatgaagtaaacatcttccatttaaattagcgtgtgtacaattagaattattaagaattaagtatgacttcagaacttaaaatacaatttcttaaaccaaaatttgttttagtttcagctcacccaatctgctaccttgcaaccacaaatgtgtttatgatttccccctccaaaaacctgcctctagttcagaagactcttcactgggtaattattttccacaagcccaaattgttttctgtggtatgaggctgggttcaatgctctttacacttttgcccatttgcagagatcagcatttcctttcgccagaatgctcctgctgacgagaatgctgttgggcctcccagaaagaaagcagagacagttcatttgaccactgcctgactcaaacctctgctactgtttttttctgtccagataagggagctaaagtcagcaataattggaaaaagaggctctcatttggtcctgttatgctactttttccagtaatttcaaacaacaaatatgtagcatttaatattatatgccagccctctaggaactgtgaatgaagtaaacaaaacttgaaatatgatcaatccttatccttgatgaacttgttagggaagatagaaccaatatacatggaagaatcagagaataatgaagtgagaaactaacatgggctgttacggggtgaatcctatacccaaaattcatacattgaagtcctcgtacatatacctccaaaatttgtacgttgaagtcctcgtacctcagaatatgactatatttggagacagggtttaaaggaggtgattaagttgaggtcataagtgtgggccctaatcaaatgtgacgttgttataagaggagctaaggacacagacacatacagaggaaagaccccgtgaaggaatagagagaagtcagccatctacaagctgaggagagaggcctcagaagaaaccaaccctgctctcttgacttcagacttccagcctccagaactatcagtaaatcaattcctactatttacgcttgcagtctgtggcactttgttatggcagcctcagaaaattaacacatggattctattaaaaaatgattttagggcaggaataaaccagtctgtgttcaaagacttgaggaaagctttgtacatgatatagggtctgagttgaatatagacaaaaactaaataaagcagagacagagggatgacattctaggacagcaggaaactcaatgagataagactagtaaatgggagagagaaatgatttagtaacaggtaatggtctctgaaaccttttaacctttgctatttgttcatcttaaatgttaatgtatttttaataatatatttactcacattggatagataatctcaatttatagtaaacaatgtcttgttactaaaagggctatgctgaagttaacagaaacatactatttaccatatatgtttaaatctcgaaatccacggccatataaaaaaggactatgaatttgggcaaaatgccattgaagcatacgtacaattgtattttgtatgttatttcatatgtacacaggaattgtacatggaaaatgagaaagagaagacataaaacatgaaataaattatgtttgagttcactggtatttcatttatccagattatacacatttattgtcaaaagctttatggatttttctgggtgaagtttatacatatattcatgatcatatgttacaaagcatttaagtatatagcttcatagctatacacatgaaattaaatattaaaaatactggtttttttttctaatttaaccctcttctagaaaaagatcaaaaaaaagttccctcagcatgtgcacatctgtttccattgaggattttaagaaaatgtttaaaagctgcatttaagtgaataatttccagcctgggaatggtgagccagctcagaaccaaaggctgttcatctaaccaataagcaggtgtaaatgaatatttcatgaacactgtctgtaattttctttttacttgcacggcaacaatccctccccaccctccccgcatcttcctgtactgttagtcctctctccaaaaagagaggggtgtttgaatgccacttaaaattcttaccagtatctggtatggtgtcattctttactgttcacattattttttatcttttggattttgctttcaaaagccatttgttctacatcaggcagctgcattttctttcagcattaaggaagaagaataccaaaagtacttacctaaaaaacaaaacacaaaaaagggaaagattaaagtatattcatggagatgcttgatgtcttgacaaagcaccaaagtggggatgaaaacacccatagcacctaatggcccatggcaaataaagcatgtaaagccaccaaggaatgactgtagaagttgcacccttgtctgaaacttaagacagcaaaaggggtatgccttggttattttaaaaatgaataggtaaagcaaagttttgattttcttttattttcacttttttaaacaacttacattatctcagactgtaatccatcacgtctctgtccttcaacaggttctaactgcctacaataatggcttttatcattatgagccagaagactttaatcataggcctaacttagagcttcaatgcaaccataggcctaacttagagcttagagcatcatgaagagtgcattgagatatgccagacactggtggctcatgagagaaacaagggctttgctaacagttgtcttcctaactatgaggcctcctgcaatatgagacattgtagtgttggtagaagggtctgctttcttagacatttttgcggtactaacatagatataaaaactaacacacggccaggtgcggtggctcatgcttgtaatcccagcactttgggaggcagaggtgggtggatcacgaggtcaggagatcgagaccgtcctggctaacacagtgaaactctgtctctactaaaaatacaaaaaaattagcagggcgtggtagcgggtgcctgtagtcccagctacttgggaggttgaggcaggagaatggcatgaaccaaggagacggaccttgcagtgagctgagatcacgccaccgcactccagcctggttgacagagtgagactccatctcaaaaaacaaacaaacaaacaaacaaaaaacaaaaactaacacacatagtcagatgtggcatacaaaagagaaaagtaatttttgtaaatatttaggaaaaaagaataaataataagtggcaaacatcagtagttttcatcaatgtgccatctgtgtatagatacgatgtctttgactgtctgctggtcacagaaagccctctacacaaggaaggcaggggatggccttgaacagtgctcctgagtgacagctctggaataggtgggagaaggcacagtgcatacccagcgaagaaatctgttcactctgtcagttaccaaaagccaaagaaaaacttcctccataggaaatgatttccccattccattcttgacaagcaagagctaacaaaagaaagagtcccaaaagaatatgggacttttgggagagtagaggagatctcatttacgaagaggagagaacatccacgtgctgatagcagcagctaatagagctgcctgatctggtgctggctgggcaaaccaacgctaaaggcagaagcacaaaaaggcattgcaccacaatcatctgggtgacttggtcaaaaccaagaagcacaaaaaggcattgtgcttcttgcttttgaccacgccagaaaggcattgggcgacttcgtcaaaaacatgatgttctcagggcccaccaagatagcatctctggaggtaagattttggaatttccatttttaataagcacccctggtaaattttatgtggttagctgggcaccagtctgcacacagagttttaagaatcacatgctagaaggtgtgggtctgtctcctgtaagtgctacctgtcagagactattctctgagaatgctgagtcacataatttggtcagaatttaatgaaactgcagggacagagatagggaatgtgcatttctcttccctatttaattctgcctcaccaacaaactgctggtaaggaaaaaaaaaatcacacaaaatatattatttgaattggtctgtgccactaaccaatgctgttgtccattcctactgtcccctggttcttgttaataagataacattctgtactcctactcatagagggcactattttcttgtcagttcatgctgttgcagacagttggtaattccaactaccaaaataccataatttcatcagtgaattaagccgagaaatagttttgaatattacagagtatatagtaagatcttccataaacctgagttgactaatttctagcatctcttgaccttcaatttcactaatactgtttagctagttcttgagctatttttatctgaataatgtaaattgagaaattgatttactttgtttttcaggaaatattttaattaatttataatatttctctgctttagacatttagaaatatttattttacttacaggatagatgttgtggcatatttaaaaggataaaaatgtacttcagaaaagttcacaaatttaattctatatataaagagatttgttttttcctaaggtgctccactattaaatgaaatataacttaaaaaaaatcagtcctaatatcagcaaactgtgaactgacctcaaagttaatatttacactcatcagaagctaaatggagccgagtgcaatggctcatacctgggatcccaaaatcccagcactctgggaggctgaggtgggaggattgcttaagcccagcagtttgagaccaggttaggccacatattgagaccctgtctctactaaaaattaaaaaatacatagccaggaatggtggcatgcatctgtggtcatagctactagggaggcagaggcaggaggactgcttgagcccaggaagtcaaggctacagtgagccatgatcctgccactgcactccagcctgggcaatagagtgaggccctgtctcaaaaagaaaaagaaaaagacactaaatggaatggaatgactttaattgcaggtgagcctgtattgccattttaaaagatttttccaagtctgtcttgacatagcattcattttgtatttcataaatgagaagactgtgaagattaaatcaaaaaagctaacagtgctggtcaggagctagaaaacttggggtggagcttgaggaaagaagactatgagaatgatttttaaaacatcatctatatcttagagcataaaatggggtaaagataaactattaactgacacagggtgcaaagcaccacaaagcagcacaaatagctttatagcttctgtaaatcctaaggatcttcctaagactcacatccctctacaccccttcaaatcagattattcatttccttttccctctctgctgtacaagtgacaacagctacaaaatgcatcacccaaagggaaggtcgttaaaaaggcctgaagaatataaagtgtcaagcagtttggctttaactgtggcctttgtctagcagcacatagagtgttgtctttttgttttcttcatttttaaggttgtagtataatatattacagcccaagaccaacagttacagcttccagaggtagctactccgtgattaagagaactcatttacagtatattccatattttttatataaaaaaattaaactgtacttgccttattccacattcaaatggttaatatataacaattatggatatgacataaatagccctaccagaggcaggtcagaatatatatgacagtagggagatgtgaaaaacacagagaaagagaagggaagagccaatttatgcaaaaagagaaatcacaccttctgctattactacatacggtcttggaaatataatattttattaaagtcaaatgaagcatactttgttagagtttagccagttcaactacaaagagtaaatacaaatctaaagtaaatatgcttgctgaccaaagcatccaatgacaatcttatttgaaatcataccacatattcgtatgactggaagccaacttgcatagcgctctttatacgcaaagactgattttatgctgggcacaggaaagaagagagagtggaaaggctggaagagaggtatgtcacatcaaccaacctcctaaacccagatggttttcatcatcataaatcatttccccaaaggcagcaacccatttcatttgctaacattgctcttgaacaacttgcctggcaagtagctttctcattaactttcaaagacatcctatccatgtcattcatctcctgcgaatatacgaatataacatttccattaccttgacttttaatttccccttcaaaataggaattttatgaattgatttgacaggtcatataagtctctttatactattcataaaacttgccttccaatatgctttgaaattaagattataagccagttccatattaacatactaatgcctacccaaaattatgctggagacagctggctaggcacaccaagcctaattaaagagctaatatttttacaaagggattaaaagttacttgagattgaataatacatcttaatgacttaaaaaaaagaactttggactagaaatgctctcaacataggaggaaagtaagggctaaaagcagattgtaggaaaaagattactttcttacttacataagatcctctctctttaatcccatcagacactataaacaggaggaagtttaatctagcaataagagcatgacttttattgtcagacaaagctaggttcatggcctttaatatagttatacccagtttgaatcattctgctttctcatgaaaaaaaaaaaaaaaaaaaagagaaaatatggaaagaaagaatgacctagaaaaaagtctagaatacaatacatactgaaaaaagactgtttcaggtcttttgctttctcacataaactagctcagtaaaccaaaatactctcatagtttcaactatactaatgcctctcaaatatatagtttagactctaatttctaatcaaagctttaattcttaatttcgagtggccagaatagagaaatcacataacttatcacattattacaataatgtttacaattcacctgggaattttaaaatgatatatacactaataattatatctaaagcctgtacttaattatgtcatttagaagactgtagacaacaccaagccactccatataatccaccaaaggtacttttccttcctataaaaaatgatcaggaagatttgatcaataattcttttatttttcaaggaggagaatttcttgtttgttgtggctaccatctcaaaatgccttatagtgtctctacttcaacaagaacatccctgtaccaatgattttcaatgtccagattcccagatgttattattcctgacaatgaatctgcatttgtttcagatgcatttaagaaatttgtgaagctagagctcatctaacctgtcatcattactcttcatcaccctcaagcaaatggtcaggctgaaagaatgatgcagaccactaaggaagccataaagtaaactatcagaagaaagtgactgaggagatttgcccagcttttcatcactcaacatatcagtccaagtgggacaacagaagtcagttctcctgaataaaaaaggcagcaacattgcaactgtgcctttgacagttcccatataaagcttagcttagaatttatagacaaaccagaatgtactctgggaatagtactcattcttaattcatttttctagaagaatttgtgttgactagaattttaaatgaaacagaaaggggcatgttcctatttaactaaaatcacggtgtgtgtgttattacaagggctagactgtagatggaactaagtggcataacactaacaagagcaattcagtgttatgttcaggttttttacattcctgctagtattttatttcttttaagttcattatatgccactgtgtacttattttaagttcagatatattatatgacaaagttaaccaagaatattttctttcaccaaaaataagactcaaaccctctttttctgcttaacatcaatcaaatctccaaaaagttaggagaatttggaaaggagtacagaaaagagtgaatgtgtctaccaaatacttctagctttcctttttctggtcacatggtaagattgcccttagcctcccctttggtatcctacatgaacatgggatatactttgaccaattattttaagcaaaagtggtatgtgtcacttctaggtgaaagttcaggcaacctgtgacggattcattacatcatttttccctggtgaagaagcctgagttgagataaagcatcaatcatcttgggtcccaggtttactacaataagtagagcctcttgccaatccctcttgggtatgtatgaagagaacaagaaataaaatttgttatattaagccacttagattttggattactgcagaataacctagactatcttgacttacataaaattaatcaaaataataaaatattaataactgaagtcataaaaagttttatgcaaaaaagttaattttttgcagtattaaattcaaaaatgaaaaccaactaagggtttgacttaattactatctacaactgtaggaacagtgttggttgggttttttttccccctaaaaaggtgtttaccattttgcaaaaggaatatttctgttaaacaaaggaaaccagcatgaaccaatataattttgagttggaagtaagagaaaataaaggaatcttcaagtcatgaaggaagaaggtgaaaccaaggaagggtaaaggatgaagacagtgtggtctccttcctagataactgtaataaggaccatacttctatcactcctggattatttccactggcaaccgttagagaattttagactttagaataaagctgagggatcctcagagggaactgtgcattagcttacggggcctgcaaacggacaaggccagtggctaaattatgtgtacctaggtacacctttcagagaagacatatagctttattcagattctcaaaggggtctctaaccccaaataaggctaagaaccatggttatatattaaccccacttgaaatagggtattataaagcataatctcagttttctacaactgtcttggggataacaaatctgtagtcttactttcactctcaagtcaatgtaggagatggcaagaatttttacttttcccaccttaaactacctattagttttgcagagcaggaaccataacttgaattctaaccaagaaattaatcagagttaactttaagaggtttagagaaaatatcttaaaggggctgggggctctcagttttttaccctatccctaaggtccattcttgtctcccagtaaaaagattaacaacaacaaaaaggttggcttagcctcttacacagtgcttttttaggctttcagaatctaaactttccagactcagtcgttgtagggctcaggcttgttgactgctgtatgcctcaatgtccccaagctcccagagtcttcccactgactactcatggcaaaaaggaaattagagggcaggcttgtctttaaaatttctctttttttcccctccacaattctgtttgtttccattttattattaataccatataaaatagagttatacaatgaatatgtaaagaacacaaactgatgttttcaaaaacttttccaagcatgtcactcaaagacagaaagcaaggttcttaaggcatgattatgttgatcataggctagggaaagaatcagaagcacgagtttcctcccaccaacctattctcccttccctctattttatgaagaaaatagtggccttaaaatttaactgagttctgtttctggatacagtgaaattgcttatggaaaagcagcactctcaccaagaacacaaaatggtaaaaaaacaaaacagacaaaacctaatcttatgtgatgtggtgggaggggactggggtatggtaccagggacttctgggagaattgacaatgttctatttcctgatcaggatggagattacatagatgtgttcactttgcaggaattcatcaaactgtaaacctataatttggtactttatgtaggatatatttcagtaacatatttatctttaaaaaatgctaacttattttagcaggcctagtgaatacctggaaatacatcatttgtaaaatccaagcatatgtacattttctctgagaagcttaacttttagacattctactgcatgtgttcaaatttactcccactgtaattattctctcctggcagttttacataagccttagtgagagatagtctcctttggctggtaagttcatgagcaacacaatcttgcataaagtaatgcccatctgacactgcatttacctttaatatagattatggttatatactttggaaaactgcattgcatgtggtcaaatgtccatctcctcccatccctataactcatttatcagtttcatgatggcagaaaggagattttctatctatccaaaaattacaaaataaatatcctgttctaaattttaagtagacaaaattttgaaacattgcttgcaaactacacttattaatagcattacagcacgtaacaataaatcactttggaaggtaattgaatctcataagtttcaataatttataagaaaatatccagagataatagtaacacatgaaaaagaacaataggaccaacagtctacaaataaaagctagggaacacaaaaatgacacaattatcaaattcaagaatttgaatttctattcacaattgacagaatatataaaggcaactgtaaaaaccacctacaaaaaattaaaatgagaatattagaaaaaatttggtagtgatactgagtaaaggatttctgtaacttgtttaattgtactgagcagcagcagctattacattgattttactcttataaaacaatttataaattttattcttaaaaaacaaaaggacatattagtgctataaaatattaactaacctgcacaatgtgcacatgtaccctaaaacttagagtataataaaaaaaaaaaaaaaaaaaaattaaagaatctctacaaaatatgcttacttatatacctaataaatcaatgagggctaaaataaaagtgtatgtaatttaataagatgaaaaaatacattggctaggttcaggtaagaaactcttagatattttaaaatactacatttaggctattattaaaaagttaaaaaacaacagatactggcaggattgtggaggaaattgactgcttatacgctgttggtggacatgtaaattacttcagccactgtgaaaagtagtttggagatttctcaaagaacttaaaacagaggtaccattcaacctagcaatcccattactgggtatatgcccaaagaatacaaatcattccaccaaaaagacacatgcactcatatgttcatctccacactgttcacaatagcaaagacatgaaacccaccctatcagtggtggtttggataaagaaaatgtggtacaaatacaccatgaaatactatgcagccataaaaaagagcaaaatcatgtcctctgcagcaacatggatgcaactggaggccataatcctaagcaaattaatgctggaacataaaaccaaataccacacgctctcacttgtaagtgggagctaaacaccgagtacacatggacggaaacatgggaacaacagatactgcagactactagaaggggaagggagggaggagagtttgggtgggaaaactacttattggatgctatgctcactatctgggtgacagagtccatactccaaatctcagcatcatacaatatacccatgtaacaaacctgcacatgtgccccctgtatctaaaataaaagttaaaattaaaacaaaacactatacttagttgataacatttaataattaccatcatatgggaatatttacatctattttttcaggcattagtaattcttgccagagtattatctaattggaaatggtaagaatttgtatgagcacggatttgaggtttataacaacattacttttttcagatagattgtaaacatctagacttaattcagaaataagatttcagaggaaatgtagaaattatctaaaaggacaacctgtttttaagaacttctgaagtttctgtttatgtttgaaaaatggatacactaaccacaaatcattgtatcttctttttaaattgggtacagaaagatcctctatttgtcaataatttaaatatcttaattagttttctaaacgttcaaaatccttttagaaaacagttcatcaattacataccacagacactaaatctacagtttttgtgtatgtgtgcatatgttcaccaatttcaattaaaatctatgacaaaattaaagaaattatttttggttttggaagacataaaataactgaggattatggaagtctactatttaaataaatataagtattaaaaactatctatttgacttagttaactagatttctcctgagccacattcaactagaaaagtagcacttaacatataacctgctcctgtcaatgaattcttcataaaattttcaataaatcacagtataacattttagtaataagtatcttaaaatttgaggttcaatgatgtgcataactgtatgctcatagtaacctctgttattcaaaaatatctgttgcttttgggtgatacacaagaaacacgtcataaaatatgacaaaaaagcattgttaacatgacaaaagtattcagtgcacaaggcaaaggcatctactcagagttgctattgatggtttgggtcctagcttcatattacaattacctggggagtttcttaaaaatactgatgctcaggccccatgctcagagattctaaatcacttggcctagagtttccaggacttttgcatactttacaatgctccctggagagttcctaagcaccgtcatggttgggaggctcatgacataacagcttttaagtagctactgtactacatccacagtctacccttactagctatggttaaccctaaacaattccagataaataaataactagatttcagactagttacctttatctggcctcagaagaaagaaaggtgaaatcatacgtattttctattttttaatccttccaacctggataataattccaaatttcccatttacatttttgccttgagtctgcatatttcaaacagagctcatgaccaacaggaaggttgtgaaacaaatttcatgtgttgtgacaaactttaaaacaaacagaatagagatcatcacatgtatcagagatcatcacatgtagtaagagtaagcaggattttgtgaaacttttgtctcagttgaatatacatatatgtgtatgaatacatatgccgagtggtaaaataaaccgtatttttacaatagattgttgggttctcagctgattccagctgcttgtccttttctcactgtctgaaaactgatactcttcgacaatgtcatgaaaagaagtttatttagtcataagcttaatcaagacagtactgaactcataaaaaatcttctgagagaataatcatggcatatatcttgtaaattcagactacagtggggagagtatgcacattaacttataatttctatgccaagcatttttttttggctctttctccaaacattttactaatatcttacggcatacagattggtctcttggtctcccaacttacaggagacattttttggaggttgtatttttaattttttttcaatattgaaaaattttataggcatgagcatttcaataacttcattaaagaagaaattctccaagatttttgttcatgaatattatagtactccaagcttttttttttaattcaaactgttcagtaatagttttcagtttgcaaagttatcaaaaaggatagaatagtttacattagaataaatgtaacattagaataaatgcaacattattgttcatatacatggaaagtatatatttttatttgaataactatcctttcaagaagatcatattacaatgaagataatgttcccacgtactctctgaatagtctgagatttaataaaaatgccatctgccaatgtcacagattacctcccttatctatttcccactaccacccaacacccaggttctggtccaacccagaccactcaagagtgcttctgcttcccttcattcacgatgggcactgtagtcacatcatcatggcatgtggccatgttgggtcactgagattcactgagaggttaatgggtccaatatgccaggatgggaataccccatgaagccaggcattattttccaatatgacatttttcttaaattactttgtatctttccaataagtctctttttacttgatccaattaataggtttctgttcactcattcatttattgagcagttactgtgtgccagacaggtgataataaccaatagggcagtgtagttcctgcctttgtgtcatttactttattacaataaaacttgccctgattaaaacaatttatgttattctcctcccttgaaatggattttaagtcaaggccaatcggctttagtgtttgcagagtaaccaggacagcaatgaccagggcagtgtcatgcacatgaacttggtgaccacttgcacagcagaatgttcctgaaggctctttgtctctatttgcagtagaagtcctaacaaggccaaggacaaaacaatagatggcaaatattcctacactctggagttgctgcaacatctggtaggacttgcaaaggcgcagctattctgaccgttagcttataccccacatacagcctttaaaagaggtcaaagggagacaaaaaatcctagagaggatttctttttagagtcccattggcatgctaagacctaactctttattggattttaatgacagtggagggaaaggcaaatgttttctgactttgctgtatgagtcttgcttgttcaatatggcagttaaactttttaatagactggggagtaatacaatgtagtccaaaaaaaaaaaaaagttcgagtcaagaagcctagtctgcagttggtcaccccttagccatatgtcctgaatatatcattcacttctctgagactcacctgcttcatctctaaaatgggagttgaattagacccatggaacccttcaagtggaaatctccataatttctgacccctattccctgctctatgggtgcatttgggtggtggtaaggaaaggctgctccagcggtagagttttaaaatcccggaacctgcctgagtctccacacttctgtggtctcctccaacatgaagccttcatgatttgacttttcttggaaatcaagacctttggtcatttcgttgttcccatcactgtcattattgaccacagtccctttgttgaagccattcatcatctggctcttctcatttcccctataaaatttttcagtattgaaaaaaaaattaaaaatacaacctccaaaaaatgtctcctgcaagttgggagaccaatctgtatgccgtaagatattagtaaaatatttagagaaagagccaaaaaaaaatctttggcatagaaattataagttaatttgcataccttccccactgcagtctgaatcaaaaagcatggtttttctctacatcctttgtgcttacaaaacccacttcttcaggaaaaaagaaaaataataaaaaaaaatttcttttcaactctcacattttaagtacctgccttagacctaagagtaagtctctaggctagctacaacatccccttaacattcataccctctccagcttgtgaattaacaaaatgacagatattttttcatagttgaacttatttggcttattaggcttctcctattctagagcattacatattttaattccttaatacttttggaaagttgcttcaattaattaagtgatgatgtgtttgttgaaacatgctggtttaaccattgtctactggtctcttctttttaaaagaatgtaagggcaatgagaagagccacttattgtggcattgttcttttaaatactgcctttaaaatgaccttcttttacagttgtaaagtgctaaagaaaatcattttgcaatgctatttcagatattcaggcaaaatcatccctgtagtgataaaagaatatgcccttagaaattcaagatttttcataaaaaatattcaacagaagtcaaagaaataaaaggaaaaaggtgattcgcccttgttgtgtctgaaatggacccatagaagttattgtgatgccttagtaaataaggattatttttagaatggtgtacacatcattatcataacagggcaaaattttttgattcttgcttaatggtcattagcaataatggactctaaatcttcaaatcacaaatttccttcttatgctcctctctaataataaccatcatttttctatttcctacataaatctactattttacatatgaataaatatacatggtgggatgattgattttatgtgtcaatttgactgggtcactgggtgcccagatatttaattaacatcatctggggtatgtgtgtgagggtgtttttggataagagtaacatttgaactggtagactgaggaaagcggttactctcctacatttggatggccctcatccaatcagctgaaggcctgcatagaacataaaggctgaaccttccacaagtaagagaggattcctcctgcctgcctgagctgggaggttggttttttcctgcctttggacatgaactgaaacatttgctccttttgggtatcaagcctgccagctttcagactggaacttataccagcagctctcctgggtctccagcttattggctgcagatcttggaacttctcagtctctgtagctgtgggagtaaattccttaaaataaatctctttctatgtatgcatatatcatataggttctgtcctttgaagaaccctgactaataaacatagaaataaattttcaaatctattaaataagtaaatatgtatctcacatataaacttgagcccatccccctctctggaattccataaaaaataattttcatagcctttaaaatcctctacagttccaaggacctgcccagggcaaggagactgaaactttttatttttaactctttttttcttacaattttattttttaggggtgtatttttaggaggagctaccagcagaactatatcccagcattgctgatactaaggtaatgcccgtttactttcctctgttttgtgtggctcattgcaaccagggactggaggtggtggtggaggagcaggagagtaagtgggggttctggatggtaccaaaatgaccacatacaaagacagcacaacctgctaaggctgcaacctgctaaggctggatgtctggcaacagtggcctctatccacacagtgctcaggatgcaagttgctttttagggacacctttgctgctccctttacctttaaggctgagtgttacatttccagaaagaggtataccctcttcttccatattaaagctaattttaactaagtgacaaacatcactagcataaacataaaactgaataaatgcagcaaagattattatggtctctgtttgaagagacagtgtaactacaacttagcagaacacaatttattgtgacttggggaaaggcagagtatggtttttgcttgggccccacctgggcagggctgactcccagctcctctggttatgttctgcttcccaatatcatcaactactgagaatcccaactatgtaaaacatccctggggaattccactagggtctaggcttttccatgacaggcaggttcttagaaacaagtcaaaactatggtttttgaggggcttcccctccaagccaaatgttttcatctaaataccagcactaactggtgattcagtatctgatgaataatgcttatgtttttatgctcaacttgtaatggactataattgtctacagacaaccacttagcatatctttatctttgcagactggctctgtaaatgtcatatctttgtgaatacttgactcccctatcatttgagtgtctgtgcctattaagttctgtatattgaaaaattctagataatctagaccagttaaagcccccactgaaacactgtgtggagccagacctcatttccttattttccttctagaacaaacaaatgaagcaggtgcaatgatgtccgttccccttctttcatcccaccctgagtcaatggcagcagcaaacccaaagttactgcaccttcattcctgtgataccgattttaatctcactacatttaatttcactacatttctgagacaaagtaacatacatactagcaaaagctgcagactacaagttagcagcctgtagtttaagcttcaattctgacagtaactgtctggctctagtgaaaccatttagtcatttgtttcacattttctcatctgtaaaatgtaatgtgggtcaactctgaatttctctgagagttctaaaagtctacgattcaccaaccacaacttgacaaccagtaatatccaccatgatgcatgagactcaagctaataaaccaattagttaagcaatccccatggcaaaatcagatccagttttggatcacttttttaaaataattccaagaaaccccagtctcctagggaagactaggatgtaatagattctgaaggtcatagagattaaagcaaattatattgtggtactatctgcaatatctggtgggtttttataacctacctagccactagcacagtggcttttagaagacacagtaagtagttacttgttatttgactgaggaacagataaaaagatgatgactctatcatctattagtattcaggaaactatgaaatgaatatacagtgcatccagtgatttgtgcaatgtgtcagccatctgggctttattttcactgtacgccaccgttatttattaaagagtagaaatgattaacacagagacatctggccctgcttatatacccacactgcaagtttttaaaaaaagatatacccaggaaattaacattcatatttggatacaaaagtctggattgaattttgttttttagatttatgtctctaccagtaaggttttacaaaataaactctcttctcaagaatgatgctttgaagaaaggctactaccaaacttagcagttacatatttttaggtttattatataaatataaatatatataaacatatacaaatgtaaaataagttatacacaatcttactgcagaatagtttttctagaagaaatgccctgattggaaccaagaaggtaaaatctctaaatgctttcattttgcataagattagagcctacactgtcagaaaatgattaacactcagacattctcactactgtcaaaatactgcacaaagagagagaatgcaggattgccaggggcattcccagctccctgacgtcaattcagatcaaattcagataacttactatgccagctgcttgatttttccgttttgtgaaaatcctattctctttaaaatgagtttgctatctaaataccatcaaagctactttgaaatattgggaaaagggtttaagcttttttttaatgcttttcacctccctcctcatgacaacaagcttgtagagaatgatcaactccttctgattccttcaattattatcactatcatgatataaaatattttttctggactctatagtttgatgtagagtgaaagacaatctgcactctgttaaaatttatcttgtataggttcatggatatggtttggttagagactttgtaatagatgtggcacctctgggcttctgaaaagaatgtcatctaggaaaccacattatttgattccttggctccaccctcccaactcctgtcctcaccatcctgttgtcttttctctgtggcactatctaatgccacaatagacttcccatggttgctctccagaaatagaagaagcttttggatatttgaaatacataccatcttaactactcctgctctaacagcaacaaacttttcatcttagttgcaattgatgtttttctgtgccttcttgtatgaattctttacaggttaataataacatacaacacttataaaatacttcccatgtgccctattgcatgctttatacatgttttatttcagttaactatcacaatacatttattaaatagacattattattatccccattttacaggtgaagaaatgtagacccatagctgttaaatgactcgccaatgtcatacaacatgcaaggagtggagctgaggtttaaagatgtactcaggttaatatgttcttaaccaccagtgtacattacttccctttctgagcatacaaagtacataggagacatggcctatggagcgttaatgcattaaatatacaatgccctgttaaagtgactgaaaaatactaggtttttattaagcatttattgtaggtcaatacttgacatgcttgtattattgtgggaagtaaaatgaaaatcataaaatgttttctccctgcatcaagaacttaactttaagaatacaattttattttgcaaaaatagttaataggccttcttgttttagtttccagcctaagagttgtctatcaggaatgcatagaagtagaagataataggaatcatatgtccatcatttaaatatgtaagatcatctttttaacacctgtgatctaaactgaaacaagcaaacaaaatcctagtcagtatggagatgggggagaaacaaatttctagattgaaaacagaaggcaaaggagcgtctaagaagagatgtaacaatgatgctttttcaggataagaaatgcttcatgagaaggtatttcaagcatcctgggaaaggtgagcgaaacttctactgggagtgaaaggcaggggaggaatttcaagttgataggacattaactgcagagaaatagaaatagctaaagaaataagcatttgaggtttttttcgtgttcagttaagaggaaataagtaggtaaaacttgaaaatactgactgaaagccaagaaccagactcacagcacaagggacttgctgagtgaccttggacaagctacttaaattcagcttcctcatgggtcagacgatgctatcagccctatcattttcctagttagttattagtctatttgattaaatgcacagtggttccagaaagcatttaaggcagtttataaaaatacataaactaagatagcactaataaaaagtaatcaggaaggagagcaacacaaaaaacatgccggaaaggaggctaaaacaaaaaggcacatcatgaagacttagtccctggctatgaatttgactctgagtttcaaagcaacctctgaattagtgaaatctggtgagttacagacgttaggaggagaaatagctcccttctagcactgaaagcatccagtgagatcccgcatgtaacaaatgcttatttccttctcattcctcttttccatgaaatggcaggaagtgccagatccctttagagagctaccacaagtgactgtctgccatagtatttcttccctgccttcccctctgcacatcagacacacagtgtgtacacagagacacagagacaccacactcacaccccacactgcagggagcattccagagctgactactaaggcttggggtctaggtgctccctagttccctcagttttcaccccggtcactatttacccgtggagacagacatcccagataaatcttctgacatcatcaagagccaaaaaaaaaaaaaaaaaaaaaatgtgtaactgttgaagcaatgtaaaatataatgaattttaaagtgttgccatttctaaggcctgtaggccactcaggctgtagcttcgtttccttttttatctcacattttcatgctttaccagtgccaaacaatttgagctattcagctgaagcaagccgagaaagaaatagaggagagatgtgcatcttgtaagatttggaatacagctatttaatctatcagaaattagtttggagtagataagctgtttaaatacgcatttgaaataccattaatagggacacttctctttttctctttgctctgtattgtggttcttttaataaaattggcaatggtgatatcagtgtgtgcatagctgtgcacactgtgcttagcaaacagttacttaaagccaggatattcatttttatgaaaaagaactagatatatattcaatagaacaataaacctttcaaaaaatataaccactagagataatcttctttttttttttttgagggggggatcttcagagagctttccaagtacagttggaatatttcacaatttcaggagacttgtatgcatctaaatacaaaaattgaatgtattttcatggtaaaatattgttggatgtattaggattggcggtttagctggtaagtaaaattttagggagagtgggagcaaggcagacgcataaaacatctgtgctttccaactgagatgagtcaaataaggagaaaaatgacaaagttctgtggtaaatgagctttgaagtgttctccagttcaagccaatttttaaattttaatattaataaggattgttggccaggcgtgacggctcatgcctgtaatcccagcactttgggaggctgaggagggcggatcacgcggtcaagagatagagaccatcctggacaatatggtgaaaccccatctctactaaaaatacaaaaattagctgagtgtggtagtactcaggaggctgaggcaggagaatcgcttgaaccctggaggcagaggttgcagtgagccaagatcacaccactgcactctagcctggcgacagagtgagactccatctcaaaaaaaaaaaacaaaaaaaacaaaaaaaaacattgttgctgtggtccctctgtaatactgctctcttcctgaggcttctacttgcttgagctcttttgtttcttacaaaagcacaagcatctagaagacagtaattagtttctttcttgatatatcagaattattccctaattaaatgagatttaaggtgataaatggaattactttgtcttttagacctccatatttctctggagaattaccttacaaggtttaaaatatgtatattaaggaagcccacttggaaaatacagaattgtttggctatttaaatgaaagcagatacatggtgtttcagtattcttattgtctttatggcttcaatgctctcaacatttgaattaataagatttggggtgccttagctgcatggaagaatccttatttgtttccttgtgcccacattaaaaagaactcaaaatgactcattaaggaaaaaagaaacttgcaatgaaagaactgttgtgtgggtgagtcccaagggagacttgacaatatcatgcaattttcagttttctccctatttctttatattttaataacctaccagttttctatagagcacatctttctccatgccgttgttttcttacacatatagtaatgataatagttatctaagatttcaactttaaaaaagcatgtgtttaataagatctctggtattcctctagagatagtaaaattataatatcagcactgccttaataacaacattttaattgtttattacttccagtatagtaaaaatatcatttcgcaaatatttgcttagctctttggactctctcatatggctacaaagatgagatacccttacaattatctcattttacaaactgattttctttttctttcttctaaagcaactgtggagtaagtatcctcttaaaataaatttcatatgctaagtgattttctaaaaagtaggtggttgaacttaaacaaaaatattttaaaatatttaatatattggctgtttctcaaccctaccactgcatgcaaaatagcttttcttttcaggtgaccatagcaaataagtactaagtagcttctttatactaattgctcagtcaaatgctttcatatgctttcatcaaatgcttttatctcattttttaagagtcttatgagataaatattatgatctccactttgaagatgaagctggagacataaataacagctatagaaaagaaagaaaaccaactaaaaacagtttctgaacttaaaaataatccatgcaggtaattcatgttcatacacataatgtaaaccacttagaaatgtagtatttctttatatgttacatgcctcatttgtcatctttgtgcatcccttcagacatctgcatttgtgtactgcaatgactaataatagtaaattaaagtaaaataaactattataaccaaatttatcttgttcctttgatgtggtacagaaaataattaaacaggtaaagatataatacatttttatgtgccagaatcaattggcaactgacgtggtaccacgaaagtaaaaggctcatttctcccactatagagaaactctaggcaatgtatctctatccagattaagtcttcagggagtacagaggaagtatacatagtggagggaaagaacatgagttccacgatccacgtatagacgatcaaatcttagccctacttactagcagagtgagattggccaagattatttctctctgaacctacctttcctcagcttgaacacatatggcctaacatatatttcaagcatatctgcaatatttatatttaaaatgatatgaagcaaactttacctataatgacattagttactcttgggagatgattatgtatgtgattttatattgccctgtgcacttttctctatgtttaaaacatctcattattctttttaaaaagaataaaatgagtaagtaaataacataaagttgataatagctacttccaggggagggttcagataaactgaaatcagataccatatataaagcagatactgcaaagtaggtaactctcaatttttagctcccttctttcttgttttcttggcaatgcaccattaccttctacctcatcaatttcattcatgagattgagcagtgactttccagtaaagcaagttatcatatttgatgtcagtggtgattgatacaatgctaattaagtagctacatcacaggaaaaccacataacattgaaagcatatttcatttaaacattttggaaagctttctctgtagtctcattgtgaatagtaactgatgccttggttatgcaaaattcaagtattttcctcagtatttctccagaaagatgatataaaaattcaccatactttcaatgtcactatttaactatatgtatattcacacagattcaaaagaatcatgaataccttatttcttacttaatctaactatctaataacaataaatgttatagttaaatataatgtataagatatagaaattgctctttatcgctatactcttcctggtgagatagcagggataatggataaattttaggttgcccaggcaagaagcagataggagaaataagaaaaagctgtagctttatttactaaagttaggatgttttgctcaaatatgcaacccagatacccattcaggattgaggcattcattcccccagcagctgggagtcttctcagctaagtctctctcctggaattgcctttatccaaagagagagaaatctactgcacacaggtgttgatcttaagagaaccccacccccaaacaaatttcttgggcctaaatctctgcctccaagtctgttttctagagaatctggcttacggcatgttgcatcacctctttcttccttgaatgcccatgaaaaccttgaatacaagtatccatgatcctgaacatggtttggttttctaaaaaaatttactgggactatcccatctgtacattcactgacaataaatgatgtagaacattcactagagaatttattcaagattacctacttatattaatccagaaataatataagaaatgctgtctgattagggagagtgaggttgctcacacttggcacctgacccaatttctacaacattttacttgtgccagtacagacctatgttgttctttttgaagagttaagtgtatatacataggaacattgctcatttctatttactcagaaaatctaattttcctccaatgcactaaaaacaaacaggaggcccagtgagattaaaccctcaaattagtgtgagaatacctggtttcttttttactgccctcaactgaatttctcatcacctggagctaattttccagggtacatgtgctgtggaaataataccagggaagtttattagtgtagggaactgataggtctattatatgtttaggctgtgtccccacccaaatctcatcttggattgtagctcccacaattcccatgtgtcctgggaggcaatcgaattatggggtgggtctttctcgtgctgttctcatgatagtgaataagtctcacaagatctgatggttttataaagaggagttcccctgcacaagctctctctttttgcctgccaccatccatataagacgcgacttgctcctccttgccttttgccatgattgtgaggtctccccagccatgtggaactgagtcccttaaacctctttttcttcctagtgtcaagggtgtctttatcagcagtgtgaaaatggactaatatgatctatatggtcaattcagtgagaggtgtccattggctaaaattgtttatatacttttaaaggcttaaaaaaattaattgtcagattggtaccaaactctgagtttttttattgcaatattttaggcattttggcaaaatatacactggggacccagaaaaaagactattctaaaaagaatgaaaacctcttattttgcaggtggccaaaatcctttgttaagattcaaaaatccgtgtactaaagcagttcataacacatctctgcagaaacatgatcagatacagcttctcaatgtatatacgtaaatgccttgcaataaggcaaaatggttaagaatgtcattttaaaaaagcatgttctaaacactggaatcgagtttactatttggtaaacagttcaatatactgtaataaactagctcacaatgaaccaacaaattaatgtaaagttgttaaagcacagtaagttctcatttttcccatctactctgtttctcaagttaaactgcctattaaataaccagaatctcatccagttatattcataaatacaagttaaatacatttttctctaacaaccagcaactcagttttagagaccaaatgataggtgtcctggtgatttaaatacataattacaatgttttaatgtataggtaaattactaagatcagaaactgaatgaataacgagagagatgtggcaggatattttaagatccatcataataggtaggaagagtgattctatttatttgtgaaaatgcattactgtttaagttcgattcatgaagctatacaaaccccaaatgtcacagcattatgggaaaaggtggaacatacgtctgagcataaaacagtgatctaatcacatctgaccacattacgaaatagtttttttccaagttataataaggattgcttcaaaaaataaatggcttactataaatgcatgataataagataaaaacaaaatgagctttggaaacttggctttgaccctagtaaccccaattaaaattagagaaatacttcctttgacagtttatgctgtgatatcaaaaatacaatgcaactcagggagacagaatgtaatgctttgggtgttgctacctggtgagttcagaccactggcaggaaggaaaatgtcatctaagctgctgaaattgtttgtactccacttgtgaatttgcaatgtgtcagatatgtaataaaggcactttctagaagtcgtatagccattaaacttcctaggcattgccatgttagtataatgatggattgcaggtctcaaaaataaatactagcaagactagaattaggatacaaattcagctcctgaacatctgttagggaaagtcagtgtcctaatttgacatgaaaattagatctgtcaacctaagcaaacaaaacaaaacaaaacaaacaaacaaacaaaaaacacctagaaatttattttctggtctacatcagttctcacaaaagtgagacatcaggagaaagttgaactgttagtcataactttcatttattttatatgcccaaacttttgcaaaaattttccttgtgattttaattaattattgcaaagaaatgttactaaggttgcacagtcttttaaactactattaactatccctaatctttctctttcaaaaaaccaagaaaattctaaatgtctagcaatagacctgaggcacttgcattaagactttgaaacaatcccaccagcaacgtaccttccccgtaaacatgcccctcaaaataatactcagtgattggtgcggactacaagctgagcccaaaccttattcctcacttggagtgttggaataaatggatgtgttctatacatttctaagaaaaaaagcaagaaaagaaaaagctagtttttaacacaggctcctgtattcaaatccccttcaagttaccccctacaattcccacctaaggctgttattttcatcaatatgctctttctaccttatccagcccagtttggccttgacttccccaccagtttcctccctaggaatcttccttgagtcttgtcctgcctttatgatattgtaagcaaactcacaaatatccttgatcacttctggatataacttgctcagctccttgaccacactgaagtcgggctttctcctgatggcacactcttccaaaatgtttactatcagaagtagtctccccacttgcatgcttctcttagtccattagctcacgtctgctcttcaacaaggttttttctttgcaagtccatcatatctacttactccattctctttgtgtctctcatttattaccccctggccctgtttctaagtttcttagtgaaattatcatcaaatttcaacaagcctcatcatcaatcctcaatctccatgtctccattccattttcatccttcataaatagagacatgaaagggatcaagatggctgagcagaagcaggtagtgtgtggctccccaacagagaaacgccagaatagtaagtggacaccttctgagcagatagtctaggagagaatgcttggatgcgatagagaagagacataaagcattagaagactgcaggggcaggagagttcccgaagccaggtttcttctgggtggcaagacatgcagctaggggcagctttgagacctggaaccagtctgcgtgtgttgctacgaaatgagaaaggttcccttgtcccccttgcaaggtgtgcaactggagaagtggctcgcttcttcagtgccctgctgctcgtacctctaggggagcatgcaggttgtgggggtcgatcccacggcagcatctaggggtggatgtttacagctcccaaagccccagtgggcatgtgctaccatgggctctttcagttttgccgtctataggcagcttgtgttaaccagctcaattagaccctccaccttatcacaaggacgagggctttctgtatcccgggttcttgccttggcgtgagggaagaattgaatcacacctgggcttggagaatgagtacaaggttttactgagtggaagtagctatcagcagatgggggagccagaagggagatggtttccccctggagtccagccgctcagcagcccgggctctcctatgactgccacgaccaaactccgcgtcattcctctgctggacggcctgccaggtggcagcatctgttggtgtgctcttccaccagcgtgctcccctcgatgtcctctccactttcagctgcttgtgtctctacccgctagggtcttggggtttttataggcacaggatggtagggggcatggtaggctaggttggtcttgggaaatgcaacatttgggcccaaaggctggagtgcctgtcctcacctaggtccgtgggcacaggcctgggggtggagccctcgccagggactcacccttctttacccagcacttcccagcatcccttacatatcaactactgggttccccagtcggcttccttgttcagttgggggacagtaacccaccagctctgaaaagtggtaagggaagggacccactcccctagaaatctagccctcggttcagtcggcccctaagggagggggatgtagccggctaaagcccctcttgggtcaaaggttgggtcaaaggaaacaggagcactgcgctagccactgaagggggcgccaccaaagccagggaatggttgtcgagaaggggtcatcgctcacctctctcatccctcttcagtgtactgttgcggactcgaaggtggctctccccagcggaaccgagagagtgtgggctgaaagagaccacttttggggcttctccagcaattccactcccactgaaggcaaacgcgctgaaggagggcactttgcagacttttccattgcttctgcccttgcccctaccttctggcgctcactcttaagtgccacctactgggctgcagcctgaattacactacaaaacaaaattacatcactacaagaagcaacgtctcagccaccgcacaaacttatctgcaaccaaggaacccatacagagccttggcgccctgaaagcactcagaaatgaagctgatccacccatacacattttacaccacagtcatacccacaagggaaaaaagaatttaaaatcaacaagctccatccaaacaatagcaaattcaaaaaagaaaagaaaaaagcatcagctctctcagatgagaaggaaccagcacaagaactctggcaatacaaaatgtcagagtgttttaccacctccagagaatctcactagctcccaagcaatgaaccctaaccagaatgaaatgtctgaaatgacagatatagaattcagaatctagatggcaaagaaactcaatgagatccaagagaaagttgaaatccaacacaaagaagccagaaaaatgatccaagatttgaaagacaacatagctatattaagaaagaaccaaacacaacttctggaattgaaaaattaactatgggaatttcaaaatacagttggaagccttaacaacagactataccaagcagaagaatgaatttcagggctcgaagactagctttctgaatcaacccaggcaggcaaaaataaagaaaaaaataattttaaacaattaataaaaccttcaataaatatggggttatgtaaagtgacattggcatttctgagataagagaaactaagcaacttggaacacatatttgaggatataattcagggaaatttcctcaatcttgccagagaagtcaacatgcacatacaagaaatccagagaattcctggaagaatactatataatatgaccatcttcaaggcacacaatcatcagactatccaaggtcaacgtgaaagaaaaaaacttaacggcagctagagaaaacagtcatatcatctataaagggaaacccatcagactaacagcaggcttctcagcagaaaccatacaagccagaagagattgggggactatttttagcatttttaaagaaaaaaaatgccaaccaataatttcatatcccaccaactatacttcataaatgaaagagaaataaattctttctcagataagcaattgctaaaagaatccatcaccaccacactagacctacaagagatacttaagagagttctaaacatgaaaacaaaaggaaaggatgatccttgttaccatgaaagcacatgcaagcagatagcccacaggccctaagcagtgactgaatcaatactacaaagcaaccagataataacactatggcaagaataaaacctcacatatcaatattaacttttgcatagtcaaaattaatattgatatgtgaggttttattcttgccatagtgttttaacataaaatattaactttggccatgcaaagttaatattgatatgtaaggttttattcctgtcatagtgttttaacactccatttaaaaggcaaaaagtggcaaattagactaaaaacaagtctaacttcaagatacccatttcacttgtaatggcacccataggctaggctgcaagtaaatggatagagaaagatctatcatgcaaataggaaacaaaaaaagaacaaggatcactattctaatatcagaaaaaatagacattaaacaacaacagtaaaaaaggaccaagaaaggcattacataatgataaagtgttcaattcaataagaagacttaactatcctaaatatatatatgttcaacattggaggatacatatttataaaataattgcttatagacctatgaaaagactttcatggccacccaataatagtggggaacttcagcacacgagtgaaagcaatagacaggcaaaaaactaacaaaaaattttgtatttaataaatttgatagttggccaattggacctaatagacatctatagaatactccacccaacaactacagaatatgcattcttctcatctgcacatgatatatattccaagattgaacacatagtcataaagcaagtcttaatacatttcaaaaaatcagaatcataccaagcatcttctcagaccacagtggaaaaaaaacagaaatcaacagcaagaggaattcttaaaaccacacaaatacaggaaactaatcaacttgtttctgaatgactctaaaataaacaaaaaattaaggcagaagtcaaactgttatttgaaacaaacaaaaatagagatacaacataccaaaacctctagagtacagcaatggcagcgttaagaggaaagtttctagcactgaatgtctacatcaagaagatacatctgaaattaacaacctaaaatcgcacctaaaaaaaaaaaaaaaacagaaaaacaagaacaaaactaaacctagagctagcagaaaaaaaagaaataactaaaatcagaacagaattaaatgaaattgagacccataacaactatacaaaggatatacaaaatgagaagtttgttcttggaaaggataaaaaaagattgatatactgctagctagattaacaagaaaagagagaagatctgaatatgcacaatcagaaatgacaaaagtgacatcacaaccaatcccatagaaacataaaagatcctcagagactactatgtacatctctatgcacaaaaactagaaaacctagaggagatgcataaatttctggacacacacaacctcccaagattaaaccaggaagaaactgaaatcctgaacagaccaataacaagtaatgaaattgaatcagtaataaaaaacctaatgtccaaaaatagccctgaaccaaatggattcacagctgaattctaccagacatacaaataagagctgatacagatactactgaaagtattcaaaaaaaaaaaaaaatcaaggaggaggaactcctaattcaaaaccagtatctttctgataccaaaatctggcaaagacacaacaacaaaaaccctacatgccaatatctctctgatgaacagatgcaaaagtcctccacaaaatattagcaaaccacactcaaccaatgagatactatctcacaccactcagaatggctagtatattaaaaaaatcaaaaagtaacagatgttggtgagactgtggagaaaagggaacgcttgcacactgttggcaggaatgcaaattagttcagccactgtggaaaacagtttggagatttctcaagaactaataatagaaccaccatttgaccctgcaatctcactgctgagtgtatacccaaaggaaaataaaccattctaccaaaaagacacctgcacttatatgtgaatcacagcactattcacaagagcaatgacatggaatcaacccatatgcccaccaatggtgggctggataaagaaaatgtgctacatatataccaggaaatactatacagccataaaaagatgaaatcatgttccttgcagcaacatggatggaactggaggccattattctcagtgaattgaaacagaaacagaaaaccaaataccacatgttcttacttataagtgggagctaaacactggaggcaacacggacacaaatatggaaacactgaacaactgaggattccaaaagggtgggaggagggaggtgagcaagtgttgaaaaactccctatggtcctatgtcactacgtgggcagtgggatcattacaagcccaaacctcagcttcacgcaatttacccatgtaacaagcctgcacgtgtactccctgaatctaaaataaaaataaaataagaaaatacaataaagagatccctctactaccctcacaggactggccattgtatcatttcttttggtacagttcataaactctaaccctttatttcttctttttttctccccttctgatcttctctctttccacattttcactttcagtgctgtatccctttctcatttttccatattatagcctcacctgctagaccaactaatttttttcttatttaaattccaaaattgaattttctaatcagattcacattatcacttttgaatctcttatacttggtcttcagaagtcctgaatgtgaaatccaaaccctctctccattcattgtattctttttaacaataacaaaattatatctttgaatacttgttagagatatattcctcagtcagtctgccttccgattttcattacaatttatcatgtagtcatttcttagtttttagttgttgtgtagcctaatctgtcagctgttttctcccaataaaacaattcaagagcatatcctttatctgtgctgggatatggagattacataatacatttggggttcagatttgtttacttcaacaaatattaagcatgactacactaggtagagtagatatattaaagaacagctcctgaccttaaggagcttgcaacttttggagaaaaacaaagacatgcacaaataatttggatattacacagcaaatacagcgacagacatgtatcagcatatgagagcacagaggaatgtattaaatacatcttggaaggcaggaaaatgaggaaatgcatccagaggcagaagaaagaggcagctggggaggaaagaggaaaatagactttccagacagaaaaaacccagcagttgtgtacaataatatgatgaagatctaaactagtgtagtcaattgataaaaaggaaaaagcttaaaaaatattcagaatataaaatcagcacagtatggtgatggtgactgattggagacactacctaactacactggggaaagactggcacagcaagagaacagggaagcgatgtgcattcatattgataggctgaggctgagctgctaattggaatgtcaagtggaatagatagtagaatgtctaaatttaatgggtaaatttatggatgaagataaaacctgaagatgcatgagaatgtttatgatagctaacattttgctcttgcttgcagtttccccaggaatttttacagtgcctttggagactcagagaaactgtcttgttctattaattcctttgcctcctttcactagtgttctccactaaattataatctccctaaagattcatgccatggtttctttacctttatatccctcctgtctcctagcatagtgcattactcttagaagagagtaagcactcagtaaagtttattattgaaaggtcctcaatagcatgaacatataactaataggtagattaaacttatgtggaacacctgtggtcaacaaaatacctatatgcagatgttccattaacagataagtctttctgagatgattaaagcaaagagaaagaggtctgacatttatgacatgactttcagatttaaagcactcaaatagttgtttaaaagaacagatctctgtttaattacctccaaccaatggaggtattagatcacattcagaaagctttaaacatggtgtctgagcaataggaatttcttccatattcttctacccaattaaaacttggggtgaatactgaaaagatggagatatatctaatgaaacataaatttaaaaaaagacattttattcactttgggacaagatcaaaaagacttagataattattttaattcaattaggaaaattgaaagcaccattattttccactcagataatttctttattccttaaggtagtgtgtgtgtgtgtgtgtgtgtgtgtgtgtgtgtgtgtgtgtgtgtgtagtttgttttatctctttttttgtaaaactctccttagggaatattgcaagaattgtttttcttgatataaaaattaaagcatggagaaattccagtgaaaaggaaaggacaaactaacatctgattccacactatttctaattctcaatcacaatatcttgataggatagaggtgttttgtaggagattagaaggctttttttttttttttgctgaaattgcttttacttgatttcttttgaagagttgatctcaatttttaaaattgtcatttaaatgctaagttctgtattaggagaaaataatctagaagaatctaaagacaagtgtatagccttaggtaaagcatcagaaagcataatttaaagagggcttgctgtggaagacccttcaattcagtattattcagagtagcaaaaaaggttaggctacaatattcctgagtgttaatttcatgctctggagctcttaggtaattttacagagtatggcaaagtgataaaagttcaggaggtccatcatctataactacttctgtagaaatataggggaaactgtaattacatcctcagaaacttatgctttcaagtaaaaggcaaataaaattagtaaaataacttcatgcaactcatggctatccagaggcagctttattcaatggaagtgctctcactgctggttcacagcaaaggttcccatgacaaccaagaatacacagtacagtggtgatgctgtttgcccagggatatcctgtcattaatataaataagtagataacgatatctagtctataggtattatgatccacagctgtctataaatgacaactgcagagtagaatggaatgctcagaactgagtttattccaagttcaattaaagttttatttccttactttctaaaaacatcaaagtatatgcttctaaattattctactgtgtttcactataattttcaagtttggtttcatcctggattatgacctttcagtgagctgggacagtaatgtggccccaggtatggtgagtaagcccacctgaaatagaaggtggtttactttcttgatatgaacaaaggctattttggagttggaactctccagaacagttaaaatgcatttatatctaaaggttcttaggtgtaaaggaacatacatatgattttaagcatatttctctactagaagtcttataatatttcttatctgttattctgtattcccatgtttcctgaaatactgtgaacttattaagacaagaacaaaatgtcatttacttttatatattgggtctaggatgagttggtttcttttatatattggggtctaggattacttgatttcttttgaagaatccttgtagaatgaaccaaaagataacagataaaaatatgcaatcaataaatgtaatagcatgtgctaaatgtcatgtgtaccagaattaacacttggcctatgagagatacagagtaatatagggcccatttgaatcctaacactgatttgtcatcctgtttatttaagaaagttacatactatagtatttcataatatagttgaacaaagtatctgttatatacatatgcacattaagccacaattcattttgcatttgtaagaaattcaatattattttgagtaatttgaaggaaacacaattcttacaatttgcataactgaggttcaaaaggaaagtccaccatctcaacccagttaaatttggctaactagtatgtaccaatcaatataaacacgtgctttaaaaaagttaccctagttctcattcctaggaaacatcagctgtgtagcaccgggattcatttctgttctcatacaatttaatttctgtaataaaaaatctatgtccattttttgatgtgtcattgctgatagctttaaagtgttatacctctctcttcccctctgtcctacatttgggaaaactgttaagaaagcccatgtgttctctcctttggtgatggtgggaaattcaaaccacaccagagtccacccacacaaaactctcagcatggcctcacccactaaaagtcataaaatctcaaaccagtcattttccccctgctctctcaagctacttcagaccttcttgggaggcctgctctgctctccccagaaaaacctcataattttataagtaatacatactttcatactttcttggtaggggtatatgtgtgtgtgtgtgtgtgtgtgtgtgtgtgtgtgtgtgcgtgcgcgtgtgtttgtgtatgtgtgtgtgtgaaagtgagagagagagaagtgtagggctgctcattagtcttaacatttgaaccatattttgggtggaggcttatctgaatccacacaatggatacaacagtttcatcttctagatcttggctatttggttctcctcttctgctcctttctttgggagggaagtaaaaagctaaaatatgcattcccaggttatgcatagaagctaacctaagggaactgcagctttaatacagcaaaaagaacccagaggagagtacagaactgatgttattattagcagaagttgaaaacattcacctgcctaattctgagttggctctggcatcaacagtctttctagaatttgttcaaacagcattattagcagagggtgctgagaagagcagattaccagattactctttttatgcctacattagattggcctcttgcagtgcatcaatataagggtatgtggtatcatttccaagatgaatgttaaggaaattcacacggacaggggaaagcaggttttctacacttaaatagcacattctcaagagggaaaatgtcaacgtatggcttattcatagcacaatagctgtttaaactacagcttagaatctactatgtgccaagcactgtgctaagcattttacattttgcatatatcattattagtgccattttactattggaaaccaaaaacagatccagcagttgtcagagatagaatttcaactcagacttacctcatattcaatgtctatattctaatgaactcattctaagacttcagatttacgttgttaagactatgaagctttttgcttcctgataatctctgaatgtctaataggcctttatagctggcaagcttaggaaagaagcacatttttttttctgctggaatgtagggagatatctgtcatagctcatagatgaaatatataaaaacactacatggtatccattattcatttcagctccattgccctaaagaaacataacaccatgaatttagatgtagcaagacaatggaataaatgcttttaattttttttcaataattatgtcaaaatagatattctgggaaccgtgagaaagtagaaagtgtagaagtcatgttgttgacttcaacatgcttacaatatacctaacatatggctcagtagtttgtctagttgttaataatttgaaacattgatttgctaaattaatataaatggtttcacattacaagtaaggtaagtattttaaaatactaacttttcaagacttcattttttagaggagtgagattcacagtgaaattatgaaggtatacagatttcccatatgtaacatactagttttcaagcattaattttaataattcttatatcctgagttagcatttaaatttattttatacccttagtctttggcaaaaaaaatgcttctgcttaaaatagcttattggctaagaatccatcattttaaagaaaattatgcataatcaacaggtatatagtttaaatagaaaacagcagggggagctcaaagacaggttggacaaattaaaagttgacttcaagagtactgaaaaattattttaataaaaatttgaagagaagaaggaatatactgttaaattatgagatgatattttatacaataatttccagcaaaatagctagctaaatggaggaatagtttcccatacagaacacttcaaaagtccagaaaaaaaaattaatgcacagaatcactagacatcagtgaagtgaaaattaaaattacaatgaaataacactacatattactcaactagaatggttaaaatgaaaaagataatacgaagtgttgacaagaatgtggagctcttagaaaatagagaatattggttggaatctaaattgaagaagctacttgagaaaactgtctgtcagtcttcaaaaaatgcatgcctcataatcaagcaattccacttctggctatatacccatcagaaatatatatgcattatacaaaaagatgtatacagtaatgttcatagcagcatgatttgtaatagtttcaaataaaaataaaacaaatatttaccaataataaaatgggccaggcacagtggctcacacctgtaatcccagcactttggcagactgaggcaggtggatcatttgagatgaggagttcgtgaccagcccggccaaaatggcaaaaccccatctctactaaaaatacaaaaattagccgtgtgtagtggcaggtgcctgtagacccaactacttaggaggctgaggcaggagaattgcttgaaccctggaggcagaggctgcagtgagacgagttcgtgccactgcactccagcctgggcaaagcagtggaactctttctcaaacaaaacaaaacaaaacaaaacaaaacaataaaatgaataaataatttataacatatttgtatgaagatgaaaatgaactacaactacatatataaagacaaatgttcctttaggcccaggagtttgagtctagcctgggcaacaaagcgagacccagtctatacaaaaaaataaaataaaattagccaggtgtggtgtcatatgtctgtagtcctagctacttgggaggctgaggcaggaggactgcttgagcccaggagtttgaggctgcaatgagttatgactatggtactgtactacagcctgggtgacagagcaataccctgtctcaaaaaaaaaaaaaaaaaaagaaaagaaaagaaaaaagaaagataacttttccaaatacagtgttgaggaaaagaagctagagaacaaagaacacactctctttggtaaataatatgaatattatcttagaaatcacaatagtagttactctggggtgggggcagaatctgaaaggtacacaaatgggggcttctacagcttagcaatatactgcctattaatctaattgctgcttacatgggtatgttatcttcatggaaatttaccacattttacatttaggtttgtgtgctttttcctcttatggtataattcaacaaaatttgctctaaaattatactggatgattgctttaaatcattaaattaaaagtttttgaggcttgaaattaagaaagcttggtcccacagggataactaagtactagaattgttttttgctttgtttgtttttttgtttttttcctgaaggcatttaccaattctttgggttccagggcaagaatctaaacaaggggcctaaacagagaaagaactcacattcagacttcacagaaagtcttatacccaaaagtcaatacctataactaggcatgctacaatctttcatgcagaacaagacttgtcttggtttcaggcagcatatttaaaacaaatatttctttcaaaaatttctaatcacaagtgtatacttgcgatatgtaatatggcattggatatttgcgtggcccaaaagttgaacatttcatttaaagtaaatctatagttagcagacatgcagttacttaaattataagcaaatcctctttcgaaaaatacactttcaacacagataatttccagagataaaatactaaagagtatgagctcacatatgtaaaaaaatatagaaaatgcataaaaaaaataaacttgcctgagagacaatcagtggaataaactgcacaggtagaccaacaagattacagatattggaactatcaaggaactaaaataaaaaaaaatatttaagctgtttaaagaaatgataaaaaatttagtaaatgagcaaaagacaataaaaatcaacacacatatttagaataaagaccaatagaacttctaaaattgaatgtctaataactgaaattagaaactcaacaaacaggtgaaacaacaaattagactctactgaaggttgaattagtgagccagaaaacatatatgaatgaaacattcagaatgcagtagaaaaagaagtggaaaatatgaaagcaaggttaagataggtgaatgacagagtggggccaacataagtcttactagggttgggatagattaaaaggaatggcaacgaggcaatatttgaaacaataatagctaagaattttccaaaataaataaaagacaccaacactcatatttaggaataccaatacattttaagtaaacttttgaaaaactcaacttctggattcattagagtgaaattgcacaacaacaaagataaaaataagaatttcaaagcacccaaaaagaaaaaagtaacactggtcagactgaaaagtgatttctcaaaagacaaggtagtatcgtatttaaagaggtgaagagaagtagttgtcaacccagtaatgcatacacaacaaaactaccttccaagtctaagcacaaaataagatagtaagaaaaccacacatgaagagaattccctactattggagagtcactagagaaacttctaaaagacatttttaaataaaaaggatggtctcagatgcaaaaaaaaaaaaaatgctgagcaaagaaaatggaaaatgtgttagaaaatgttcaccaaagatgacttactacaactataataataatgataatgtctacaatgtaatacaaatatgaagagaacaaaaatctattcttttgtattttctcaggaggacagtaaaagggtaaagatattatttaacttcagccttaagttacatatttggaaaattttttagggttattattaaaataatagaattagagtttaaaacttacaaactagaaggaaaaatacaatgagaaaagggaggaaatcactttgatctaaaataatgccagaaaagacgtgaaaagaaaacaaacattagaaagcaggataaataggaagcctaaattaatatttttgaatattataattatattataaactttataattttatattaagttataaatatataaaatataggtttatattataaactttataaattatataaacttatatataattatacttttgaatataattatattttttgaatattataattataattaatccagtgttcatgaattaactaatattttcagtttagtttcaacaatgtcaaagaataggtactatacaaatatctcttctgttaaagatgaacaaaattagaaattaataacaatgtatttatttaaaaactcattcctttggaaaacatttaaaaagtacttctaaataacacttgagtgagagaagaaatcaaagggatttataaaatacttaaaacttaataataaatatattatgcatcaaatatatgggattgtcactaaagcaatagaattaaatcactgtattagaaataaaggctaaaactcaatgcacaaagcaacttacttagaaaaaataggaaaataaacacaaaaaagtaaaggaaaataataattataaaaacaaatactaataagagaaaatacagtaatagaaattcaaaaacaaacatgaatatactaattaagtagtctggcaatttgacacaaacgagatacagaaatagaggaaaagagaaaacagcaacaaaaaaattttaaagagaaaagagaagaatgggcatagtataagagacagaggtagagttccagataggtaggtaggtagctagctagttaggtagacagaaacaaaggtagagaacatcttagtagagatagacagacatagataaaaaatagtaaaaatttaaaggaggcatgacttacctggaaaaatatagagacagaagatgtaaatgaaagaactatttcccaggtatatggaaacagcaggaaaatgtaatgcatcttggagaaatcataagggtctgagtgaaaactctttagttaagtgaagcaaaaggagcaccagtgaaaagtggtggcactagtgattccagcagataggcaaggagatctgaaaatataatttctcctacttaaaccgttttttaaaattctttctgtttcactgtaaaacttaaatccaagtaccggtgatcgtaagatttaattagagaaaaatagaatttgactcatttgtgatgcaagacaaaataaaataagattaataagtaagttatcaagcaggtcttactcaaatagcatctttttggttacaaaatgacaggggacacaaatatgattgtagaatttgacctagtaatcccagttcttaaagattattttagtaaaataaaagcagtttaatttaaaagataaggaaaacttctaaggatgtttctagagccatcatttctaatagtaacaaatgagaaaagaagcttgaacatcaaaaaatacaaaaagtttcgattaagtcagaatattatgtagtaatcaaaatgatacatgagaagactgtgtcagaagaaagagcaatatttaaggaataataatgtggtttagaaagtaagataaaaagtatacaattattattatagctccattaatatgcatataaccagtcaacattgggaaggaaaaaagaaaataaaagtggttacatcttggtagaatcatggcttaagtaattttcaaagtctttttctatatataattaggaactaataaatcttttaaatattctacttgtacttgttgactaatatgcacaatggtagcagggacagaccattagcttttacattatttttgtgaattcataagaaattcacaaaactagaaaacaagtataaaattccttaaaatgagctatataagtagagtagctatgttgcttttttcactttgataaatatgaaaatgaataataattttcaaaatatatagaagagcacaggttacaaggaagtacctgctgtatctttataatgaacagtgtccagtcaattcaatttccttaggagatagaagaataggccaagttacagcccgttggacaatatgatttcagaaactttcatacatgattagcaatctgaaaacactgaatttctgttctatggattcagcactatatgataccattctaatgaggcttttaaaaaatgtggtaatttgaggtctgaagtgggttcaaagatgtaacaaagtttggcgctccagaacataaacaaaacataacacaggtgtggatgtctaaacttttgactgtacccaatcttaacatctggtttttgtgctcaactgctcacagtcatgtaaaatgtctcaactgttaatgactcagtgttaagtgagaaaaaagaaaaattaaactctgctgttgaataccatgttgtaaaatcctcatctttagagattctaaaaatattcatagactacacccttttgaatgctgtggcaacttatcccctgaaaggagcaggctaagccaagtgacatgaagatattttctctgtttccattaaggttatattcctctctgggtcagtcaaatcaaacttgtagcacgcatgtctaatgcagaatcactgatcaatcaacgtgctcttttctgaggagtcatggagctccatatgccttatgatatttaggacatattccaggaagctaacaatcaatgaaagcttttttcaaacagacttaattaaagagaagatgaatagatgaatgaacttggggtaaaggtgttcaaatgtctctccaattttacttcaagaatgtttaaccccattgaacttatcagttttggttttatcaaaccaaaattctggatatacagatgtagggttcatctttattgaagggtttaatattggatttcctatttcaaaggaatggaaactgaaaagataatattaactcagaaatcagttgacagatgtcaaatcaaggaacatttgtaaaaaaaattagactaatgttcaagtacagatagagacattttctgtaataaaatcttatcacagaatagcaatgccactgaacagacaagtataaagtaataccaaggacaaagataaaaagttatttctatttttgaaaagaaattagatgatgtctagtttaaaaaaatatgtcaaggtataagattccaatattttatttgactatacagtttaggttgtttttcccattaatgtagaagcacattacatatcgttttcaaagtctaaatgtgttcttttttaaaaaatgataaatatgaagggcaaaatattcatcttaaaccatgagataaaaatatagaggtttttcatgccgctatctttttggtaatcaatgattgaatagtgaatattggtttacagtgcagctatttaattattaatacatttgttttttcttagaaggatttaatattatttttacattttctccactaaatatatcatttcaaaattatctacaggaatatgcccaaaagaatgatcaaagcttagaaatattttgcaactctgtatcatattgagatataaaaacagaatcaagaatgatattgacaaaaatcaggttagcacatcatctagatgataggttttcaatctcctaaaaaataatgcattacattaattatgcatatttgagctttaatgagaaaacattgtaaggatgaacaaaatcctttaacatcagagctgacagagaggtgagagactgcctagttcaacctcctttcacaaatgaggcaattaaacctgtaaaagactacatgatttgtgcagttcataaccttcatgagcaggctaatgtctcctgtattttcttctgtaccctaatatctacgtagcatagaaaaaaaaatctctttgaattgttaaagtaaaatgtcttacattgaaaggcagtacttccacatgctaaagagtaagtaagaatttaagaaaaaccatgaaacaatgtgaaagaaatcaaactgagtggtaacaaaataaacacgcttcattgtggaccacaggatttcatgaaggataatgacagtctttcccatgtttctgaagttcgctgtaaagatacaggtttaaatctcagtaagagagattgagattcaggtataaaggaaaacttagagcgaaagtcagtatactagggccaaatgatttcctgaaaggttatgaaaatgataggcatatacctattagtgaattatgctaaatcactgcagaattcagtgaaaggtatacactttaaatgaaatcatgaagcaaattaagcttttgacataggccattaagtgacaaagccaaggtaagtgtttacatttttctttttttttttttttgagacagagtcttgctctgtcgctcaggctggagtgcagtggtgcgatctcggctcactgcatgctccgcctcccgggttcacaccattctcctgcctcagcctcccgagtagctgggactacaggcgcccgccaccacgcccagctaatttttcgtatttttagtagagacagggtttcaccgtgttagccaggatggtctcgatctcctgattttgtgatccacccgcctcggcctcccaaagcactgggattacaggcgtgagccaccgcacccggccttcatttttcaatttagaatctcggtctaccacctcctcttgatagggagtgggaggctgttacaaattactaggggccccacttttctcagtggcctcaaaatcattttatttatttatttatttttacctcactaggatctaaatctgtttttagtggctttgaaaactgtttctaggactgaactactgaattacatttaagattgaactagtgaatcagtgactaaacaaaacaaattttaggaaaccattctcttcattgttcaacagacaaaaaccaacgaattttatcacttactagctatgtgactttgggctagttatttaacctccatgtacctctgtttcttcatcagtaagatgctgattataacagagtgtgtctcaaaaactagtataaaagtgagttccatgtaaagagcttagaataagagggtatacacctaattcattctataatgaaacttaaaaacattaagaatcctcaaggattacatgaagccaatctgaatcataaagacaggttaaaaagtctaaaccaaatgttagcaaataaagcagcaataaatacatatttttctatgtacctatatgtgtatgtatatttgtgtgcatatggcatgaaaggctttaaacatgagatgttctaataattcacaatgttaagagattaaaggggaaaaaccacagaaaattattcaactaaacaaccattcacgataaaaatgtatggcaaatttggaataggaggaagttaccaaaactaatcaaagatatctaatcttgatggtgaaatgtggaagcatgctctttaattgtagacacaagtaaagaatgcttgttctctccatttctatttaacagtcttttgaaagcattgctttttttggacaagtgtcctcactgtcacctgggagcttgttagaaatgcaggttctcagtgcctgacctaccactgaaccaagatcttccttttaaaaggatccctcagggattcatattttaaagtcagagaagcatccgtgcagccagtcaataaatcattttaaaaagtggtataaaatatagagtataaaaattggaatggaagaaacaaatttttgttattcacagatgatacgattgtctacaaagaatacctaaaagaatcagaagaaacatcattaaaagtacatcaaagtttgaaaagtttctaaatatttgttcgatataaaaattattagatttggatatagctgcagcaagcatttggaaaatataactgaaaattgttgccattttgtaatagcaacagaagtctacagtggatgtgaataaaaaatgtataagatcttcgtaacaaaatgtataaaatgcactgaataacactaaaggaggcaattaatagagggatacgccacaattatagctagaaaggtaaagcagaccaactgtactgatgcgtgtcaaaggtaacactaccagtcagtggaaaaatgatggatcagtcaatcgatggtgtggaaataactagttagccatatgggaaacatacaaaagtggatttcttctcacactgcacacagaattcaattccatatgtaaaagaactttacggtgaaataaaaaacttgaaaaatttttagaagggaaacattattttaactgtgattcatgaactatatgatagaatgaaaacaatgacattttatatcatctgggacattactagatgtaaaataattaagtttattgacctctaaaccagcccaatagggaaaaagggagtaaaggggagcatcttctaggcaaatgatgttcccatacatagacttgccagagcatttgcaagattccctttagaatcgatgtttggtctcttgcctatccctcctccccaggcagtcactttctctggattttttttccctctttctttagcttttccttctcagtcctggcaataggccttcaacaccacaccatcaccactccaccaattctggagggatatgattttcaaaggaacaaagtttttggagttgagttccagcactaacatatgtatggacgaagataacagtctacagctttctgttttcctccctattgctctagaagaaaacgctgccaagaaaaagctacttctaattttttcatagaaaaaaactgctactaaagtatttttttaagaatcattcttttcttcgggagaagatatttccaacacttgttgtgatcaagagaaattgcagaatatttttaaaattcttaaaaatcaatcagaaaaaagagtctggaagaaatttgaggaaggcttagaaataatttttatagaaaaagaaacatgaatcactaacaatatttttaaggcttaaatgtattatcagggaaattaaaattaattaaaaaattagtatcatgttaccactagattgacaaaaaatttgtctttcaaaaaacacgagagcttttataaactacatgtgatcacatattctttctccaatactccttgagaactactagattataaacatacatacacatacataggcacacacataggcacacacacacacatacacagtcatttaaggttaaaatacggtaaatattttctaagtcacttaaaattattgcctgtggatttttcatgtaaaatattaaactcttccaatgtttgaacttaatggttattgagaaatacgaaaaactattagctttcttgatttaatatagttaatattgcttataaaggaaagaaaaaatgcttggctacaaggtcatctcattttaagattacattgattaaacatgtagtatagacagggcatctaacccccatttcactagccagcactgaaaacttctttaaccttgcataaaatgcatgcatattctttgaaagtctttttttgtaaacgaagtattagatttttaatgtaaattataagaaatgtaatgtttactaatgccgtcaagaatggcaggtcaaattcacctggtttttaaagatcaaatgcctacttttacagtcacctttcaacctttgttttagactctaggattcgtttgtcacaggtttgcctatttgggccacagcttccttatatagggtacagagcagcattcaaaggtagtgtttaagtatatggacttgggtgctagatcactgtgcactaacacccagctcagacacttactagctgtgtgacctggggtaacttaacagagcctcattgagctttggtttcctcactagtaaaatgaagctgaaaggaggatatatttcatagggttgtagcagttacatgagttaaaatacctgagctatttagagcagtgcctggttcatagcaggtgatctaggagtgttattgttcttcacgttattcacatttaatagcaaatcatactgcaaaaaatggtgtcaatgtaatggtcattacaggcaatctaagttgcttttgctcttgacagtattttacacctttaaagtttccagtaaaaaagataatgctaataccatttataaaacagaagaacaaagaattccttgacaatttaaatatctaaatttattagttaaatcaattaattatttgttgttgctgacttccactaaaatgtgcctaatcgttttatgaatgtcttcctattccagtcagtatttttagcaggtttaattctcaagcattccaattggatgtgctggaatttggctcctattaactcatggttttgtcctagtgattaatttatcctaccagattgaataagtatatatgtatgtacttgtgtgtttgtgtgtgtgtgtgtgtgtgtgtgtgtgtataaaatttacaccagtggcaaaaatagtgatttcattttgccagtttgcaaggcaaaatgatgtttgctattgtatttcttttgctaaaaaaaaaaataaagcacgctcgagtatttttactgtctgcacactatttaacctcatgtcttattgtgtagctgagtcatgatgaatacaacaagcaaacatccttaatgttctgttttgtcagtgctgggctgtgcactatggtggctgcccaggaggaggggggcaggacatgagcactcacatcaaggatcttatatcaatttaggaagatagaactaaaacacccaaaacaacagtgagcaataccaaatggtttcagttcaacccatgatagtgtacaggagtcgaataaacaacaggaatgaaagaggggaagatggcaatagtcagggaatgtttcatggctgaaggggtcacttatccccaattcaggcattcgactaccagcttcatgattctgccatatccacatttctacatcatgatttttgttgtttctgcatcccctatatactattattaattttaaaaattctgtaatagactagttttttaaaaactgaaataaaatgtcttcatttaaagaagaaactttatatcacaactataaatggaaagtcagtaactcttgccataaatgcagcataaacagaacaaccttattagtttctatccagataatgttgccttcgaaaggcactaggctacaggccggtgttatctctgtttataagacaaagcaggtgttaataagtgttagagacttagtaaagccaacatgagactttctgctgtccttccttcttccctaccatctttcttcccttcctttcttctttcaactttcctctttctctctctccctccttcctcctcttcccttcttccttccatcctttagcaaatattcattgagcacctattatgtgacaggtaccattctaggcacagaggatacaacagtgaaaaaacagaaaaaagcccttgcccttatagagcttacattcttgttggatgaaagcagtcaataaacagataacaaaggatacagtaggtcataggtgctatgaataaaaatacagcagggaacgtcaaggtggaagaaaaagcatgaataggaaaggattactgctaaagtaacatatgagcgatgatctgaagggcaggatggaaccagccatccagatacttagaggaagagaattcccagcactgggaacaggtagtgcaaaggctgtgatgcagaacatgcttggcacattcagggaacaccagtgaagtcagagtggagaagtgagtgggtgaggcggacagtggtttgagaagatgtcagatccaggtcacttgaaaggggcggtagacatagatcatgtagaagtttaacagacatagcaagaatttgactttgactctagatggcatgccattggatggctttgagcagagagcaacacgatgtgaactaattactgtttttgtagaataactctgctatgagattagactggatgggcaaaagcaccagtcggaaaactggttaggagggtatttccattaatttaagagaaagatgagagaacagtcatgtgggaagcacaggaagtagtaaacaatattggatttgttgggcaaagtgtatccaccaccccccaaatacacacacacacacacaaatctctatctcagcacttatgtatttatggtttataaatgaggctgtttatgggcaggacacggtacctcacacctgtaatcccagcttttttggaggctgaggtggggggatcacttgaggtcaggagtttgagaccagcctggccaacatggtaaacctcatctctactcataatacaaaaaaattagctgggtgtggtggccagcacctgtagtcccagctacttcgaaggctaaggcaggagaattgcttgaacctgggaggcagaggttatggtgagccaagatcacaccactgcactccagcctgggcaacagagtgagattctatcaaaacaaacaaacaaacaaaagaaacatgagaccatttatggggatggggctgttctccctgccccaaatttgttgtcagtgactggcaatcatgccttattcatctgtaaaccttactgaccacagtgcctgataaaggtgcttaaaaagttggtgcgactgaatttcagatgagtggaataatgaaaggcacagaggaaagaaggctcacagtaggtatttggggcaagaagatctacgtgggaagtgcagaaaggcatgggcattgtggtgaggcacctctcagagaaaccgaggttcacattagaatggatttcacgtgaaagaagtagaactaagagaagtataagaggagaacgatttaagatgataggaaagaggccaagtttcatggaacctttattaaaaaaaaaagaaattccatataggttagatttaggaaatcaggattcggaaagggctaggatttactacataactttcattctgaaatccttacatttcaactatcaattcactgaataatgtcaatattttattttgctgcttttaagagataaaaaagagctgttcataactaatggaatatgtatatgcacacatacacacacacatatacatatatacacatatatacacatatatacacgttgtgtgtgtgtgtctgtatgtgtgtatatatatataatgtatatgaaattcctcaatttcaaagactggaatagaaacgttcctatagatatacaaggatcatttatactcctaggatgaagagacatgcatcatgaaggtttacttgggttaattaggtatatttcaagggtgattaaggaacaataggagatcactaaaaaaaaaaaaaatctctgctgcaaaataaaactaatggaaaactgaggcaggactaggacagcagtagagaatgatgcaccactgagaatgggggaagaggaattaaggcagatagacctggaagaaaggtggctggaggagcagatatcttgtctttacatcagtgcattcctgatgtataagggagacttggcccatcttgcataaagcagtcaggtcagagtaaaaataaaaacagatgtataactgcccagtctcttgctggaaacgtggagaccccaagtcttgtatggaagggagacaaagtcaacagctatttttgcaggtaaaagagaggatttttttgtttcctaatccaggtcatcctcatctcttgcctttacttatagacacagctttctaattggccttgcaggtcaacacttgcccatctgtgcaccattcttctcccagccaattactggcctctaaactatttttgaataaatagcaaatcttatattatctgtttcaacctcatttcctgacactctttccccactttaccccaaattgcataacttcctggttaattctttaaaagttgcctgttctaacactaacttcttcctccctccccaacccatctctacagttaagtttatgtcctcttcttatttgatcctgtagcaccttccacctgtctgttataatatttgatacacttgtaattctagatctgtcaccccagaatgtagaaaagtgtctggtacatggtaaacacttaatatttgttaaccgttgaaggttgaatgtttactattgatgaacatgaagataaaaagatagtagccgacaattattgagaatgaaagggtttttacactaatttacatttcagataaggtacagctttcattgagatttaaaaaaaactcaggtttgaaattattatagaacattgtataatttcccatgttcacaaatttaaaaaatacagtacactttaaacaaaacagagttcacataaagcatatttgataatcagctcagctccttggtgaaaaaaactaaaatttggaatagttaattgaatggctatcatttaaatattttaaatacttgttcttgaactataaataaccacatagaaatatgaggaaaattaaatttaagagggtgtttatttggagaggaattttaaaacaagtcttatgaatcatggtaaatacccttacaggtatactcagggcactggagtgcactttatgctccaacaaacccaagacttagagacagttgctagctgcacacaaacagtgtcactgtccactattttacacaaacggcaattgagtagcaagggaaggtgaattcctcagtcctgagttacttctgggtgtgcctcagatgtttaagctgcacattaactaactcatttaggcccccagagtaactattaatgtaccaaagctacaatttgagaagaccctttatttccaagagagctggaagaatcttcaacaattcataatacttgttcttattaaattgcgaattctgggcaaagaatcttgaggagtaaaattgcctatgccatttcacatgaatgatatacagaatgtgactctgaaatgtctgccattttcagagcattacacatggagagcttcctcaattttcagaggacctctactgctacagggaaaatttcggttcacttgagttagaattatccttaaaagggatagaaaaattcaggaatgcaacaacattgacttaccaagactcacaagttgtatacaccatttagaaaaagtttttagccttgaaaaggaacatcttgtattattgttaatatgaatatttatgaagcactatcagtaggcttaactcagtccctgctcaattagcttataatttaattagtcctaaatgcaaatcctctaaattggggtggttggcttttgaaatgaatgccaactaatatcattattgatggctcactatcttctgcttctctctctcatttctcttttcttcttaccttatacatacattttgctctcaaacacccacccttcctcaactgaaaggatgtaaatgaaggtacacctgcaaaagcagaagccctgtggtccacattgaactttaaaatccttattagcattttgtatctgaaaattatagggatgttttgtgaatttttatagatctaacacaattgtcaaatatcagctttgaaccatgaaaacatttctaagatattacgcaaactaaactctaaattgagttttctatttctatttgaatttcacatatctaaatttcctatgttgtttctgagagagctccatatctgtgctggagttggttcactgcacaacatttcttacaggtttagatagcacaccttgttttgtgctacattctctcttgggagacctcagttgtattacaatcatagatggttgcttactaatacagaaagtagaaaaaaaagctgcccctttgaaaactatttaataactttaataagctgctttgtaaataagtaaataaaaagatacacttccttttgtcaaagcaaactctttgatatggtctggttctgtgtcctcaaccaaatctcaacttgaattgtaatgcaaattgtaatccccacgttttgggggaaagtcctcatgggaggtgattagatcatggaacagattcccccatgctgttctaataatagtgagtgacttctctggagctctaatggttttataaggggctttttcccctccactctgcacttctctctcctgctgccatgtgaagaagaacatgtttgcttccccttccaccatgtttgtaagtttcctgaagcctccccagtcatgtggaactgtaagtcaattaaacccgtttcctttacaaattacccagtctcaggcagttctttatagcagtgtgagaacagattagtacagtcagttggtactgagagtagtgtggcactactgcagatacctgaaaatgtggaagcgactttggaactgggtaacaggcagaggttggaacagtttggaggcctcagaagaagacaggaaaatgtgggaaaatgtgcaacttcctagagacttggagggctcagaagacagaaagatgtgggaaagtttgggacgtctgagaaacttgttgaatggctttgaccaaaatgcttatagtgatacgaacaatgacgtccaggctgagttggtctgagatggagatgaggaacttgttagaaactggagtaaaggtcactcttgctatgctttagcaaagaggctggtggcattttgtccctgccgtagagatctgtggaactgtgaattagagagatgatttagagtatctggtggaagaaaattcaaaaggaagcacaccataaaagtttgagaaatttgcagcctgatgatgtaatagcaaagaaaaacccattttctgggggaaaattccagccagctgcagaaatttgcataagtaatgagatgccaaatgttaatcaccaagacaatgaggaaaatgtctctagagcctgttagacgacttcacagcagcccctcctattacaggcctggaggcctaggaggaaagactttattttgtggggtgggcctagggtccccctgctctgtgcaaccctgcatcccagctgcttcagtcccaaccatggctaaaaggggccaacatacagctcaggccattgcttcagaaggtccaagcctcaaggcttagcagcttacacgtggtgttgggcctgcaggtgcacagaagtcaagaactgaggtttgggaacctccacctagatttcagaggatgtatggaaatgcctggatgtccaggcaagagcctgctgcagggacggggccctcgtggagaacctctgctggggcagtgcagtaggaaaatgtggggtgcaagctcccacacagaattcccactggggcactgcatagtggagctgtgagaagagggcaaccatcctccagaccccagaatggtagctccaccaacagcttgcactgcgcacctggaaaagctgcagacactcaatgccagcccatgaaagcagccaggaggggactgtaccctgaaaaaccacaggggtggagctgccaaagtggtggggacccaactcttgcaacagcatgaactggatgtaagacatggagtcaaaggagatcattttggaactttaatgtttaatgactgccctattggattttggacttgcatggggcctgttgcccctttgttctggacaatttctcccatttggaatgagtgtatttacccaatacctgtgcctccactgtatctaggaagtaattaacttgcttttgcttttacaggctcatagacagaagggacttgccttgtctcagtcgagactttggacttggactattgagttaacgctgaaatgagtcaagactttgggagactcttgggaaggcataattgtgttttgaaatgtgagaaagatgagattttggagggcaaaaggtggaatgatatggtctggctctgtgtcctcacccaaatctcgaattgtaatccaaattgtaatccccatgttttgggggagggaacctcatgggaggtgattagatcatgggagcagatccccctgctgttctcatgatagtgagtgacttctcaggagatctgatagttctataaggggctttttccccctttcctctgcacttccctcccctgccgccatgtgaataagaacgtgtttgtttcccattccaccatgattttaagtttcctgaagcctttccagtcatgcagaactgtgagtcaatgaaacctgtttcctttataaattaccatatctcaagtagttctttatagcagcatgaaaatggactaatacacccctgcagtgataaacattttcatcttttgagaataatcaaaaatagatgtgcagcaaaaatgtcataccattgcttcctgtgccctgtgatgcacaatggagcaatgcagcactcctcactagataaacattctgaaataacagtacagggcaagcagtcctaggaaggcagaccacagagcttagaaaaagtacacgctgcagtttgaagtgcaaaccacaatgaggcaatgaggagcttatgtccactctcaatataaaacatatctctgttaagtcctcaaatgcctatggttctctgcagtcacccattaatgacaactaagggaccatgaagggggagacatggactggcattgtctgctgcaccattcctggtggtttgattaaaaaacactgaaactggagaggatatgtttagaaaataattgtatgcttgcttcaattcagcttttctctccacttttaaaatcaggtaaagccaaactcatatatattcttattatctacaacaattactgtttcaggaggttgacatgtcttgttacctaaaaccactgaaaatttgaatgttgatcaacatttaaaatagcaagaggaatcttttcccattgcttaattttatttttttgagacagggtcttgttctatctccctggctagaatgcagtggcgtgatctcggctcacagcaacctctgcctctcaggctcaagcaatcctcccacctcagccaccctagtagctaggactacatgtgcatgccaccatgcttggctattttttttgtattttttgtacatatggtgttttgccatattgcccaggctggtctcaaactcctgggctcaagcaatccaccagccttggcctcccaaagtgctgggattacaggcatgagccaccaggcctggccaattttatttcttacttgactttttttgttggtgtagccattctcctattgatagacactgttcattttaatttttgactattacaaagaatgtttttgggaaattttaaaatttttttcttctcatgccaaaataaaagcttataacagaaaatataggcaaaacgtgaatatgtaaaagtttctgcaatcctacttaccctgaaataaccactgaatggcatggtggttgttatggtgtgtgtgtgcatgcaagtgtgtttacaacatttatctttttctgagtataagcttatatgtaaattttaaatttacatatatgaataagcaaatgcataaatttgtaaaaattgaatggtactaaacatactttttataagatccttttttaaccctgtaaggctattaaaatattcaaaacactatcctttttctagtactatgttcacaaagtattcattttaaaatatcactatagaacagtatattacagcaggcaaagaagttcagttgaaagttatactcctaatatttgagagagataagaatggatgaagtttgatgtacttaatcctattgcaataaagtgaactttcaaatatttcaagccttcactgcaaagtaaaataagacctattcttatttcttcaaaaattttatatattataagtaggtaaggtatctccagctgaaagaaataattttatggccagctttccaaaccttccaaattgtatatcactttcttctcttttaattctgctgtctcagatatttaattaataagagctgctgtagcaaggggcttgtccataattttattgtcaacatttctgagtcatctacttctgatttgttttaaaatcaaatgcaagatatttggctaacatacaatcaccatgagctaggaatataacaaataaaccaatgacagccttctctgatgcacccttactttcatctgaaccattgtgctaagaaaaattagttttttattccttaaaagtcttaagtatccttctgttatatctgaaacctcaactcctcaactccttttttgttagttgaccatcagccatcaaccaccatccagttaaagtcaatgatgtgaactgcacgcttaaaggtaagcaaaattcttttaagttctgctttgaaaagagggaacaaaacccttggtgacaggagtttgtaatctaataggggcactgtgattaagtgacatagtgcatacatgtgtgccaggaaacaaatctatactgagtacaatcagaaacagagatcctatcagacatatgataaagcttgcttaaggaagcttgagggaggagtgacaatctttattatggaaaagggtgtagtttgggaaaatactattacatcaagctgggaaggacagctaagagaatggatgacagaatcaggatataaaaagagcataaggtcaaaatataaccagatggagttaaatagggtcacatttgaagtcctgccctttggttaaaacaaaaacatctaactgagcagctgccaagagagaaggagatggtgcctaagtcaagcccttttagttaagtgcaggatgtcacaacgatacgatgtggcagccagtgtctatctaatctaaagtcactttcattgataaataaccccaggatgaggcaaagaaaaaaaaaagtctctatgatgttctgagctaattggattactttaggaatttctggaatttgctaatctttgggccattaaattacaaaaggaggttatgagataggagctagtctaatggggagtcactagaaaaggaaagagatgtgatggtataatggtagccaagttaaggaatagaaaacatagggaacagacctgatggttacagatacaaaagtgtcacatgaaaatggaatttcaggcagttgtgtgctgggtcaccaaaatgtcattcccaaagtttactccatcgcacctggccactctgcccttgaccctcgactcagccaaatatgacatatctctggaaggctggcagatgcaagctgaacggttggccataagagcccagctgaaacaagagtacctgcttcagtacaacaaccaactctaaccaccaagggctcatcgaagatcttgccttaattcgttggacctatgcaagatcagcaaatgtctattctaatttcagactcactcctaaaactcactcttgggagctctgtgtggaattgggcccctcttcttctggtattatgttttcaaaactgacagggataggaaagaaaaacttatccaggaaggaaaattggatggaacatttaacatctcatattaagtctggcaatgatgactataaggatcttgcttaaataaattgtctattaatcattaaaaaaagaaagaaaggaagaaaatggaatttcacttgccctgtgtgtttccaagattcacaggtaggagcaatgctacttagaagtttcacggaggccaaagttcagtgaaagcaagaccaagccaatgacacagagccagccaatgacacatcaacactgacaaggagaaggatgtgcagcaataggggcacaagcattgacctttgaagagtcacatcatagctgtgttagcactgaaccacagggcactggtgtcttttttcatcctgaaaattctgattcaacaaaaaagtttgtttccttcccaatttaccttcctttgaactaattaaacttctatcctcttcatccctcaactattaaatatttaaaaatatgttgaccaatttaaggttttgaaataaaaacattatatgaccaaaaggtttgataaattctcaaaagcataacactgtctacttctctgtaggtatctcgtgagcaccagatactaagctcccttgatgaaaatagcttttcaaaatatgatagatatgctagtgcactgtattcggaaaaatgtgagttcatatggacctgtcaggatgtaaaaaacatgcaatacttggtgtgtttcctaaggagggccccgggtaaggccccagtgctgtgcttctcacattgaaaacacatatgaatcacctgggatcttactgcaatgcagatggttacccactaggtcagggtggggtccaagaatttctaccaagtccaggtgatattcatactgctggttcatggatcacattttgagtagcaaggtaaggcgtatttcccatgaagcaccattgcagaatgtttattactaggccaatattcacctaggcatttctttgctttatatattaacacttctattgacacagatcataaaatttctgttttcctttctttgaaaattaaaatatatggtatactaaaacttaaaaaaaaatcagacagttttttcccccaggtacttaagaggatacaaacccatgaaacttggcctcaattagattacagtggtccctcaggatctttggggattggttccaggtcttcaggcagataccaaaatccatggatgctcaagttccttatataaaatgacatagtatttgtatataacctacacacatcaatatactttaaagcatctccagattacttatacctaatacaatgtaaatgttatgtcaatagttattatgctgtactgtttagggaatgacaagaaaagtctgtacatgttcagtatatacacaaccatattattaaaaaaaaaaattggattgaatacacagatgtggaacccatggatacgaaaggcctactgtacttggaagtatcaataggaaatttcatcaaaattgatggtgaatttcacatagaattaactctcattttgtttttatttatttagcatatgtaagccggtctctaataacaaaataattacaatgactatttttctccagctctaaatttattatagcaacaactcaggatcaaatataatttgagatccctttgaaggggtataagctgttggttgataatgatgttgagtagatggtccaaaaagactcagtctgaacatcctcaattgtttgccttagaccaaattctaagtgattgtaagaattcatcttctttgaatacggtgtattgaatttcttaatgaactctccagcaaacatgaaaaagtaaatgatgttatttgggcaagactgtttgcttatagaaaaataagaatgtcatctgtggagttttgaaacttcatcctaaatcatcacacatggttcccaggtgaagcttgtacatatattctgaagtagaaactgctcttttaatggtgatattcagaatctagtcaggctgatcattgtcctagtctcagcttttagcctcctgtttccttcatctgaaatgttcttgcccttcatctcctttgagtctatgcaaatgttaacctggagggctaccctattcaaaattgcatccctactgataacttcctatgtcattccctgacttttttccttagcacttatcactatccaacatatattttttacttatttttcttgaatattgtctatcttttctgtagttttctgctgctggtgtaacaaattatcagaaacttagtgatttaacaattaaaatgtatcattttatagttctgtaggtcagaagtccaacacaggcctcaatgggctaaaatcaaggtgtcttcagggttgcattcctttctgagtgggctaagggagaatctgcttccttgccctttctagctgtccacattccttggctccaggcccccttctttcatttccaaagccaacaaagttgcatctgtctgaccctttttctgttatcacatctctctctaacctaaccagggaaaagtctttgcttagaaggacttgtgtgattagattgggcccactgggctaatacggacactacatctcaaggtctgtgcccctaatcaaatctgcaaaatctttttttgcatgtgaggtaatgttcatttagtccagggattaggcagtggagctctttgcaggggctattattttgcctatattcattggaatgtaagctccaaaaggtcacagatttttatttgtttgattcactgttatattcctagcacttacagcagcacctggtatatagtataaactcaaaaaatatttatttcagaaaattaatgaaagaaaattggattgggctaatgatgtcatgacaaacacatatttgaagtgcaggcgctagacatagacccttactagatttttttgttttgatttttgagatggaatatcactctcacccaggctagagtgccgtggcgttatctcagcacactgtaacctctgcctcctgggttcaagccattctcctgcctcagcctcctgagtagctgggattacaggcacctgccaccaccatgcccagctaatttctgtatttttagtagagatgggttttcaccatgttggccaggctggtcttgaactcctgacctcaggggatctgcctgcctcagcctcccaaagtgttgagattacagatgtgagccaatgcatctggctagcctctactagatgtttgaagagttaatcacttgaattaaataaaccttagtcctcatttgaaaaatgagaccatcactttgcccacttcatagagtggtttagagaatcagtcaatgtgatctgcactgaagtggtctgaaaattcttagctaaagaaatgtaaattattgatactatactttttaagtcggtcttagtatccttacctaaaaatttaagtttctttgagctcaaaatatcagccattttggtcacagttcactcctcagactttcagaaaccccattcaagatgctgaaaaagatatatgggaaaatcttaaagcatggcagtagccttctttggtttcttttttgccaaacataccattcctcagggtcattgccctagactgagtgtagcatgattggaccatctgagaagatggtgggataacagaaagttatttggagtcttcagacctcagtctagtccaggctctttttgactgggcatttccattagtatctccaagccaccctgctgcctagagtttatcattctcagctacatgttattaaaacatgttagcaagtactgcagtggtgcagaagaaaggccctaagagccttattgtttttatttccttaaggtaggactagaacataatttaactaacacactgtcttcatataacttaagtttataaccagtatcatagaaaagataacatgcccacaaatacttgtagaattattttgctgatctttcaaaaaatggcacttagaacttttatcatctatttttagaatatttgtacaaggaaatgggcctctccaattttattgaaaacatttgtcaattttattaaattttttaaaactcagaatttgcttggaactcatatgcttatatttactagaagactaaaaatctaaaggtttaagatagaattttctattgccttagcaaatctgtaatgcccaaattagaaaacagttatttttctccaggattgatgtaattaaaacactaaagggtgggggggtcaaacaacaacaaaacagtcttaatatagatgtggtttgtttctctgggcctgtgactacatatggatatttggaaacattacagtgtttggcgacaacaaagctattcattgttagtcaacagatatgcacactgtggtgaaaactcaaccaataaaattgttaatttaatgcagtgattctcaaagtgtggtctccagactagcagcattagtgtcacttggggtcttattagaagcaaaaaattggaggctgtaccacagatctacagaattagaaattttggggaaggggcctggtaatgtgtggcttattggcccttccaggtgattctgatgatcattagtggatgcccttttactttcttaccttaaaatatcttataatcttgtttgatagtgtatatgaaaaagcacaattgctttttaaaaggtgaaaatctgagtcagcaattaaggctaagtcatatctaaaaatcatgtgggcagagtattttgaaaactagatatttgaatcagctgaaaaagcctctgctgcaacccaaacctaaaacctcccctaaaacccaaacctaaaagtattatttattcaataacttacataaattatccatgtaaaataaacattgtatatattaagaaatgcttttcacatgttaattgaaatctagcttattttcttggaattttctcttgcattttagacatattttccagagattgattttcttgctctaaaattttattggcaacccaaaaaaagcaaaatcaaacagacaagccaacaatattctcatataatcaaccagattttttaaatccagagtcttaaaaatatgggtattttcccctgcgagttaaataagcacaaaacaaacatattgtatggtctatagttttattttagtaactggaaacactattttgcctgcattccaattgttataataaaggtgaagcaaaagtcctgagacagcctcaaggatctggtggctaattctttcaacagaaccaagggcagggtccgagatgacaaggtctgtttcagctgggtctcaggtgagtgtccagggtatacagaatggggttgaagactctttccacaagagcagcagaatagtatgcacatgaaagtaccccattaccaagaggccttgtgggatgaacctgtgtgcaatggagttacaccatccaggacttcctgagtagaggattttgggttattggtaggcaatggagagccaatgagatttcaggttgtggatttacatatcacagtctctttttaggaagatgaactccagccaaagtgtaagctctaaactgaatcttacagagcctgttgtcaggaaattctggcaatttctagcttgacaaaaggccaggccaaagcagtagtggtggtgatggaggccagaatgtgagaaacctttgggccaggtttgaatgtgatggctgaaggaaaaaataggaaacaaggtaaaatcttgggcttcttgttaagtatttattaatattgggtatgatgcttattctgcattacttatccatgcaaactattgaggacaacaagataattttgtgcttagattggtgtgtgtgtgtgtgtggggggggggtcctctatcatgtatctagctgattcaaatcatttttttctaaatgataggaacaggtgaaaagtgatatccctgggagtccgagcaagtagggatgcatttcttaaccagcagttctttaagtggaagtctgtgaacctctaaagcagcggagtcatgaaagacatttagaaaaatacagtcacctgggtcctgtccccagaaagtctgatgtcatttttctgggtgtctggcccaggcatcagattttttaaagttccccaggtgattgaaagtggataagaactaatgcttgaaaatataagtgaaggcttttttcaattagataatataactttaatttcattctgttgatttgcctaataatctgttgtgatgctaatgaaaccaaagtgttacatatttacctcctagggatgatgcaaaaacaaaaagataatatgtgataaagtacatcaagctgatacctatttgggccctgttgtcaacaatagtgtttcaactttttcctacagggaataaatacttacataaatcactgggaaaatacagcaaagtagcataatttctttgcttttacctttaacacgtgggctataaaattgtctataaaacactatctgccacaacttataataaatacatcctttttattgacataagatgggtaaatatagtttttaaaaggcatcagaggagctataaaggcaaactggatgtcaacacccattttgagggggttaatttttcttccaggaagtttataaatggcaggtcctggaaatcctaaaatcgctagatggactttgccttgcacatacttgacattcaataaaaattctggaaatgcctgaaaaagatcagcacatgtgttgtcttaatatagcacagtaacattacattgtttgggatgggttgtgctgaaaaagttgatctcttccaagacttaaagaatagtgtctgaaatttagcaacaggaaatctgggcagatgtgtaatgaaagtgctgtgaaatgattagaatatctaaaacaaagaataaaaataccatggatttggtaatattggatacacgaaaatggaatatatcaaatacacatgaagttctatctggaaaatttaaaaaattagcttttgggccaggcatggtggctcacgcctgtaatcccagcactttgggaggccgagatgggtgaatcacaaggtcaggagattgagaccatcctggctaacacgatgaaaccctgtctctactaaaaatacaaaaaattagccaggcgtggtggcaggcacctgtagtcccagctactcgggaggctgaggcaagagaatggcgtgaacccgggaggcggagcttgcagtgagccgagatcatgccactgcactccagcctgggcaacagagcaagactcagcctcaaaaaaaaaaaaaaaaaaaaaaaaaaaaaaaattaccttttggctacttttaaagattttccacatgaatgttggaactacccaactttcaatgaagaagtcttagctctatgcatttgcaatatttaacttctcccactttttccaaatctcttagatttcagctgttatgacacatttctaagacctttattcagacccttacaggcttttgaaaagactcttttttctttaatatgagatgtattgtgtacctattacactgaatggcactatagaaaaatatggctaatctgtatttctgtactctttgtgaatgacctaaatacaatgtttaccaccacaaatttggtacaacctacatgaaataagacttcagttttaaatataatactgttccacatagtatgacaaatatatacttggtatatgaaccatttggtatgctacaatacgacccacccccaatttaaacaggcttatctgaagtttacagaagatttaatatagtttactagatgattaaatataggtatggttgtgcgtgtatgtgcatgcacacatattttgctgagtggttaatataaaagctatgatagaatgtgaggataaacactgtattagctaagtactgtagagtaaaagaattcagaggacctggactaggataaagagcacaggaaaagaagatgagatttccataaaacaagctttgacagctttgaccaactcttaactgtctgcctgtagtctacattatgtatgagcagaaagtttgtatttcacatagaagctttccagttattaattaggaaaatgtttacatatggtatgtcacatgagtaggtttatctccttagccgaccaaagtaatgcagatattaaaaagaatatgttgtcagaaataaattattcatgcttcctaacttttctaatttggtaatttgaaaacattaataggatttggtcattcttaattgtgttgatgactatccttgctctctttattctcaaggctagttgaaatttatctcatttatattaatttttctgtctgtggcttctcaaaagtaaaataacttcagaagcttcataagtatggagaaaatgttaggtgaaactttgcagaatcatttataatttatatgagatttttctttagtttttgagaactatcacttgaatatgtaatcatcaaacaggtggccttccacttatttgatatgatagaagaaaacttctaacattccaatttaaatattttatttgaaaattcactgctataataacactataacattaaggagagctgtgttgtaaacatagtccttctttttaaaaatgggaactcttattttatcctgtagctgttatattcatctactcatttttagtgttgctttcaccaaacaacatgtctacagtaaatatatttccattttatgattacagggaagtgattcctaatgaaaatgagaacagagtgctcaaattggggttagaccatccctgttgtgtcatagtttccactgttgaagtaaaatcccaactgaaaaataataggtcttgttagttggcaggcaggtttcactgagtaaactaagttgctttctaggattttgtgcagaaaaattctgcaatgctaaaattctgcaacgctaaaattcacataacacttaaaactgacatcgagagtagtggcccaatcactatgggagtaatcaacaactgtaaaagttttttggctttagcctctgctgtgaaaaagcatgagaagtatttatgagaataaagaggcctaagggattgcattttccacagtttattggacatctctacttggacaaccacagacttctcagaccctactagcccaaatggaacacataatttcaccctcaaactcactcctcttgctggaccccaaactcagtgaatggcctactgttcttctagttgtcccaagtgtcttcctgttcctcgctgtcacacatattgaatgccagttcccgttcaatctatttcctaagtagctatttcctaaatctctttacttttcattctccccttgctgctggtccaagccatgagtaccggtctgaattattgcagcaatgtcccagctggtctcctttccttcagcactgtccttccccaatacactctctacagcacagccaaatactacaacctcaaagactttcccttttgttggaatgaagtccggaattcttaacatggatagcaaggcctgttattttctcttccttgtattattctcagcttcatctcccatcattctccagagcatgtgcaactgtcctctctgcaccctaaactccaccatatgcacattcagtaatgtggtaatgtcaagaactctccactttccaactttgcatatgctcttgtctctgcctgccctgtccatcatcttgctaatttctattcacactgtaggctttagtgcctcttccatgaaccattcatgaactccacatcacccagtcctaaaatcaaggatgactgcttgcataacatcctatattctgcctcatcctggaagtgattatacttcattgtaattgatgtttactcatctagctttaccactggacctctggcttcacaagaatcacatatgtgagtatcttgctcactgtacaaccttagcccattatagtgataagcccatggtaggtgctccacaaatatttgttaagtgaattaatctgaatgcagatatgtacaaagaccacagagttcagatttttgtctatgcccttagctatcatgtcaaagaactggagggtagtgcataataactagctgtcttattacaacgtacctccctgcaatacagtttcacccaccctaccccccaaaaaattctaatcactagccagatttaaatctatttgactctacttctttcagtgttggtaagagctatagcagccattacttaagaagagagttaaattactaatatctgtctacccatttctctgagaaaatgaaattacttctctacataattaaaacaccatttctttgaacttgatgaagaagccaattttcttttgtgttcctgcctcaaaaaagaatatatgtctagagagaatattagagaagttattccataagatataactttctgctagaataaacttcattattcctacaaaattatggaagtagctggctatacttctctgcttacctcttaatttttcaaaaataacaaaaataacaaaactaaataaaagtctaccccatattttctaaaatagaattctgctaaaacacacacacacagacacatacatacacaaacacacacacacgaactatgaatttctataccattcttcaaaattctaaatattgtcaaagtcattttaagagaaacagaactagtttagttagtgtacatctgtcctatggtattctttgcaccagtggatctcagactctagcatacatcagagtgtcctggaggtctttgtaaaatgcaggttgctggactgctcccttccacctagagtttctgattcattaggcctgagatggaaccagataatttgcatctccagcaagttcctaggtgatattgatgctaacctggggaacacgctttgagatgtgacttatacgtgtaactaacagtagggaagcacatttagttctgtccatgcagttctatcaggcattttgacatgtgctgtcctcttgctctctttctttcattttttttggtaccaatatctaactcagcattactgcctaaatacataaagcctgtattccatgctgaaacttaacagcacaagtgtacatcatttaaaaaaacgaaaacaaaaaaaaccaaaaaacagaaaaaaagagggctatttctgcaagttaaaaaattaaatggaaaaacaaccccaaaattgctctaaggaggttttgccttcaatagcaaaacatgttttgcctcaattgtgatttctttgttcgggagccaaggtggcaattaagctggcacaaggagcaggagccatttatttaatatgatgacagcgtagccctttgtaaatcctggaacaatgagggcccacacacaggctcattccaagttctagttccttctcttccctgttgctcagtgtgaattctcatagccacaaaggaaggggaagattttcaatcctgtcacatcctcccccatttaaaccatttatagtcttaacttataagatatgagtaagaaatcttctttaaacattttgcagagctgatcatcaaatctaacaaactggtggttttgaaatctcctttgctccaaagacattccattaacctctgtgtcctctgttgtgtcattgtgctgagaagagcaagttaaaaatccagtcttaattggggcttggtggtaggattatttttatcttatagatttatttcaatattcattttaggaagaaagaagaccttaggaaggtctaattctcatcagttctggcataagctgagttagggatctcagaatttaaagaaacgacgcccttaataatggcatctgaagaagcaagtgtaccatgctgtgacaattacaagatactacatcagttcccatcctctactaggctcttttaggatggagactctgtctggttcactgctttatctctataatttacaatagtactcagaaaatagaaggcgctcagtatgtagcaattattgcctgactggctgtctctgtaagcattacagggaatgtacaaccaaaatgtataaagtgtaacatgacaccaaagttcataaattaaatgttatcaaaatagattgtttttataaatgaagaaaattaatcagaagatatctttttagaatataacaacctctaacacccagtctacaaatatacccatcatcaaacttctggcaaatgttcaaagtaaataaacacctatcatgacttaaatacctggctttatacttcaacagtgttcatatgagtaaaaacatttttgcttaagttgtctaccagtttataatatgggaaggaattccccatgggatactatctcctccccctttatatagggaatacaagtttggctaaatactttatcataattgtgcagaaagcacatggccttataaaagggcaatcacatatattatcaatgggattgatactattatcaatggtttcctaaaagcagcctctccattttgcaagtctatcaacttatagttctttaccttcccttcagctgaatctactcacttcaggctcagcctgagttcctgaaagaatcctgccagggtgggacccattataaggattttaattgcatctaggtcatgacactcagatctggatctaggggtgactgctggcttctgcatgatctactcttcttctcaggctgcccattccctgagatctacttcatggacactagatcctgtgcctgatgttcaaattaggatggcctcataccacaatgttttgttgccccttctagctttggatctcctgtaaccccaaatagcctaatctatgccgggccctcttatgcccttttgatactatttctcaaatgactcacaagaccagcctctaaggtcaagctagttctcccaggtctcttctagtatcctagtgctatttttttctctgccaagttctgatttcttttccagtccctgttgctaaaatcctactgaatccctcacagccacccaaatcctggcaaggtatgattttaccatcttaagttcattttcagggctgagcgtataataatgactggtcatgcagcacccagtgatcacactgtacagagagtacagacattgggatggaggaagggcaaaaagaggcccttgatactgaaacatattttcagagagtaatataattggtgaattctcatatgctgtgaggatcaaattgatgaaccattttagcactcccacaagaattctgctccctcatttctgcacagaatttcatcttatgaaaaagttccacaattgttaacatactatagcatctcttcatgccaagtagttttgtattttaagaattacaaaatgcactcatcaaataattttggcacataatatatatttctaaattccagaacaaatctctctcttgaaattctatttaaaatacaacctgggcttgtacaccatccagtatgatagaaaaacatataatcaattcatagaagaccaacacctgccctacaggtgctagaatttgacatcttgttgaaattagattgaaatttagtatacagtatgtaagaaaaaaggcagactacaatatttcctgctagtggacatcattcaggcctcagagatgaaatgtgcaaaactcttctagaaatactaatcaactgaaacaagccgcctccaaaacagtaatgtggtcagtctgcatgctgccaggtaatttacaatccatgacaagcagagccaagtgaaagttatttacatttattctactggtagaatagaagagatgagagtgaaaaggatctgctgaatcagatcatgtttgactgaggagtgacagggaagttttcttcaattaatagccagctgcataatttgagctaatgccagctggactttcatcatgaaacgacacagaaataaattattctgtactcaggtgctggcatagtgaagtgaattaatccacttaaatctggaggagggagagagaaagtagattacactatctgaattttttgagcctgttttagccacactttaaggatactgaggttcatgataattattaaaatgtccaagtggatccatttagactcaaatacttgcttgaatgaacaaattcttagaagggaggaaccagagtagaaatggctttatcaaggtcatggtggtttctttcaccaattagtgaaattcatattcaactcagaaggtcagggggaagtgggcaaaaagagtcttattaagaacaactttataggggaattcttgagggggtaaaaaggtgactacaaagatataaaggaatccaggacaggtttagagaggtcaactgcctgctggttcattcagaaaagattaacagacccagctgctgggacttttctggctaggcatccttcccagtggtcacaagtcaatgtgtctcctggctgcttggctatgttcccatccgtctggatggaagagcgcccacccctacacgccagaacttttccttaggggaaagttactgaggttccacgtcaggcaaactttgctcacccatcacttcaagtaaacaactcttctatggagatttcttagagaaaaaatgcacttgaaagcatctaaccaaagcaatgaaggtggaaaaaacaagttatgtgggaatctgagtatagaatatacagacataaaataagctctccaaatgaggaagcagtcacagcttgacctctgaattgtttgctgtttgttccttcaatattcaaactgtagccctggaaatacaaacacaaacttctaaacactcacaggcctgtggcaacaaaatgctacatgccagcttcacaactggggcatgcagaccataaatcctgtagtggcaggaggggaggtgtggaaatagactgtcatcattctgcagcaaggaaaactaggtacaaggaaaaggcaactggcaacacattcctggattctctcattcattgaagaaggaactcagggattgaattacccaattgacgctagttctacccatgccagagggcaaaagttccaagactgccacaggccatggttgcttggaatttaggcagaggtgcttggtccttagagtgtagcagagagaagttctggaaaaggagctcctcatcgagtctggtaatgagcacttctattctgacatggatttcagaggactcaggggacaacgtgcccagaatttaacccttttaatcagtcagcatgagagataaatctaatttagctatatgagactgatgagaaacagtctttgccgtctataacacaaaaggaaaaggacaaaataagaagcccattacttttagttaacattcagagcaacaaataaattcctacaatcacatagcacctggttccatcaatggttggttagtctgggagattctaagctattagctggaagctctctccacagtgagtagtggggagaaggggagaagcgagctgttagctgaattagcaagtgtttttacaaatgtcatatgtagtgtcaatgtgtgtcctaaatgtaacaccctgccaattcatcaatttatagacagaacataggcacaatttctagatatgagattgcatgacagtgtttctcaaggattagtttatttctttcaacacaccctttttgatacgaactgctttattttctagcactcactacatctcactcaaatgtgtggatggcaacagaaaattttgatcattactcagagtactgattttatacattatcatctttaaccttacagtcttctgaggttaaaatccaattacataaaaagcaaaagaacctcagaggtaaagagaccagccaaaatataactatgccctagttttacccctgtatttttattattttgtggggtaacttttatttgccagtcttccttaaaattgtaacttctttgaagatgggaactccatattattcatcttttcatcttcagtgcctagaacagtgcctggaacctggtaggcagtcagaaatgtgagaagtagatgcaggccatgcagccagtcagcaacagtgctgggttttcaatgcagaaatgtctgattccaagaccactcacgtaaaaaaaaaaatgttgcagtttatcagtgatgtttggcaaaagaatggatgttgatattagtttacccagtttcattctaggtagttcacaaccaggagcttctcaagaaatacttgtttacagaattcatgaatccaaattagctctgtttcccaaaaccatagataactggaaactaaaaattggataaaagtcagcttcaacagaagaaaaaagagtttgtattaaatatgaatgagcatttactttgttaaatgatatgtgggcttttcacctagattacaggaaaattactctagcatcaatttttactttgaactttgaagaactttgaagagctatattgagtaaaacccaaagtgctctccgcatgaaaaattctagtttgcccctactgtaaaaattcacaatataaatataatcatgagggtattttctttcatagcatcagtcatttaaaaatacaaatctttgaagaaaaaaaaattgttgacgaagtaaaatagcattaaatcctgtaaaaagattacaggcacaaaacctgaggattttacttgtaaagttttgttgatggagtcaaatactcacttgcattaactctctttccaaaccctgagtccaccccttcgtattccacttgtaataactaatgttaatagcaaaaatatatttatactggaatgaacaataagcatacaacagttgtttggtttaccaaattccctttcattcacagcttaaaatgtaaccaatttagctatgacaatgccagcttagtttatccaatagcacagtaagcactattcctagagctcataattttaggagctcatagaaatgttaaatctcttttaaaatctgaaaaaatgagtacaaaacagtttagattatatttatctttacataaatgcagctacaaaatataattttgtattttttatgaggaggggacccacaaagccaaaagtgcgttgcgctcatcaaaatcatagtgagctagggtatttttaatctttataaaattgctatggcattattcgttgctggaatgccaggagcatgttaatattatgtgccttttatttcttctcacccactaaaaaaatctaatctcacgaaaaatatggaaaagtcttatgaattggattggatatgaacaggatggatatatgacagatgtatacagatatatgatgggtatgaataggatgaatggatataaatcacaaatccaatttaactgggcaatgaaagaaaaaaaattcctaagaaagccttcctttcccctatctcacatcttttacctagaaagcaacaatttagaaatgattacaacttcagagaactgaaggaaaagacgaactaccagaatattgtggcttcataaaaacaccaatttagaaatgcttacccacaaagcttctttttccccttaacactggatttgctaattgaattgagcaaatcctgaatccagctggatatctcagtatgtagtaacaccaaattactgagttagtactgaattaataatctgaactgggtgagtatactcactaactttactcagttactaaaaggctagtatcaaagctaacgtcagaaatgcccttctcatacagtacagcataaccaacaacagtagttcttgtgggcattatgctttcatgccaaccaagccacaccttgattttctgactgtgttgcctatgagttggttctatgttcatccattaataggatgttgacttattaataaatatattatctaattcttcctctacctctaactattctgtggaatagataaaataaggagtaaaaatactttcaattttgaagtatttgttaagtatcttggcatagaaaaaggcaagaagtaacatttgaaataaatttgtaacattatctgtgaattttatttatctatgaacttctatcagttttttataggaaaaaaaggggcagtatatacataattcaaataccaatagttggaacagaaatttttaggatttctagcacattctaagtctcttttgaaaaattataaaatcaaattagaatttaacaccttgcctatatgaatgtcataataatatagaattatatgaattatataagaaggaaataagtaatgacaacctcaagtaaacgttcacttttttcacagccaaattttgacttttttgacagttttatctcagataagaattcctttttcctttcaaaatatcattttcacaattatgctgtgaaatatgtggtcatctgatattataggaaagcagaactttaaaagacttagaactacattcctccctgttgtaatgagatactcttcacatatgaccattttttctggttacagtgtatctctgaatacttgtcatgcatcttctcctcttattctgataaagaattctgattttcctttgattaatccccctcctactgatggaactgacctccacaaccgggacacacagaggcctggtcagtcagtcacaattgactcaaggttgacctgtaatccaagtgcacacgtttcaagtcagccctgggttttccttggaactactgggagatgtatgctctcatgtcacaagaattactacaggcagccttgtgctgtctgagctttctttgctaccacatagagaaagtcttagaaacacagtgagacagaaggagagaaagagaaagacagagacaaacgctcaatcaaatcatgagagggcctgcagcaatcctcacaaccattaaaactagctgtatcctttgaatttttgagtttcaagatcctgcaaactgctattttgtttaagtcggcttaaattcagtttctattatttgcaactaaaggagaaaactctaatactgtatttcaccacatgaatattttcaatgttaaggaatataaaagaaatcttgatatgatgcaagttcactcttgcttacttactctttgctatctttatatttgattgacaacaagggactccaactgttgcttgttgctccactggggaaaatttatttattcattcattccttcgctcattcattcaacaaatgcttatttcacacccattaggtaccaggcacccacctaggttctaaagattcataactcaacagaatagacaaatgttctaccttcataaagcttacgatctggtgggatggagtcaacccttaattaataaataaataaaaatctaagtgtgctgaatagctacatgtgctacagagaaaaataatgcaggaatgaggatacagaaagtctgcacttgaggataggttttgattagttgtttttaaaaacagatggtcatgaaaggtcttattaagaaagtgatatttgagcaaaggcctgaaaaaaaatggagttccttactggggaaagtatgggtcctacaacagagaatagtaagtctcagctctgcagggtgcatggcaaattttccttacaggagttcacctagttacacaagagagaaactcccatgacaccccactagaacttttttctgctagctctctgagggaactgggcatatttgttctgtttcactgggcaaacagaaataggagttaggggtggctgtaggttccacgaatcattattattttcaatgttcactctctggcgtaaaggctgtgaggtgaattgctgactaattttataaagcacctggagctcctcagggcaaaggcactatgtcaacaccaacattaaataaatagcaataattggccaagtcctctggtggtataaggcaaataaaatatgttccctcttggaagttcatgacgtctgccaggttaagcaagaatgaggcaaagcacttttagaaagctactttttctaccattgtatatggcctccaaacagccagccactgtgaaatgttaagtgttcaacagcaaattaaaactgagtgtgtttttcattcactatcacaacaaggtactaaataaccacttgagatatttgttgtacgttatcattttccaggcagttttactgttagctagaaataagagtagagtgacattcgtttgattagagcagaaccattttccaccaatttttagagcacatgcaaatctctttagcaaaaggactttttcaagggttgaatctcttatagtttctcaatgtgaatgttaattaaagaaacctaccaaaaccaagaatgatttcaaatggttatagggtttcaaatggtagatgaaacatgaaaatatatataacctattaacaagatatatttgtgtctctaagaattctataggggaatatacatttcagtgaaactctgtacccacccaacccactccacagcaaaacaggcatttgtgagaaagcgctatatatatacacacaaacacacacatgtacacatgcacaatttataaataaacatcaggatgttaaatttaactaattttaactaaaacaagggatagctcaggataaacttggttttactctactaactccaaagttcaataaataataacaattttctcaaggttattaaccatcaatactcatagaattatgaaatatttttgctaaaagcatttagaactaatctagtatgattcctttatttcacagatgaagaaacgaagtgtcacagaggtctctttgctaggggtaatctatgtgctgaaaaccacctataacactttgaaccatacctgttgttggtattttgtgatgtccgtctacatgttttccttgaatgactatatattttttattataaaaatgggctctcattttatgtattttttattttttcatttaacataatgaaaatctaccatgttaaaaattatccttatgcatcagtatcctatcatacacatttaccttgataacatatcaaggtatattgtgctaattcccgctgctgaatatttggctcattttttttcttggcacattttcagttttccactataataaacattgatgtaactaaatcttttcacatattcttaatttttttcttaggataaattcttcaaagtaaaattgttggttcatagtgtgacttgaattctcttctagaaagctactcaaactttcactttcattgctaatgaataagaatgtcctgactttagtcaatacgctgaatttgttatcatctagttttgactttgttttttaatcttgaatactctttagagaaaatgttagttcactattgtttaatttgtatttctttaaagttggggttttattcatgtaactcaccaattgtgtttcttatggattgtgttcattttcctggaagaaaggtcatttttttccttattaatttctaagaatttttttttttttgagacagagtctcactctgtcgcccaggctgaagtgcagtggcatgactcagcttactgcaacctccgcctaccaggttcaagagattctcctatctcagcctcctaagtagctgggattacaggcacgtgccaccacacctggctaatttttgtattttttagtagagacggggtttcaccatgttggtcaggctggtctcaaactcctgacctcgtgatccacctgccccagcctcccaaagtgctgggattataggcgtgagccaccccacctggacgatttctaaggatttttaagacattaaagtcaatgtctctttagtaacactggaaatagaatcccacccttttcatttgcctttacgttttctttatggtgtttttgatgtgtagaaaaatttgattccttaatgtatacacatctatcagacattttcttcatgctttctcgctctagtgatatgcttagaaatatcctccctatgttgaaatttaaatactcatttttattttattttagtaattttaactaaactactttttagttgttacattaataaaattatatattatatattaatgaaatctttatttaaataaatatttaataaaatatatatccaatgtatatttttatataaggtttaaagaaagaatctaactttatattattttcccaaacgatagctgttgctttcaacaccatttattgaataatcatcccttttctcattgaataaaatgctacttcagtcacacacacacacacacacacacaaatacataaatgagtcttatttgaaatctatagtctatccaaatcaactttatctaattcttcatttgagccaccgtcctaattcttacaatattatatattacatgatatatgttactgtaatttttatgatataatctctggaatggtgtgttctacatccttccaacctttacccactgtgctttatttcaactttttcttgattttcccatgttagcttgatttttgaaatactttattaaaatcaaaaataaaatgtgattggaattgcctatagtggaatgaatattgtggattgtttagcattagttaagacatttttgttttcttcacaacaataccaaaaaaacccttctaatttcttattattttcactcataaatataggtgtagtatgtttttgtgactagaatcttgtgctatttaaaaagaattggccgggcacagtggttcacacctataatcccagcaccttgagaggtcaacacaggcggattgcttgagcccaggagtttgagaccagcctagggaacacagcaagaccccatctctacaaaaaatttttgaaaaactgtccaggggtggtggtggatgtctgtagacctagctactcaagaggctgaagcagaagaattgcttgagcctaggaggtgaaggttgcagtgagctgagattgtgccattgtactccagcctggacaacagtaagaaagtaagtaaataaagaggtattttatttttttcattataatatctaactgattattactttctataaaaaagctaatagctttcttatatgtaattttgtatttggctacctatctgaattactgaatcatttctaataacatttcaactaattcctttggctcttccaggtaaatacccacatagctataaagtcagttttcattttatattttatgtttcaagttgttgtactagaacaataacttgacaataactatacaacttcccaaacaaatattacatacaaatattatgttacgtcttattgcttataactaagctgactttaatagaaacgactcacacttaaaaattggtttcaccattgaaataaacactatattcttctgttgctatttcactgcatccttttaaaaaaaactaacaacaaatggatattaagttttagtcaaatgccactgtggcacctgtcaatacaagtctattgctttttctttcaccatattaatatgatggattctgtgaccagatttgatcaaaattaactatatgtacatttacagactcggccttatttgacatgagcatgaatcttttaacaaaatgcaagattcaatttaccaagttgtatttaagattttatctaccgaaaagtaagattggttgagggacttccttcttattgcaaataggtctacttgatagaatgaattgaaaagttgattttcttttcacaaactctagaaaatttatataacatactatttgttccttaaaagtttggaaacattttctcagaaagtctctgtgcctgacatcttttgaaggactgtttatttaaagcaatttttctaattttttttctgacagatatcgctttgtcaaggttatatacttcactttgtatcaaatgtggaaatatatatatttttgcaagaaggcacaatttaatcaggattgtctctctccctttccgtatgtacatgtttctgactcatcctaggcccctcactttccctcactcccatagaactgtttcaccaactgttaggtatgactgctgtctcattctctctcaccacagaaagctgggaaaggcattttaggaggtgagaaataaagcatcctctctcaagtttttgccatcccccaagagttatatgtggggtctccatgccaacagtccactcctctgagatggttttccctaatcacccgcaagtaacttttcacttttaactttaaaagagtgagcagggctccccttcctcataacctagctgcgaagcaatttaataggtgttccatgaaatttaaaagcagtagtaagattcctaacagagacactcctcaactttctccattctcacagcctgtctctagatatagggagttctttggaactaatttctgaaagaacacgtactttttcatattatataacattctaagccacattaaaatgaatgcttggtgagatttttcaagcagatatttaaattattgtatgccactgagaaagattaacagggcataataagctatacttaatattttaggaacgagtatagtaaactattgtttaataaatacaaggcaaggcaaacattacaaagtgaaatgtggaagaactaaagcttctaaaataattgaaccttccctctagcagcccctcacagagctctccgtcattaaccaggagtataaaaaatagagcaaagtatataatacaataatagctatagttttttgagctctggccacatacctggcataatgctagatgttatacacattagctttcttcctcagggcagccctaaggaaaaagagcaaaggagggctgatgtggtttatagctcccatatgccaggccccaggatggatgagtttgtaggaactagagtctcagatcctaagtccatagagttaggaagacacaattaataaggcaaagttcctgctcttgacattgtaccactgtttcaggtttgactcaactttttttctgaaaataatgattaactttttatagttgtttacagcctgccaggcactgttctaagaactttatatgtatcaacttctccttgaatcttcacaaccactttataaagtaagtatcatgatggcccccatccccctccattttttaggggagaaaattgaggcttaaagaagtggcctgcccacagatggcaagtgaccaggccagagtccacacccagactatttaactctagactccatttaactctagactctaagcttttaatcactaaactttcagaaatgtctaccaagaaagatggctaaatttggcgagcaatatctaaaatcaagtccaaaggaatatgaataaaagcatttgaaagagaaggctatgatttctcacactatgactagcatttttccttaggtgtcatctatgctgaatctccactgggcaggaaacacaatgaaatacaactgaaactgaatggaaagttaaccatgaaacgactggaggaatctcagtcagaactaggtctcgctttaccaagagaggtcagtcatacttgacaatagaggctttagggcccttttcgatgttccacaccataatttaaatgatgcagtaaaaacagaaaaagcaaagagttaataatcatctgaagaaatgtgcttccattctaaacttccaagggggttgggggtgtaagaagactaaatattgtggaaagcagcttggtgacatctgaaaaggctaaaaacagaactaccattcaactcagcagtcccattcctgggtatatacccaaaggaatataaataattctaccataaaggcacatgcacacatatgttcgttgtagcactattcaccatagcaaagacatggaatcaacctaaatgcccatcaatggcagattggataaagaaaatgtggtacaggtacataatggaatgctatacagtcatacaaaaatgcaatcatgtcctctgcaaaacgtggatggagctagaggcattatccttagcaaactaacgcaggaacacaaaaccaaatactgtatgctctcacttgtaagtgggagctaaataatgaaaatacatggacacaaagaggatcagcatactggggcctaccagagggtggagggtggtatgagggagacaaccagagaaaataactattgggtagtaggcttagttcctgggtgatgaaataatctgtacaacaaacccccatgacaggagcttacctatattaaaaaaaatctccatatgtacccctgaacctaaaataaaagttttgttttttaaaataagatgaaatgcatagggcaaaggtaaatctgtttgtggaaaaacagcaaaaggaagcactgtttcctggcaataagtataactcttttcttaaggtctgcccttctccttaccccgatctccaacttgttggaaagctaagattattgaccttctgtgaactctgtatctagttaacttctttcattcaaccctttagggactcaagcaaacagcatcactgacaccattgacagtttgggattccaaggtggctatgcaaattaatccctgtctcttgctccactcctaccctcatcactaatcctcacttctcctacaaaaggacattgttatgaagcatcctcgccttgttttcagcttgtgtgtttttgagccagagcttcattagaatatgaccatctgtgctccctgggaccttggtcacctcaatttatttgctggaagatgtggaatgatcctatttcacgtgaatatctagctcagtttcctctatttctctaaatgtatctcaatgtcttttgtgctttctggaaggtattagagtttatggaccttgctcttggttaacattaaaaaataagctttctacataatatagtgtaaaaaagctatgtcatttcttcacttttctgactactaagttctcttgagaggcagtgagtgtcacactgcactactagtggcctgcacatctgagacagagtatctcttacacacttgtgaattaattcctaacttctgtataatattctatttacattttttattcaaattctctctcattctctgtacatttctttagcacacactagatgtctgctgtgccaggtgactctcacttattcagcacagcaaccctaagagacacacacatttagtactgaaatattagagtggagagaacaatggtgaggcaatgaggttacatggtcacattcttaccttgggaattctgctttgctgtgaagcagtgggtaaagacattgactattacagcactcactgtttatccaaacagtatcccaggggagaatacatttcagggttctgtacgaggaaaacttagtctttcctgagaaatggatgttgtgttcttctcgtctagcatttcttttgttttcctgctaagtttggccaccacgtaactatgagatgggtttctgggctccttcagaggaagcactatgactcttattattgaaatattcactttctcttcacccaattttctctttttaacattctgaattaaaaaaaaattattgactttgtactttttgtaacttactgcaaatccttttctaaataggcagggcatgaataaagaaaggatggaaggatggaagggaggaagggaaggacaaaggaagaaagggagggtggcagggagaaaacaaaaacaagtaggcaaatacataaaatgacttaccttttgtaattttaaattattcaagtttgttttctaataaatataaccttaatgaaatgccatctctaaaaatcctttatacaaagcttttcaaataataaaaggaatacgagtaaaatgatgaaataaataaactttttgcagccaagaagtctatgatctaacgtttcttgttcactatctctcaaggttccccaagagtaaacatatgccataaggatttttgctaaatctagtcttaaaataggaactattctaaaattaaacttctacttttatccataaggccatttatatcattttaagcaatgttgtaacaactattggaaataccacatggtctggttttacataaatttgcaatgtatattatcctccatcaccccctacattggtatagaagcttgttccaatggtatcacatagtgagttttattttctggccaggttggcattttgagatctagaatctttatatgccacccctgccgccattgccgactggctgtgtgcctaaaagccagagacactgggcagggttaaagattgtggccaggtttttttttttccactttgtcaaatgtaaaaatacaatgatggtttgtagagtatacttcagaaataatttagtcagtaggtttatgtctaccaatatatatcctatgagttaatataagcagttcacactaacaactgtaggtgatgtatccttcttttagttgctgatactgtgagagaataaggcattttatttaattaaagaatgagctaaaatagcaatgtggaaatacagaaaataaatactgaaaccacacaatgctaaacatgaatcagcattcctatatttgtaagtgaagtcacctaaagggaagaaagtataaacagaaaaggcaataactgcatcagggaaaatgagaacctatggaaggaaaaagaccagcagtacctggattcagcttttctggttggaaaggtctagagacattaaaatcacacctgtttataaaattatgtatatttaatattggaatattattggtggctctagagggcatacacctggttgtacaggaaccgtaaggtttaacaatactactaaaaaaggaatgtttatagatttagatttattgcaaaccatgctttcattttttcttcctataaatctttcctgagcatctactatatattaagtgctactgtagctatggagatacaacaagacaataaatatgaacttttgttggagttcacattccagtcgaagggatatgaatattaaacaaaataaataggtaaattagaaggtatatcagaaaatgacaaggacaatagagaaaactttagcaggggagtctgggagtggggttagggattaaaactgcagttctcaatctaatggatagaaaatgttacattgaagtagctttggggtgaagccttgaaggaagtgagccacgcagataactgggtaaaagcatatcattctcttgtttagatataaatgtgctgagaaaaaaaaagtattttctatatataagactattcctctgaagcagtagcatgcagatgactgggaattgtagaagaggtgtcaatgccaacaatttgaagaaaaataacatattttaatgttgaaacaaatagagaaaagtaagggattgaagagatattttaaagagaaaactgaaggtgttaaaaatgtgcatctgataccataaatccaggctactcttccagacaccaggctcacatgttcaatttcttctggcatgaaaaattccagtggaaaaagtcaaagaagctcttatctcttcgctgaagcagtcatgctagggtaacagctgaattcaggaaaacttaaggaaactaactttcactgcactcatactatatgtaaaacatcatacacataatatgaatgtccaattttagaagtatttaaaaaacatggattttatatagctctaagccacatgaggtgtgtatgaggttgggggtagtgaagctcaaaattgtaagctagacacttcttgaaaaaaaaactaaatgcagccttcactaatggcaataggtagaaagagaaagagcatgagccagaaatactcatatttaaatcaaattatggctctgtgctctgtggtcatgaggaaactgcttaatatcatttacttcatttattaaatgagtctattagcaacaacacatgtcaaattcctaacatggtacctgtccatccttcaccttatgagattattaaattattaaattttgccttttgagcaaaaatattgatttattgaaaatacggcctaaaatatatgccaattatgctacttactataatagtttaacatacaacagcttgaaaatagtataattctttcttcacatgagccatgttatgatttccagtaatttgggacccactggtatgtgggattcattacaatgttcttcaaaattatttcatttattacatggactttgtttaaggaaacgaacagaaaaaaattaaatgtttgttttggagaagtttcatgctgttaacttcaaagcccctaagcctccagtggccctcttggatataagccacagatatgagcgtgaatgacgctggttgttctacatgaaacttcctgatgtgaaaacttttcacctataacctcaaaagtcagctatagctaatagctcatgagtatgtttccacaatactgaacattttgataaaatacactttaaagacttcctgattagaaaagattaaaaaaaaatgttttcctaggattatactggaaattttgagaagcttcttacagcactcaaaaagagttcttgtgtatttgttgttgtctggaacgacatcatcaaggatcaatcacattctttaagggctaagtacgttcacaaaatttccatttttctctccaaagcacatggaaataatttacatataaatgaagaaacatgccaccctttaaaaataccagtttcttgacatatagtccaatggattgctacaatttcaagtctttaatagattcaagttgaaaggaatggcatgtcatttgaaagcgtttccaaagcacaagggcagccttgttttgcaatgtttctgaaatatttggtttaggacatggcaccagagggcttggcagtgaatactccgaagaaatgtaaagtttaatcaatccatgaaaatcagtcccagatgtggcttacgagtgacaccatgtttttaaacataatctggcataaaaagttcaaaggtaatagatatcagaaatatattcctagtgataaaactgtaggtaaagtttatttaaacctttattatgaacccactacacgcattatctgttttatgtcttatagcatgtaaaaaggtgagaaaaacatactgtcctgaatatgctaccaatcaggtagatgaaagcacaaaaaaaacccattcattcattcactcactcattcattcaacaagtatgtattgaactccaattcagggttagatactcttttggcaccatgactgtgagatctggttcttgttctccgctatctctgcgacttttcatctttagtggggagaaaagacaggtaaacagttgattaaaacctagtaagaattaggttcaagttttcacaggatgtggtgaagctcagaggagagagcagagcactggtccagttctcaggtctggggcctggaggagaattgccaagggagatagagattgagcatagtcagggaagggtaatcccagcagataaagcaaactgtgtaaatacggggaaaagctagcaggaaacaggcaacaataaattcattgtttctggagacagtcttaatgggacatggcaaacagagagaggatactagtgagagagccaggtgctgcgttcctgatggccaaaaggtcttgttggagagtttgtattttatcttcagggatctggaaagccttgaaagatttcaatcaaaaagatatttaaaaacatgacagagtaagagaacactaagttcctcacttaaaagttatggcagacatttcaaaactgttcaccaatttccagttttcttcttccaaccccacaggaaaattgtacttccctgcctctttgaggttaacaaagttgcattgctttggaaaatgaaatatgatccacttttcggggtggaagcatttaattgtgacttctggaatctctaaccctttcttctgtcatggtgaaggtagacacctgtggtttatatggcggcattgcttttggcaatcacatggagactgctggcctgcggggttctcagatccacagtggggtcgtccgttattggagtattattttgcctaccatgactagtacacgtattcaagtaatggagatattcttataattaacaagctactagctctgatttgtaatttgctcaattagacaaagttaagtgtgttccttgttaaaagtattcacctgtctaaagtttcttgtcttagtaaagcaagtcaccgcttccagattttggaagtggtaattaacagcgttttgcttatggatttacttataattagtttttgtttttggaaatttgaaaaatgcaaagtttaaagaagagggtgtacatttattctaattacttttagaaagaagtagtacatcagtaatatggtctcagtgttaaaatattttaaaagggaccaggcatggtggctcacgcctgtaattccagcactttgggcagccgaggcaggcagatcacctgtggtcaggagtttgagaccagcctgaccaacatggcaaaaacccgtctctactaaaaattcaaaaaaattagccaggcatggtggcatatgcctgtaatcccagctatttgggaggctgaggccggagaattgcttgaacccgggaggcagatgttgcagtgagctgagatcgcaccactgcactccagcctgggcaacaagagtgaaacgctgtcaaaaaaaaaaaaaaaaattaaataaaatgtagattaactcctgaaagtgaatactgtacatgtttgcatgcattttattctttgtaccttgtgactgctggctacttactgccttcctcctgataccagtttttctctactgcatatgtcaataaatgtttagaaatgcttgaagaatacagagaaagcccaaagtgttttttgttttgttttgttttgttttgtttttttcagaaatgcatctaagtgtctccttacaaaatgagagaattcattgattagccattctttggacatgctcttaaacgtcctctaccagaaggaatttcatattcctatcacaaaagggaaattgcttattcttatgtttataacaccagatcttttatttgatatatactatgtgtatatattatacaaataagctctttataaaagataaccatgaaggaattatttcctgaaacggcaaaatataaatttgcctgtaaaatcagaatgccctagccaatcttttgagatttgaccaggatgatcctgtgggtaaggaaactaaccctttcaaattgcatgaaaattagaagacaaatgaagatgttgtgaatggaaattcatttccaaataaaccactgggataaaaatcattagaataatgctagtttcaaaatctatgtttttccgtctctttgtcactcacaattatttcaaatatgttcactttaaagtacagtatatatacctagttaggttgagtcatgttttagaaaaattccttagagtttgtttttaagcaaaacaggactgttttaaacaaagcagaaccttaacaggaaactgataacagtggccaagaaaagcatcttattttctattttctgtgtattagaaagaaaccctatttctcacttcctcatatggtaattatatctcggtggaattgaatcctcaggacaacagggcatgttattgtgagatattttacacctggcttaaccattctgtaaaatcagagatagtgactagcccagaggctctgtctcacttccttccggtgttgcttagctattgataaatattaaggtgcatgtgatttggctgctaaaatgaagaaaggatgtcagaaggctatcagtttgctgaatcaaacagcattgccacagggctccaagctggcagggcccctctgggcattgccaggtcaccaaggaagtggctgggtgaggtggcaacaggtgtcagacatgctgctgagcagatgatctcagcaggcctgaggacagaagagaaggttaccacacaaagtgcttagctgtgaccgcagaggaatttcagcatcaaaggaatttgagtagaaaaaggtttcaaatttcagttaacccagggttgaagcagcaggactcattgatagaaagagagaagcaaataaaagcccacactagttaacataactctcaaataagaatgcaattatctgcagccacagtagcccatggaaagatatccctaaccagtcattcagttgagacatagggacatcacctgggtggaaaggacccttacaggttgtgaaggaattataagtgaccattagtgagtggtcactatgtaccagacacagctgtaagtgctttatggccattaattcattccatcttcacaacaacactctgaggtaagtattcatatttgccttattgtacagaggtagaaatggaatcataaaaaagtgaagacatcagccctagctgatacagcaagtacagaggagagccagaatataaacctaagaagtctgtctgtataaaccatgctcttagccaccaagtttcaccatccctcacagggagaaaactgcagagcagaaaagttctggtcttactcctaagaagagatgcacattacatacatgaaaagataccaaacatgacaacatagaaaatgatggatgccaagtgagtgccaggaactatagagctgttgaaagagattcattgcaaaacaggttggaataagcaagacaaacttgagaagtggattctcacattgagtgtgaacaagcaggggcagtgtgatgtggaggaagggagcatgtactctacaggctttagcttcagaggggcttgggttcaaatcccagctctgccacttacaagtcatgtgagcttggggaagttacttattctttgttttctagttttcctatctgcagggatagaaaaatgctatttcaaaacactattcatgaagatcaagcaaaattagttataagcaggtctcagcatacttggtacaaggtacacatttaatatgtgtactattatccaactagggagagatagaaagggagcttcaggtgagaggaacagcataaaaaatgatccgcaaaagccagaaataaaacttctatgagctcagttcaagctgactgggtaggtaaatgtctgccatgaacttggaagtgagagagaatctcccttggacactcattaaggggcctcaaagccatgaagagttgccatgtggtccttccagtcaataaataattttgtccaaacacgagtggaagaaaaaattaagagacacccggatggggaaaacccattctctttttggtgagacaatctagccagaaggacactctcgccagctagagctctgcatatccaaacaagcacaggtaaagtggaagaactgaccagaagaggagaaaacatgaattaattaattaatcaaagaaacacctgtaaggttccaagtaggtggcaggtaggctgagtgttagtgtatccagtcaggcaggtggtgatgacaaagggcccccaggaaactcccatttgtgtgagtgagaaaggcaagaaaacagcatgcacaatgctacttgaggagcgatgtttgaaaaagtgatgcacaggttgcaggggatgcacagaaactagggatgcagcactggagtggggtgagaagcttccaagaagagacaagccttctgatgggtctcaaaggaagaggagggtctcaccaggcaaaggggttgggggacacattctagtcagaaggaacaccatggacaaaggttgatgaatgaagcagaatgatatctttaagaagctgcaaaacactttccaccaggagggtgcagctggggtgtggcacatgaggttgtgaaatcaggtcctaaagaggctggaagaatgtgtaggaaggagatgggctccgcttggctcttaggtctctgcagaaggaaagagaaggagaatgggacaggtggtgagactggaggcctgtacactatttagaaagttactgggccaggcacagtggataatgcctataatcccaacattttgggaggctgaaccaggaggatcgcttgagcccgggagatcaaaaccaacttgggcaacatggaaaaaccctatatttacaaaaaaataaaaaatgagccaggcatgttggtttgcacctgtagtcccacctacttgagaggctgaagtgggaggatgccttgagctcaggaggttaaggctacagtgagccataactgcaccactgtactccagtctggatgactgagtaaaaccctgtctacaaaaatgctctaaaacaacaaccaaaaaaacccagaaagttactgcatggagcccagaggagaaatagttgcagcatcactgggaggtgtgggtagtggggtgaaaaggctatggcgtaagcctggtgaggaaaggcaaagcacctgatgctccttggcttcaagtacagatggcaaagcaactgggcaaggaagtccctggacagatgctcaggatgattacagcttcagaatgctgaagtgcagctgtgcctatgttttcttcctcctgtcctctgccacactgtccttcgtcaccctctggggcacctcccctcatatgagaattgagaaatggagggagagtacatgagtagtggggagacaccaagacagcagagcatagtgaagagaggaggagaggggaagcaaaacttaaaagagactcaatgaaactgggagtgcttttgctaatgccactaggaaaaagaaatgtgaaaataaaattttatatataaatacaaacacatgcatatgagtgggtgggttaaactactataccacctcttagccagaatgatcttttctaattagattaggaaatgaaagtgttagaagactgaatgggtaacatttgaattttccttttgaaagatgggccatattttgactttagaggaaacacagatgggaagtgcattcttgatcttggaaatgttgtgatgatccatcactgtcagggtgaagtaaggatctttagcatggccaccagagccttatctcccacctctgtgcctgcctccaccctggctcttctgctgcctttatattaaacatttgttcattcaccacataaggttctctctcttgccttcttttcctggttaattcttactgatcctgcaaatcacagcctgaactactcatcctcagagaagacattcctgattttccctgaacagataaaaaaacccttcacagatttttgaaccctgtgtgtctttctcccgtagcatctgatccagtcacagtttcatgtgtgtgtgtgtgtgtgtgtgtgtgtgtgtgtgtgtgtgtgtgtgtgtgagagaatgagagagagagagaaagagaatttgattaatgcatgtcttccccagttaatcataaactccataggggcaagaaccatgtctgatttggcatctacgaatgagtgatgaatgcaaataatgtttggctatggggggatgaggtgtggccatgtaggaagatgatgtcagggtgtggtacaaggttaaggaagctgcagctaaaaaggatgccaacttaatctattttggccattttgtctaccctaagtattatgttcacactgtatttcttctttctggactaagaaaaaaaaaacatgtttgcttgtggggtctttttttccttctaaaatattagactgcaaacaaaggcactgttgggtagtatatttttgttagcacccaaggggaaatgactgtgttcttgggctctccaatttttacattacatgttttctacatgagctttcaacctaatgtaagaattaaatgcaaatttgaggcatatgaactattttatgcaagatcttaaaattgttttccttgggacgttcattgaaagtatggctcattactgaaaatctattcttcagtgtgttcctaaccatctagccacgtcaaaaaaagttgctttaatatctgaagccaaatcgctgctttcctttgtgattacaaggactctcttggtaaatcagagtatggccaatgtccagttgctaaaggtggaaactacaagttactattctccttaagttaccagcaagatacagtcaacatgtagttctttggtgtctgtcaagaaagtacagagatttataggtaaagaagtcaattttcttatcatagatatagttgtcatatggagagtatgctgattagaaataatgaaagcaagagataaacttaaattgtggaattatctgagaatttccattatccatgtcccaagttaactgcaaacaatataaagttgactatatcaatttttatgtacagaaaaacatttgggacacaaatacattttaaaatcttaagagtttgcagggtaaaaaacattttgggggaaaaataatttttctaagggtttgagaaaaattcagcttatatttatgtatttcaacttcagtaaggataaatggaacagcaccactggaattgaacaattaagtaagcaaatgatggatggtagtttttcactgttggagtggaagattatagataagcaagaggaagaagctagaatgacccatgtggtaatgagttagatttgaaaatatcagtatgaactaatgcttatctatctatcatctatctatttatgcttcctgattgttagatatgtgtacatacacaggttggtatacacaaatatatgtccttgctctgtcagccaagaaggccaaaaggaaatgacaacccaaaaacaatgaacacacctattgctcaaatcttggtttttaataccattttccaatgaaaggaacgtgtgctccttggagaaatggctgaatctatgatgaggaaggagttatattgttgataagcctcaagtattgtgtaatgctagaaaggatgaaagtgcatcaaaacaaaacaaacaaaaaacagaaaacaaaaccaccacaattgtggggatgtatcaaagggacacaagaaatagtacccaatggccaaagctggaacaatttcacagcacgattagtatgacagtagtggattataacctaagcataaaataaatatccatgagtccatactgatatacataaatgctgaataattaaatgagggagaataagcaaatcttctgtggagaagaattgcaaatattttatgtagattctctgccttcaaggagatggagtataacaccctcttaagtgtgggttgtttatcatgacttccttccaaagggtaggtatgaaaataataaaaataaggaaaaataatacatttatagtggaaaaacctgaccaaatccacctcgatcaggtgatcaaggttaacatctttagtcatgttgacagtgtgatggaaaaatggcacattaccctctgtggtctctctccccaaaacactaactacagtctaatcatgaaaaatcaatcagaaaattccaactgagagacattctacaaaatacctaatcagtactcctcaaaactgccaaggtaatgaaaaacaaggaaaatctgagaaaattctatagcaaagataaatgaaacacgagaactaaatgcaatgtggtatcctgagtggggccctggaatagaaaaaaagaaccttaggtaaaactaaggatatatgaatgaatagggactttaaataataataatgtaccaatactggttcattcattgtaacaaaagtatcatactcatataagactttaataaaaggcagtgggtgaggggtatatggaaactccctgcactatctttgccatttttctgcaaatctaaagctgttttaaaataaaatttatctttacaaagccctgaaagcctagaaatttaaagtaaactcgtacaatcaaatagtaaggcctaatcttactgacataagccaatatttaattttctaacccaaaatacaaactcttcttcacatgttaacctctatctccattttctatgtctacatttctttagaagaccataaatcacgctatattatcattaattagagccaagttaaaatgttaaaattgctaaacatatgactcatttaaacaaaggtttactaaaagacaggaaacaatttacaggaggtatgcattttctgcatggttgcatctttcaagaagacaaagaaagggattaagaatacctttgtcctaagatacaaaaaaaccacaaggcaaaaagtacgacatataaagttttacaccaaacaaaaaagagaaaaatttcagcaaatcaatgttatcatctacttatgattttttatcattgcaaacaacgcatgtttgtccatccttacttcgccacctggaccaatgcaggccatgtcatatgaaatgcctgttctgaccattagaacatccagactcattctggggcttaatctcttttactgcaggtgcatccacttgttatatttcagattagcagcctcaaagaactagcctcttcccagtacccatccttcaattactgcatcattttctctaacaattgcagtctttcaaccactttatatgtgacaaggcatgagcttgcttcctctcttgtcactctcctgagtcctcttctgtttgtctgcagcccaaaaggaagcacaatattccagctgaggtctgaatgatgcagggtcaagtgcattcattacctctttattttgggttattctggttctattaatacagcttaagatgttatgtgaaatttccaaaataggttccatattttaccttcaaaactgtatggcagacacaaatactacattatctgtgattaccgtgaatgaggttagcacattattatgtggttgtgaatatcatacttggcttcctggagaccgaatattcatgtatcagggccctcctgtgatgacacagtcagtggcgccctcacaagggcataccttctagccttgtcttattctttaaaaaaaacccacattctttctttgttctagctacacagctggaaaatcagaactgaacataatagtgggaagagagtactctttaatctcagtatttaatctcctgatactttctggacctctgaaagtattaatacatgcattcccatgagaaatattattgcttctctaataaataaggatgtcatacaaaattaacaaattaataattcaaggacacattcgggtgccaaagaatacagttttctaatttttacaggaaaatatgtaaagtaatataaaattttcacttgtaaatagtgcaaactgtgttagaaaaaaagacaatgcagatgagagatttccttgaaatgctcttaaaatcatgttattgatccgtgtaagtcagctatatcaattctactgatcaagaaataggtattttaaacacaatgctttcaggagtatacaatgttgacaaatatgcaaaaaaaaaaaaattgcaaaactccaagaaaatcaaataatgaatgctagccaaatttctatccgaactaagctaactcaatgatattatcgttgtctttaatggagaaacatgaataaggataatctttagtggacttagattaagtaatacaatgaatagctataaaatttgtggatcagaattagaagaggggaaaaacacattaatcaagtagacatgttaacaaaataatggattagtcaggattacatttgaataaattagcaaagcaaaagaaatacattaaatatctaatatttagtaacttagaagagaaaaaaatgctgtgtattttacatactaattcatacacatgcccaacaaataactaccgtttccagtcttcatgtgcaccataacatgtgtaacatatgaaacaaaaatttgctcctccctgatgtatattggtatgaaaatcttttaaggtaacatgagaatgaaagagattcttcttcatgctagacatagaggtttttaaacacatcatttggctgacgtaaagcacatttgcaataggcattagtaacctcaagttaagaacaatatatgccaggctgatgtactggacacttcctaaatactgtactcagcagttttggagcacttagcaatgatgaattggtgtgaagactcaggtactgaaaggtcatttccctttttttcttgaatcttttgcttgtcttgattgacgctctgaagaagccaaggatacagaaggggtggagaaagcacgcaacccaaattacccaaaggagctgcttataatgaacttgaatgaagatagattttggggagaggtgggggaaagtggccacaatcttcaatattcttttgaagtgttactgctttcaaagttgtgatttttctcaaggtaaagctgtttgacacagatagactcatctgtcaatcaaacatcttttactcatggccaggtcaaatacttgactattctagtagtggtatcaaactcttagtgccaatataaaacagccaactcacctagccagggaaaagaaataataagaaaatgaaaaagtgcactgagcctttatatcctgtattcaagaactgcatttcttttttatttagttgttttgtcattgctgtttatcagtttttgtttttgttgttttgttttatgatcaaatagttttagggggataatatataatagccatgtcacacatttctgaaagaacaacttatttcacctggccccataaatggaaatatttcataaattccagaagctttggcattcgtctacatcctctttccagactgcttgctatttcataatcattttcatgattctcattttccttatgaattgaatttgtgcttgaaacatttcaagcctagggaagcaatcttgtgagctgacagatcttattgggagcaaccttgttcagaattttgacttccacttccactcttacacaacaaatgtccacgtatagactcaacatttgcctcaaaaattcaagtctccttaagaattacaaaaggttgtatcaccctgtaagactgttgccattacagatggcataggactcaggattctaaaatctagtgctataatgggctataagttgggttaaagaagtgagaatgctgtgcttttaacttcaaaatttggcaagacataccattttttaataagaaacatattttttatttggattatccttttcttatactatctattttattatactttctttaatagtatttaatcagattttaatgaaatctggtacacaggttttttgttttgttttgttttgtttttgtttttgtttttgtttttgagacggagtcttgctctttcgcccaggccggactgcagtggcgctatctgggctcactgcaagctccgcctcccgggttcacgccattctcctgcctcagcatcccgagtagctgggactacaggcgcccgccaccacgcccagctaattttttgtatttttagtagagacggggcttcaccatattagccaagatggtctcgatctcctgacctcgtgatccacccgcctcggcctcccaaagtgctgggattacaggcgtgagccaccacgcccggccgctttcttttaattataaactaacaatagtatttacaattttcaaagaactttcaaatatactacaatcttccacagaaatccataggggaaaaaagggacaggagaggaactaaaatatatcaaacacactaagttgagcagataccatgatttatatatgtatatcattaatctttatgcacaacttaggacaaatttctttctgatcttagtatcataagtggtgtgcttccctgatccatcaaattgtttatccaatggacacggggatttgtgtttaagcttcctgatttaccctggatcctaggaagcttagtgagaactttacattccatcttgcatacccttggacttcatggtctgcttaactcttgaaagatggaaggccctctgcctcccttgagatctaaacaaaattgatttgaacttcctaatttcatgaccagtaagaatcccaaaactcacctctaaatttctgataatttcctaaaggctgggctcattgacctgctttgccaacacaacacagctcattttgattcacatgccaccaacaccatcaaaatcacttacttcaggtactcctgaggcttcaagtaagacatacatatattagtggtcttcccacccctagcaactccctgtaccctccccaatacccctcacccaccgaaccactgtcagtactggggagggatctgtttatggagtatacccgcagttctcagccttcccagggcgaattttcctcatcctgtcctctctcctaatttctctgcctcatctccatcattctcattggctctttagcactaaattcttcttctgttatgcagagaagttttcacccttagagcacttgagcacctacctatagtcagatcctcagggactttcttcctatcccaagggcacgttcaaaatagctcttctaggccagctgcagtgactcactcctgtaatcctagcactttgggaggctgagatgggtggatcacctggggtcaggagttcgagaccagccaggccaacatggtgaaaccccatctttactaaaaatacaaaaattagctgggtgtggcagcttgcatgcgtagtcccagcaactcgggaggctgagctaggagaaccgcttgaaactgggaggcagaggttgcagtgggatgacatcacaccactgcactccagcctggacaacaaagggagactctgtctcaaaaaaaaatatatatatatatatatatataaaaatatatatttatatatatttatatataaaaatatatatatttatatatatatttatatatataaatatatatttatatatatatataaatatatatttatatatatatatataaatatatatttatatatatatatatataaatatcttctagcaaagacatttttcttccttccccaagaggattctggtgccgtttgtaaaggtaatatatatatatatattttttaactattacatacatatgtgagtaggaacatcataccttatttctctttgcccttcatcaacattctccctataagttatgcacatataactttgttggttgtcttaaatgctgcctgggaaaagctgcggtttaaaaatgacaaattaaataatgtattatctcattgaatccttacagtaaatctgggtgattggaactgttctatttttctcttataaatgagttaagtgatgctcataaaaggtgatttgctcaaagttaaccagtcagcatcagagttgaatttgaacttggttcaatacagctttaaagcatgggatctttcccttgcattgtactactggttaagagagagaggtatgaaaccctcgaatgctttatcaaaatatacctgtcacttcctcttcctacccactcttcaacctccagattttcatactccttattactttccccccaacaaagtcttgcagttatttctgataaatgatacaactgccttccctaatgacattctccaatcctcaccatctccatcacactgagaactatggctttttaaaacattgaagttaatttttcaggatgttctctgacaaaactacatataatgatataaaatagttattgatactctttcataataaagtgagaataaaacctcattctatacatatatagtgtgattataaccactatactaaagaattgatatatttaaaaactcaaatataggatatgtatgctagaataatgagagaaattaattaacactgataatattaataaaaattatcatttctacaatgagactagaaaggaggaggccagatgaggcagagctttatgctgtattacatataatacaaagctagtacattttcttggcaagtgaagagatattagggagatgatttttagagcttagtttgacagtgaaagatgtataaaaagaacgaagagccacacgtagaggctggtctatgtctgaagaccacatcatgtactgtgatgaaaagtaattaaaatgaaacatcaatgttatagatgcagaaaggggcataatcaagcatcagagccagctgtggagataatttacagacttttatctcaccagcaagataaaacatacatatcttcaaggaaagaaagattcctatatgaaagtgaatgagctagttattagttttgaagaaatggtgtcttagataaggtgatttgtagcaatagcatttagattttacagatacacccagttcggcaggatggttgcttctacaaatccagttaaactctcccaagtgacagaaatcaagatatgtgggaattatttatgctcaagatgacaatttttatagaaacagtatctatccccccaaaaacatgggctatatcctaaaaacctgaaattaatattaaaagccgtaaattcccaggacacaattctggaaaagtaatgtttactctaaaatcattttattgagcacctactatgtgtcaggcactgtgctaagaacagagaatctaatgaagcagggcctgagtaagacagtcataaacagaaaatccatcctgtataaggtaggcactgactcaacatgggagggcacatcagtcgattcttgctgaggcttgagagatgaggaggtataaattatccctcataattcaaacttaacccaaggtattgtccctgtatttactgaacaagaatgtgatatagaagaggcagtttagacctccaagcaacctatagttaatgggtaagatctaggttggaagtggcctgccactgattaccctaggcaacctggttaaccattcacagctagttgcctaatctgtactataacaatatttattggatacttactgagtgacaggtgttctaagcactagactggttttctcatttaatcttcacagcaaccctatgcaatgagaactatttactgtccctatgttacagatcatggagaggttagataagtgacccaaggttgcacccttagtaagtagataacaagcccttgccacagacttgggggatgattaagtaaaatgatgtctataaaaaaattagtctatacttggaatggataacctgttaaatgtgatagttattatctgtattattttttatagcatacgaccctaccttatctcaaaacatagcacaataacattatttgaaaaatataaagttatttaattaaaatttcccctgacaatataatttttatttatcattcttttctgtacacataattatttattaagaaaaaatttaaaaagtacctattaagtacaacaccatgctgggtattgtggtataaagtagaaaaaagtagtcgaggtggctactgcaatgaatagaacagattataatgttaatacctggtctcaaaggctagcttggtctcagaaagttctttgaagcaaaaggttgtgtgcagtgaagatctcacagaatgtggtcaccctttcaaatgatgacatcctgaggcaacttagcattcaacctctctcaaaaatcaaatctggcacagattattttctaaaaaataggacttttcccacaaatattttcttcttttaaaattaacacacccaaaggtttaagactcaaatgccttactttaggacttgtaagaggtctctttcactgatctcaataccactacggttttctcaatttgcccactgtcacattgctagctttcctttcttctctagaacatcaagggactctccatcattacgccaattatttgttttaaacatagtgagcaacccaatgacaaggttcttaagattgaggacttcatatcatgttatttccttaaattaaatggaggatatatgaaaaaggaagggcctgagacctttatcaagagaagagttgggaagatatgagaaatgtataggttgcatatggaatatgttttctcaaatactgtggatatcagcattaacgggcataacgctgctgtcttccccatgaaaaaggctgccatttaaagttaggttttgtggagaaggaattaagcaaaatacccaaggtagacaggctaaggatattccataggagaggccaaatacttgagaaaagcatcagagctcagtcctggaggtgtttgttgatttatgtgtggtttctctgcattacctttaatggaagaacaattatgcctgaataagacagaaatgagtaaattaactaggtaagatataagatcatagatttttatagcaccttagtgatcagttaagtcaaccttctcattttcatatttagaaaagaaaaatatggagactcaagggagaggaagaatgaagttccctgacaagtgactaagacttttagaatcttatttagagttttagagccacagcaaaaattctacaaagcaagctctgtataaagtagtggtgagcactgaatgctgacaataatagcggaagctctgctgagatgattagaagagatgaaaggaattcataatattggctaaagtcacagtatcctccagggtttattctcatgacctagaaaattataaggctatttaataatatcccttaacttacatattttatttgtcattttctcctatttatcttggagacataaaagagaatttaaatgtataaatatttaaactgggttacatcagttctggttaaagtcatattatgtttccttatttccagtacatttctcagagactggtgacactttcaagtaagcttcatagcggttttgaagaaatttttgtaaaagcaggttacatatatatggatttgtgacattctaacataaaccacagaaaggttcctattaaaaagggagcaaagctgaatcattttggcttttcttcccactgtgatttttattcatttgaagataaaattcaaagcaaacatcttaaagcttctgtttgtcacccaagagttatttcaaggcagcacaggaaatctcacattttcaaaaaatcaggtcatgaaaatggaactgcaatctaattaatatgttcataaaacagtttccaccactaccaaataaaacaacaacaacaattaagatcaactctgtattctttggaatcccaagaaacacaatccataggagacattctcatcacaaaacagtttcaaatttaataattaagaattgtaacatttctgtcacatctctactcatttccctgacataatactttgtgtaaataatttctcaagtagagtaaaacgtcttttattgactggatatattcattcaacatcactgacctttttccaacttgtttgactgtcttgtactctctcttcaataacctttccaattccccctagtagctgttccatcatcttactaagctcctccacctgctcctccctggtcctctttctgagatgtgatcttgaattccatttaatacttcccagagaaaacacagggcataaaacaaaaactccctcaggctctccttccacctacctaatctccacattatctgcattctccctccttttcctccccctatcccagagggtgtcatgtccacaagtttcccagctctgtatcagaatatttccttagggacatgcttcctactcttaaaagtgcttggtgttcttcactagctactgtgtttttctcctctccttctcctctttcctcctcttcttctcctcctccttcgttcttaagcaaaattttgaaagaagtagtttgcacaacttttctctgcttttattacccctgaaatataacttacccccagacactcccttaaaccactctctgaagtattatcagtaactactaattcccaaatccatcaaatatattttcactttgaaacttaaggtatttggatcaagtcagttaagttgtttctccttctgactcctgtaacaacttgtatatatctatattaatatgctccatactatactgtaattatttgtttctgtggctgttctccagactagtttatgagtatctccaaggcaggactcttattacattcatctgggcatcccctatgaataaataactcagtgtgttccacctgttccaatataattcactaaccatgacatttttcagtaactcagaaattgggctattttatgattaaaatgcttctttggcaattggatctgatttcagataatactaatattctttacttgagcacaaaatgaagtttaaagacatacaattagttgaatattttgaagaaagtaataattatggcagcaaaacctaaaatgtggatgatcttttatttttggcaaagcattctcaaaaccatttcatctgtcacaaagtaaagctggagcccgtatcaaagcagggccagagataggcagtttgaacagggctcaacaatgccccgcagagatggtgaatagagctgaattcatctatgctccacacaccaagtgtgtacccagtgggaagagtgacttttgctttgaacagaggctctgtccattcaccaagtactgtagtttgcatttctacttcatctgttcaaagtgtgacacctttcctaatatatcgtccagagaggcactttttagtgaaaggatcctataggccacagtgaccttggaaacagagttcaccacaaattccttttaaatttctcattctgagaaaatacagaaagagctgctgacacagtctaagtataggtcattgttctaacattaaaaggaagagtttctcaaggaaaggctattcacattcagtaagcatcctacatacttagccaggctgctaaataacagggtaaatctgcttattttctctggtctactgctaatctaattttcaaaaagatccataaacaagagtgctaagtcatctgccacaagaacaatatggtggattaaaaatatattgggctctaaaatcaggccaggcctggttttgagtgggtcagcttccctagcaatagatatatgaactttcagcaagttatctaatctctgtgaacattaccttcctcatctgcaaacagggatttggataagaaattctcagaaagttatattgccattaaaggatgtaacttatgtgaaaacatatggcatgcagaggagtgctcaacagtgttgatctcttccatgaagtatatgatagttatacaagagattttggcatgtcattgtcaacattctaataaattcttcttttatttttttgagacagggtctttctgtcttgcccaggctggagtgcagtggcatgatcatggcttatcgtagcctcaaccttctgaattcaagagacactcccaccttagcctccctgagtaactgggaccacaggcatgaaccaccatgcccagctacctttaaaaaaatagagagagagacagggtctcactatgttgttcaggctggtctctaataaattgttattaccaatgtgctatgagattttctttaatagcctacttcttaacatgaagtgggtaaatatctgctgtaatagttttcaaaagtggtaaaaactcaaagagctttcagaaggtcacacaaaacattaacactccagaagctgaattagaaacctggagtgctttttttaaattatttttttttagtttatttatgtttccagccaatagcctgattatgtagactctagattatctatccttgaaatcatatatggagagatatatatgtataaattttacacaacataatccctagttgtaatatattgtcttgggtatgtttataggctggtacttctcaaacaactggaaacgtcacctaatagtccatcaagttataagcagttgcagcagttatggcttggagacatttttgagctattgcaaaaatgtggataatgctatagctagacagagtattaatgagcattaacgtttgtgggatatgattgaaagaggagagaaaaggatgagggatttttttaaaaaggaacattcgacctatggcaataaaaaactggttgtttagtttttttgggttcttctttgcatctcagaatttgaaactattttcaattttcctttacttgcctatttttctctgaacccaaatacctcaacattagtgtaagtaactcagtaatagtcaactaaaaggaagaagcaaaaaggagtggaaagtgaagaatttaaaagaagctaaaacatcatacattgttagtaaataattttcatatgatgaggaataatttcttatttttttccttttgtaagatttctaagacctccctggcttatgccactcagtcctttgaagatgtaacctcacagcgatttaaagtgcacaaactattttactacagcagaaaggctgctaggactaaagactatttttcatttccataagttgtaagcacattgatattactaataacaactttgctcctctatcatagcatacttaatcgaattatttttaaaaacactaaaacataaacatttgtaatttcatttttaaattccaaggtattactagaaaaaattaaggggcatacagctgatggcaacaaaagacagtaaaatagaaagccaagagaaaagttttatgtttaataggatcgatatctcatataatggaaaatctttgctacactatatctaaacctgaatttctgccttaaacaatggctgactttaacattgagccctagggatttgtgaacgagatgagtttgtataattatgagctccatctaaactttattggtcctaagtgtttacaagtaaattgtatttggccccaacaggaattcagaattaagctggcagtctggtatttatattttagaatttctgggttgttctgtaacccagaggaagagatgttaaagaagcaaggtcagctattacctgcaatttcactggaagacaagcagacactgcaataattttaagttaactaaaaggagcaaagctccattatcttacatgagacttgatacgtcatttccttcaacgtatacatagtcatcaaactcaatattgctcccaccccctaaaattctaataaaatataatgtattggtcagaacacatactctggaaaatgcacttctggattgagtttctgtaatttcaatgtatgaagaggagaaaaccttaaaagatgaaactctatgaggctagataggaaggattatcttttcattagaaggcaggccattctgactttctctgaatacgtattcattatattagtagatttaaacacatatacatgcaaattatgaacacatatatgaatatattatcaatatactgatttatatcttgcttcattccataaaggatttagatcaaaacagaataaaacagtatgagttagtttatgaattgaatgcttggtctatagaggaacaatcaaacaaataactttctagactaaaccttttagaaattgatacctggaaaaggacagtctaatgaaagaatttagggtcctagaagaaggaaaaagatgcctccatgttgagtgaaagtgccacagtcacctcattttgcctcttcactggagttacctctcagcatcacaaagacagtttaaaacatttagatgtcctacctttaaaaattaaaccctaagcaccaaataagcaaatcattaatcaccttccacaatcattaatcccaaatcttcctctggtgtcctcagaggggccctccatggcagcattccacagcctctcctagccagggcctttagcttctatcttccactgtccttttagccatgtgaatccatcattaaaaggatgcaaaggtatttaaataaaatgccctcctaaattgtttagctatgaaattcaattgcattcaacatagccttgatgtttctggcatgaaattatagtatttttacaaataagattataaaaagttgttatatatcttttaagtcaggcaaaaagctgaacatgttagtcacactgtgttaggtcattcatgttagaccctggcatgtgattccaggtcataatgcttctaaaggtcctcttaactgctgctacatgaaatttaaattcctagaaagctgacttgcatttcccttctttcaaccatgccatacttgttcctgaatgccaggctatctctccattctaacaactagccagaaggaaaaataagaagagctatatagtacttatctatccagtgaggcaaacccttatctttgtttggcttggcagtaaaaagactgaaaagtgtaatggaaagaagccttcgcaataaaatcctccagctaatatttctaatgtagcttcaaagaagaaacacacattcttcataccactcttttagcacggaaggggtagtgttctattaaaccaagtaataggaccacttattaactttaactcataactgataaagagtgaatttgtaatactattgctcaataatcaacacaccagccctagggcaggtggatgagagtacaagtaggaactctgtgcacaggcttctatttcaattactacttctggtaaaatttgaagactaccctagacctcctgtgtctcagctttttctcattcttgcttctcaaaaagcaggacagaaagaggaccagcacatgccaagtcccgcctctccaaagggtacagagcctttctagagatgagctagggctcgtgaaaccaaagcacatatgtcttttacaatgtttattattccttagcactggcctgttgccaacttctgatcggtcccttcacgaagaaaaggctctaaatgtgagaatgaggatagggggagtctttggagatgaaaagagcaatttggcgagacctttattctaagcacgataattcacgagcctgaaatctcaccctataggggctcttacagtaggacaaagggaaagagggttttctgtcaacaaacccctacaatctcttactgcagtactggaaggggaggctataaataagaggaaaacaacaaccattgagaaagtcaagaaccaagcacaaaattaattaggtcacctggaaaaaaaccaccaccttcttcctttgagtccaacatcatattaatgaatccctgcaaggggcccaggaagagtaggagttatacagagcattaacattctacattggcttagtttggccacaacaacaacaacagattggtacgacatgcagtgaagcagatgaagggttacctaactccaggcacaaaagaaaaccaacaggactctcaacttctccatacagctttcaaacatatgtattacagatctagaggagcatgaataagcaaatttgcattctttccaaaacttcagagttgaatagcttatttctttccagtcaaaagtataggtgaggctaatgcaataaaaataaaaagtgcttataattgcaggcattcaaagagtacatggatcctatgtattacaacataaacaaatgggcttaaacagcagaacttaggtagaacaaaaactgttgctttgtagcaaggtacacttgatagaaaggagactggtaatttcccctcccaagcaaatcttaagaggtataaaatgaactctgaagaaaagcctaaggcatagaagaaaaataattgacaaatgcctactacgtgccaggaactgtttccaggatcttttaatctcaagattaaagactattgatgtaaatttgtctgtaagaataatgaggaccttattgctgatgcctgaccctcaccaacagaacaagcaaggcaatggcaccaaggctccccctgactaggaaactctggtgatgcagttggaagtgggccaccgaggtttgcaggcatgtcacccaagcattctagagactggggatagtagctctggtcagcaaaaaaggtagatacgccacagcatcgactctggatggatctggtgttgttagaaaataagcacctgcctagagtgggagaggatgcctcccatccttctctgcaatggattttttagctgaaagccgaaaactctgtaacaaaccagcaggtgattttggtggtaccttaagctctcagggagctttcatttgagacattgtcataaaagcagctggaaagccctccgaaacctatatttaggtatctattattcatccagagtccagccagaacatttacctgaaagatatactttcaaaatcagacaaactgcatttccaaaacaacccatgttagcagacactaagccttaacatgtgcctttattatgcattcacaaagtttctgctatgaaagtcagaatccagctgaccctaaaggtatggcaaaaacaagcaattttaaaataatgaccttttgctcttataaataccctcagcaatgagttcctacacacatttagtcataaactccagcaagaaatggcacatgatatcacatgtccagggacctgaatgcattgcattgaaccttaatagatgaccaaatatcaaggcactaagcaagttctatgagagcctgagcacttcctgattcatatgttagaattctactagaattctactggttcattctggtagaaatatttcttgaatagctaaaatatccttaactgtgaggcaccaacacattttagcattattttaaaattgagtcaacattctaagtttcccttaaccttcttttagaaattcagacaaattgatatatcagaaattcatgtgtgcccttccccagggaattttcaaataaaaatagcaaaacaacaaaaaacaaaccctaagcctcatctttaaaaaaatttattaaattgttgccattctcaaagtttttttcttcctccatgaaatattagcaatttaaatgttctcaagtcctcatgcttgacttatttggggatgcttcatattaacaaagtatttttattgcataaccattactttctcagacaatattcggttttgcacagtttacttttcattctcacttgataccaatactctagttcaagacaaatcctcatctggtacctgtcacggaatttgataattctgagttttacaaactgaagggaatattgattactcaccatatccaggaatgccttctaaagggaaaattattcacgtgcatcatgttcgcagatcttctgtcattaatatttttcttgtctcctacgttacatgtagtgatttttacagatgaattccaactctcttgtttgagcagctatcgtgggcaattattgcaacaagtatt

SEQ ID NO: 261 - DNA, 799573 bp, Homo sapiens
ttttatggtatcaagttaaaaactctttaatatctcaaaatatcttatcagattgaattatatccaatatcaatttgatggctatattcaacacatattaagaacctactgtgtaccaggcatagttttaagtgctagtgatatattggtaagcaaagaccttgctctcatggagctgtggtctggtgggagagacagataacaaaaacaaacacgtatataaatctgtgagaagtgttataaagaaaattgagcagggttatgagaataaagctacagaatgggggatatctcacacaggatggttagcaatggctctgcggctccaggccctgcctactctctcacttttcctcagtttctccagatgtctcaagctcatttatgcctcaagatctttgcaaatgtttcttgtctggatccccttcctcttcctgtcaactttttccctagttacctcttacaatccttcagaactcagatgcaaatcactttctcaaggcctcaaggaagccttctgtggccctccggaacagatcaagttcaggttcctgcttatttaccccactgagctccttcattgtactgatcacatatataattatatgagtattgtttaagcctttgtcccctccagactgtaagctccatgaaagcaaacactgtgtctcattaacttattgttgagtccttaaaactttgtagtttgcggagtaggtaaccaaaaataattgtcaagtatctgaataattttcaatatcccagaatattcaattaagtaagtatggaaggcccctttcaaagcttgcttagaaaacaccatgcttaatcttataggccatctaagtaattttggtaatttttaatgtagcaaaattactcaagttggctttatttggttatgaatatcagtactaacttatgatgtcactatcctttcatttcaaccacgttcagtatcctaagagacatgctgattgaactataatttaaaatgaataatcttttatttgtaaaagattgagtcataaataggcagaatcaacccatgcttttattttcattgcatataaaaatttcatatgaaggtattgatgtacagtactatccccgtgggctgtaagagaggctaagaaaccactaaaagaataatcatttgtaattctcacacacaatttaccactctgaaaatatatccaaagaaataaaaacaactcaaatcagttaaggatgtttttgtaattatagtgtcccctttgtactgtttaaaacaaaagtaatcaaattcctttgggccagggctgctaaaatctacagtttgtgtcaaaaaataaaataaaataaaataaaataggctcatttttcctagaaaaagaatctttcctttcactgaaaagccacatgattcaagggctgggcaagtactgggaggatgtttccatataatccattataaatgtttcctgctttaggggctggccattgtacaaggtgaaattttaaaattctaaagcaatgaaagttttgcagaaacaaatcttagaggatagtgaatgctttctgctatgtaaactgacatcaacccacctttgcgtttaaatagatgggtttacatatatgtaaggacatttggtttatcttagtggaagaaaaattttaggattaaaaaacagtattttctctttaatgtattctcttaacatgtcaggaagctgatgaatagataaccaacacgagtaaactctggctccaatttcaaatcaagtccattttcctatgagctctagaagccaaaaggacttaaaaaaaagaaaaagattgtttataatcactgggaaagaatatatttccccagttgtgtttccgagttaaaaaaaaaaaaaaaggaaataatcaaatgcaagtagctgaagtagttcctgatcaacagatggcaaacaaccatcacacatgcagtgctgctccctggcaagaagtacttaagagcttctgtctcaaaagggtctcagaatctttcagaggttgtctgtggttttgtaaaatccacctattggcagaattctaatcaattaaaagcctggatgtaaaatgcccagccctagctccactgttacctttcaaatgcagcaaaacagaagaaaatattggttaaagttaaggcacagccctgggaccaaagacctgcagctatgtttttttaaatttatatatctttaagtattttatagttttcttgaatcttccataaacaagctctaaggtgacaagactatattacaggagaaaagaaaaatgtacagagtatgtatacacaccattcattctctcaccaagagtttccaaatatatcaacaccatcccatcatgggatgatgttttaataagaacagataatttacaattaacattacagtatgtacattgcaataaatacatggttgtaaacagacaaacaagactgtattacaggtaaggtcatttggtgagaaaaaaaatgcatggcacaaaaaataaataatgcattcaaaaattatcataaagctttctgtaaaatccatttcattcaagttttttctttccttgtctgtaatttgttctatctacattattgtgaattttaactgatataaaacaaaattaaaacagcattattgtgttcagtaacttgcaagctgaaatgcactggttttacacaaacttggacatttttttccccatacagtacccagatattgcattttcttatggcattttaggaaatgtaaagccacttgtaaaaggatattcttttattcttttttaaagcagtatatatttctgaagcacactttggcaagagagaagggcaaggataagcagattgtacagtgcattagtccctgtctcttggatattgagccttttctgcaatttgattgtccattagtgggtatctttacaacacggtaccattaaaaaccaacaaactggaagaaaaaaaaagagcctctctttattagtgcagttataaaccctttaccctttcaggtctggatttgttaatgacatattgctgctttttattttattcattattaagattctaggcactctgtgggggaaatactaagtgtagggaggagaggaatgagaatgttttggaaagaggaataaactctagactctttacctttctttctagacttcactcagggacaaataaaattaaaagaaacaagttcccaaatattcttgtgaaactacttggtcaaacatacgtctttatttttttcttatttgaaagattaccatctgatctttacagaggaaacagagtagaaaccttgcaattaactagttgattcctcttctgctttatgtaaaagatcagagttataaagacataatttttatttcaaaggatctaagcatcagctagatctcaggggactgaaatggggactctcttcagcatgagtcatttgcctggctgatgacttactttccagtccccaggaggctccttgagaagttccacatataaatgcttttcagagttgtaattcttcttaaacgtttgattttccacttgtcagatacccactttggcttctatctatctcaattcttgaatatcaatgtgaaaaatgattatttgggctttaaagtcttcatagagaaggtaaagaagactttattaaggctgacgtggggataaagtcagaattaaatgccccatgatgccaactgctataatcaggtaaacactaggaattaatctctaaaactgtaatacagttcctggtgctgaaatcagccaagagtgatctctaattttttatttaaccagaatttttaccaatataataaatattttaggatgcatcacagtactaaccctctggtgccagtggcatcatcttctttccctccatgtgtttaaagaagtagttcccctctgcaagatatgcttatggatcgaggataagtgataaaggacttcctacacgttatgtggctgtccattaaggaagagtagttgctacacttaaaaccgtttctcagggatgttcctgatatagttcttaatcccatggtgaaatcattaaaaccaaataggattagttgtattggtgtttgttaatatattgttaatattcttaaaaactgcctagttggctgtttaacttttctctgtaaaccaagagtaaaagctagtcatgatatacaacctcgtggttgaaatgaatgttaaccctaacttaactacctgtttcttttcaccggtgacaatggtagtgatatatttgacaagacctcatctagcaaacatggataaggttcagacacacgctaaattataaagcagcacaaggggaaaaacctttttcttactataactggctgtaaaaacaataaaaatgagcatgaaatgtgtggattattagagcatgaaatgtgtggattattagaaagacatgcacttgtgaaatgaacatctagtgacacagcaaaacgttattaggagatactaagtaggaaaacatctaaaaaagactgaccattttagctactgggtatttatatatctcccacttgcttcagacaacacgaactgatgactgagtttgcatgaagcttaagacacatttgatataacacacataaaagtattatagaacaaatagtcactttgcacatgaagaaaaacactggtgaagagcaactctgcttatctggaaagagtgaaacaaaatgcaaagtaaataataaagacttacaaaaagggtttcctgcaacataaagttgtttttctcttttaaaatatggaagtcattggtatataaaacaaacaatgaatcactacaaatcagttaattgctatgaactataaggtgcaagtaaaattcataaattagatttttatccagtgtagcacagatttgtactgaaaacttgcaagttactccttagaaaaaaataaccagtggcagatgaagttctgaacatagttttttttaaatataatacctcaatacatttaataataaaagtaagctctacaaaaaatctgttttacatatcatacaaaatgtagaggtcagtgcagctcactgaaccacactattcagtcatgtatcaggaagacttgaaattagaaaattatgcaatttctgtggctcatcctcctcctactggtaacagattcgtgctatgtcctgttcttgacatatttgttgcttcgtccattaagttcactctgtgcaatgcctttcttctgaaaatattgcaaacaaataaaaaggaatagaaaccccaagtccaataaacttttgggctgcctgatgagtcacactctcttgaaaataatttggagtagattttatctgctttgtcagctctaccaagctgaaatcttgttaaaaacgctgttcgtgaagatgtccaccttgctcggatgacatggaggtgaaaaaactggttacgatattcctgagcgctggactgagtagtcaaggtcagttttgttcaacaaacgtcctggcagatgacagtgaggtgtgaccgtggttgtggcatgtgacatgcactttggaaacaatttttctacttaaaaaaaaaaaaggcatgaaagtttttgcactgttacgtgtcaggagaacgatcatctatgacacaggcttcaggctggctttcctcttcttcccctactgcctcctcttcaacctgttcatcaaggggaatttcagtagactctgagtcttgagtacaaagagtcttggagtcactgcagctagtgtcttcttccacttgactgccactgtccttttccgtgtctgactcaccatcttcctctaaagttagttcaaactggaatttctcagtttgaccctgccggccctcctctgggtcatcaggtgcaggagaggggctctgagggattgtgctctggtaccattcacgattgtcctccaaagtgtccaaaatatcctgggcgtcagggtggacgaggtctgcccatgtctcccagaggggatgaacaatatagtctatgaagcccacctagttaagaaaaaaatccagtatgagtagaggacttgggactaagaaacaatggaaaagcttaattagatcatggcccacaaataaaacactgaacagaagactactaaacttagtttggtaaaattgtcactattttcaacaacaacagaccatttaaagtaaagtattgctactagctggtcaaaattagcttctagaacctttggttaaagagcatgttctatagcataaaaaattttccagttgttgacatggtagggcttattttacaatcaccaatttgtaggtgaatccagataactgaaataatgccatgtgctctatgtatatgaatatattaaatgaatatagtcataataaatgaatatgtctttagaatatatatatgactatatgaatgtaagtcataagaatgaaagttctttggatcataaatactaaggtgaaattgagcttgtcaaaaacaaagtaattttaaaaatccagtaaaatactatcatatgtaatacaaagtaaccaaatgctaaagcggtagctctgttctctctgaaagctatacacttcatgcattacctgtgatttttccacggaagcattgtgcttgtcacacatggggcttatctccatgccacgttccctctctcggtctccttggcggaagaactcctccattatccggtccgtccactggcggtacagctggagaggctttgttgggttgctcagatctgcacagtgcaccatattctgaagaacctaaaatagatggatgcattctctattcactcctgttccttttttttaaaaaaaaaaacaaaaaaaactagaaattcacattggatgactgcaacacttaaaaatacacgtagtgtaagatttattccaaacagctcaaccatgatgtgtctgtgtatagttcacacttgtattaatagttccaaattatgccacttctactgcatctaaatagcttaagagaaactgtttatgtgcatggctgactagattcagagctgcttaagtggctggttctgtggggtgtttgtttgttagtttttttaattaatgtagatgcaaacagaaagaccagtagaattttacctggttaattctcaggaataaaaatttggataaaaatcctgcctacaattgctgaaagtataaggtgggagaaggaagaaatacatcttatcaaagctgaacacgcagacatgtgcacatgtgcacagacacacacacacagagcaaactcaaacaaggctttacctgaatcctatcggaataattatcaagaagaagaactccagagcttgtcactttcttagtttcaaccatagtcttcaaatcagccagtagattcatgtgttttgacatatctgttgcaagtaccttaaaatatagagtatattattaagttcagagaaaacagaatttacacatgaaaatattacgcagaatataagaatgaaaaaggaataaaacaacactatgccttttaatgacagtggaaaatccttactactccttgggggcagagtcttttcccctttgctatcaagttttcccaaagcccagataaatgtgtgtaatatacagaaatgctaggcactgacaaccactttcatggtgaaaaatgggtgacatctccatggataagacatcatcacaagtttataagtttttgaaagctagagattttcctgtgtctcataatcactgaataagatgcatagaaaaaagagtaaagtcatggatgtctaaatggcactgtctactgatgagaaaaggtggggaaaaaatccatttgagctgtggcccacacaatctgcttttgttagtcatttttctctgcccgccaccagactggaggggcccagaaaataaatgatgagggtgagctgacattattctcaagtccaaactgctagaagtgaaaaacctattacagaacatcacagccagcatcacgggcagcttctataacataaagggccataatatgttttgaaatgcagttccttttacctaatactcatcttgttcttatgtctaaattataaacaacttgcatcacagttctcttctttggcttttatcagctacttacgatgtcaatgaccattttccttaaagattgtctttgttttttggtcaaattctggaaaatgtcacagttttcttcctgaagcaatttaaagcccacagccaaatgatggttctctaagactgaggaatcattgtacatcaaggcaagttcagagtctgtaaaaaagacaaaaggccaaagatcagcaaaactgtttgtgagaagtttatctgattcttaaaattctggatttaggatgtaatttcccctaaacttctctgctgcccttatcattacctgacaatatccaggagagaataaatcagataacataagagcaggaacaacactggaatgaatcttggggagtgaattctaatgctactaacatgtggcaggtcatttcactctgtaggtctcagctttctctaaagtgaaagaattggatctttaacctctcctctagagttgccatgagctcagcagaatatgacattattcttagtatctataacacatccagagcataaggttttgtattcctgataactgtgaattacctaccctgcactatataaagtgaggatcctgtgttacaggattgtttgtactcaaagagggtacaagaacaataaggaatcatatgaacaagtttagatttgctcatttgctcatgtatagctctgaaagtccaagctttattcattgttttccattttcttttccaagtatcgtggcagtcattgtatactgtacagggatattgctcttcctgcctgcttgctcacagcttcacagtgatgttgtgtttggctgtctgtataccctctggtgaagattctgccactctctccctactgccctagacctgtgaattttaggcagggagagattctgcctctctcctacttcttgtaaatagcagacccagagctacaagataatcattaaaaaacttttgatgctttattctctttccacttaatcactgtaaagactaaaagcaaatccgaggcaggaggattgcttaagcccaggagttcaagaccagcctggtcaacatagggagacctcatctcgacaaataataaaaaattatctggggatggtagggcgtgcctgtagtcccagctacttgggatgctgaggtaggaggattgcttgagcccaggagttcaaggctgcagtgagccattatatcgtgccactgcactccaaactaggcaacagagcaagactctgtttcaaaaagaaaagaaaagaaaagaaaaaggttaaaagcacaggtatttgatcttttttctaacgaatgcatagaaaatatataacgaatgcatagaaaatatatttggaaatatatatctttttttaagaaagaaatacccaatactattcaatggctattttaatggagctaggaaggagaggagaggcttaagacattttcaactgagaaattctattattttatcggaactatagaaatacaaatttgcacacttaaatttctgctcccaaactacaggagcagagctgtttagactagtagggagtaggtttgtacagtatttttttgttattttttgttttctttagataaaacaatagtgtttatcttttaaaaggcagtttctggtgaacttttatagtgtctataaatgcctttatgaacctttatctacagataggtaagcatatagaaatgaaaaatttaaaactatataggttcttagcacatattattgtatttctacagtggaatcaaataaacaaacatatattgaaaggaaggcataattattagatactggataattattagagttcgtttaaggaaggaaatatgcatgtagacaagcagtgttaacagaattgacttagccttacaaaaaccctaattggcttatatgaagctgaaggtgaaggaaattaaggctgttgaccctgcaaaagaataagatgatgagctcttccttcaaggaaaagggtgatctgttgtatggaaggtgcaacaaagagtctgagttctactggatataagtagggcctttcatgtagggcagatgtccaagaatactggcaaggcctgtcttggagagtggttatctcctgacacttaaagagtccagattggctagaaaagccaggaaaggatgccttagtggactggcaggcctccatagcctcttccatctcagatgctgttacaggaaagtggtggtgactgttgatttttaaatgaacaaatgttagcatttaagaaactgaatctcaaggaagttatttaactttctactcttctttaggactgaaggcatatggtcacatttaaattgggaggtaggagtctgcagctcctcagcagattttcatcaaagacactaatccattacttgtaagtagagtccttgaaggttcaggaatgatcagaaagttgctgtcaggatggtacagtgcacagcacagaggggcaaagaggttagcttatataacatttttgttgaaaccctttcatcttcaagcccaatataagttacctcttccatcaagtctttcttaattaccagatgaaactgcccactttctcctgtaaacttctatactactttgtaccacccatttagcatgtatcgcattctaccttttttgtctttatctctacaaatcttttaatcgttcctccccaaaccctcccaacctacttagagacttaagcccctacaaaatattaaaggttattaatttaatatgtttggttatctggcttcccctaggcacttcaattatttcaaacttacaaagtacaaacaggaatacagcaaggcacaacatttagaggatttaggtgccattgtgttaaatggtttatgtgaatcatctcatttaatcctcataactcttttaggaagatactgttgttatcgacattttaaggctatgttccattcatggatggcatggagccatataggtgggaagtaagtctttgtgtccttgggataggctgggggatagaaaatgtcccttggggacatcttttatacacataaatatttacatagacatactcatataatcctgtacaaatgaagaaaatgtacctcagagaaggtaggtaactttgccaacatcacctagccagtaagtgctggggccagcacttaaaaccaggcagtttctagagccctcaccttatactgactatgattacaagtaccttatagaggtgaaaacctgagcagtgaacactaaacatgaaccaggaaatcaacacagtccactcagtgcctggcacacatttataaagacaactttgtaagtatttattttttattgagaggccatgcatacctttacaaactcaaagccatcattttattatatatagatcaattgtgctcatttgttacaactaccctggatcatcaagaataaattaaattatgcccaacatatgctactactgaaggcaggaagaccacttttgtgtccctctcttctgagtgctaatgaaatggggggaagggtgggcaggtactaccacataactgagaacatgtacttcatctgtgctaatcttttctctctctgtattaatcatggttctccagagaaatagaatagacatatgtatgagtgtgtgtgtgtatgtgagaaaaagacacatttatttattataggaattggctcaggcaattatggagtccaagaagtcccatgtctgcaaaggtgaaccaggaaagcaagtccaaaggccagagaatcaaccaggaaccctgatgttagaggcaggagaatatgtatgtccaggctccgagaaagcaaattgcccttcccccaatgttttgttcttctctttgaggtcctcaatggattgactgatccctgccaacaatggtaagggcaatcttctttaatcagtctaccaattcaaatgctaatctaatctcttccaggaacactctcacagacgcaccccaaaatagtgttttaccagctatctgggcatcccttagcctagtcaagctgacacataaaattaaccattacaaattctgccccttgtcaccctggtacccataagcatctcctttaaccatatttaatctccataaggccataattctaccaaacaggctacaactatcctgcatacaactaaaagcacactaacacattccccagaagtgaaagtaaagtttttgagtaatgtttactcttatcctgatagcctataacttaaatactatgatataaaataaatacttaaatactaatataaagttaatacctcttatgttatataagggaataagaaaaagaaaatgaagataagttaatacctcttatgttatataagggaataagaaaaagaaaatgaagatatatgcttaatatatgtatatatacatataaatgcattcataagaaaatactcatgacaattatagtccttatttctataactggtcatatggtcatagctggtatttgtaattaccttcttttactactcattctgtattcccttttccctcagcaagcacctcagctggtcatgattctttacctggtggggtgaccgaaaccttcattcgtgaagggtatgggttattagtggtcctgcctggattgggttattttgtgctgaccttaattacagggcatggttaatactaagggatgccctaagggatctccttattccacacatactcttccttaccttcattgtggagtagtaacccaatttccccttggtagtcaggatcagtcaccccagtcaacactgtaatgcccttcttggatgattgaatcagatgcataaggagctcaaagtggctaggtcttaacttccagttcaacggaatcactgttgtgtctcctgatagaagcattcctccttctgaaactaagacctctagctagcagcacataaatttgcaggaacaggaagcaaactttgctagtgggtcactgggggtaattatgagtcgtaacagtcccatttctatccaatgattcctggacccatgaattctggttatgcgagaaatagcaccacatattggatgctgattcagagcatatatggcctttatggccttctggagaaccttgccccagccctgcaaggtcttgcctcctagctgagtaactgagtcttcaaaaggccattctaccaatttatcaagccagctgattcaggatgttagggaatatggtaagactagggacttccatgggcatgagcccagtgcagctcttctttgccagtaaggtgagttcctggttagaggcaatgctgtatggaataccatagttttggcagaaaaactgcagggaaggcacatctgtttccagagaaagtgccttttccactaaggacaaaatgctaccctttccaccatggaagtggtccaatgtaatcaaccagccatcaggtagctggctgatccccccaaaatggtgttatatgggggttcagtgttggtttatgctgctggtggattgcgcacttagcaatagtcatagccaggtcagccttggtgagtggaagtccatgtttctaagcacatcctgccacctccatccctgccaccatggccactttgttcttagcatgttgggtgatgacaggggtggctagggaaccaagttgactagtatctacagaatgggtcatcctattcacttggttattaaaatcctcctctgccaaggtcacactttggtgagcattccttttttgtccattcagagagatcattcacatatctcttccccaaatttctttctcaccagttttccaatcatattccttctaagtccctcactatccagacaaatcattggctacggcccatgaactggtatataattgcacatatggccattccctcttccaagcaaagtgaacaacgagtcaccttgcctaaagttcttcccactggaaagactccccttcaccaccatccttcagagatgtcccagagaggggcagtagtgctgcagctgtatacttccggtggtacctgcgtatcacgcagaaccatccgtaaaccaggccctctgtcaactacttgcagggaactttccatgcgaccacatgtgtaggctgggagaaagaaggcagtgtaattaataggagtggcattagggccacttctttatgtaatttgtgcctttagtgtctgctcggacctgatagatcgtgtattacactacttttatttgatgatgaaatgtcgtacatgcccaacatatggcttggcgcgttagataataccctattaatgatgggcagacagcttaaaccacatggaaacttggtggcccatagtcagtcagtatctcctaaggcccagcagcaggcctatatctttctttcaaaaggagagtagttagttatctttctttggatgatggcagggtcttgctccagagtctgtgctgtgattcacacagagggctctgtcaaaggctccaaacaacattcctatctgccactgacatttcaagcaccattaaatctgctggatcatgtggcccatgtgcagagcagcttgcacagcaggctggacctgttgtagagccccactcaaaactagcagtttttgtgacactctcttgttctgtgccccatctaaactagcagcttttcagatcacttagtaaatgggccagagtaacacacacaaagaaggaatacattgcctcccaaatccaactaagtccactaggtattgtgcctttttgtgtcttatgatggagtccacatggcagatcagagccaatattaagacctggagctgaaacagttaagactggggcagacactatagatatgtatcctgtaagtaagacttacactcactgttcttacagctttactaggcttagccttgagttagttagaaaatgacagcatgctacaccatgtctctaagttacaactgaaataaacataaatcttcaaaaggacttcagaaacaaacatttctccatgaaatgacagagggaagtggtggttttaacttaatattcagttgtcaagaaaactgcctcattcatcactccactctctatgccctcaccctgcattattttcctccatagcacttagtaccatcacatgccataaattcacttattatgctccaccttttctagcagaatgccagctcttaagagccagggatttgtcttgtcttgtccacccatgtgtcctaagtgcctgaaataatatttattataacatttagtaggcttgcagtacatttttgttgaataaaataatctctgtagctatatctatataatcacatttgataaacatgaatttatccttattttgaaggtgtgggtttatacagaaaaataaaattctacatacaatctactagtgtagctatgaaaattttaatttcaaaataaaagtagagaaataaaaaagtgtatactgacagctagatacatcttaaccttaatataatgaaatgcctctgctcttggaaaccaaaaaccgcatgctttgaatgcatcactaatgtgaataaatctttctgccccaaacttaggcatctttgctattaacaaaaataattcatttgccaagtaaaatttaatgctatattctgtacttttgatactttttttcagaaaataaagctaagttaaatataccctccagcattttatattcaaaagttcatgctgctatttacattttatggatttatttatttatttatttatttgagatggagtttcactcttgtccaggctggagtgtgatggtatgatctcggctcactgcaacctctacctcccaggttcaagcaattctcctgcctcagccacctgagtggctgggaatacaggcatgcgccaccacacctggctaatttttttgtatttttttttgtaaagacagggtttcaccttgttggccaggctggtctccgaactcctgacgtcagtgattcacccatcttgacctcccaaagtgctgggattataggagtgagccactgcacctggcctatggatttatttatatgcatcatcctttaaaaatatttacgcagcttcctgcctgaaatttcaatttctctaaatcctgttcacagtacccacactcaaatcatttattatagcttaaccaactctaccaggtagaattgttctctctgcttgcagaacctccagcatgctttcaacgagtgtaaatacaattagtataaaatcatttggcacctaaagctaaaacaactgaaataattaagaaaaacgaagagcacatgtaagaagcaggaggattaactgccctgggaaccagccaagggaatccccagcgccccccatgtgccttaagctctcagtgcttccgtagcttccttaaagtaagacaagtaaccaactatgggtttataaatttgataatcagaggtctttagaattctttattatgagaaatatggattcagctgcaggctttggacaggatggcagctccagctctgaggcaagagctgagaatgtgctggcttgacacatggatgctcaagccatccataaaatataaaaagtcaaattttaaaaaaggtttactgcaaactaaaaataagcacaaattttgataaaatatttcacgaagctacatatcacaagtttacaagttattagaaggattcctttactgcatgctgggaagataattctcttacatgatccctagccaaaccaaactaactaaggctgtaattttgataatgccctggggcccggaacaaccctgggatactttcctgtacaaagtgacaatgctgattcattccctcaggaataacacagcctcatcacacctcatcgtcaaaaaaactttagcaatccaaagctactctggcaactgtgaacttccctatgtcgctgtggtcacacagaaaggagatcattgcaatattactaaataacaaagaaagaatttgcagcggcaggattagttatccttccatcccaggcaggtcaccagcaaaatgactttaaacagacatcctaaggagataaaattatcttcttcagtttcctccactatttcattggttctcaaactttagagtatcagattcatctgtagactgaggccttgttagcttaaatggcagactgcacagggaccctgatgccagggtcctccaggtgccagtcaaagcccaagtgccctttaaagcaggggtccccgatccatccatcggctgtggaccaatatcggtccgtggcctgtcaggaactgggctgcacagcaggaggtgagcagcaggcaagcccgcatcagtactgcctgagctccgcctcctgtcagatcagcagggacattagattctcctaggagcgtgaaccctactgtgaactgctcatgcaagggatctaggttgtgcgttccttatgagaatctaactaatgcctgatgatctgagatggaacagtttcatcccaaaaccattctctccctgcgcccccagtttatggaaaaattgtcttccataaaacctggtgcctggtgccaaaaacattggagactgctgctttaagggctcaaaagaatgaagaatagagcaggtcctcattacccttaaaaaatgtatcagagtacttggaagacagtgacctttctatcagttgttttaatttgtcttctaaatctactcttaattctaagggaacatataatatgctatataacagaatgcaaagaaaacataccagtttgaatgtttggtgtttaagatagatatatatatatacctttaacacaaaaattttatgtaaaaatacattttatgtatttactaaaaattgataaaattcagaatatctcaagacattcataagcatcaaaataaatcaggccaggctcatgtaaagtgccagcatgcactgtattgcatgacctccctgctcttcttagaaaggacataatgaaccctccccactgatacctccccactgataccatgtaaatgcagggagctgcatccaatgtatattaatatttgtatgtatgctttgatgagttctaaaagtacctcattataggtgctcataggtaggtagaacatgaaatgttatcctgtctaatctggataaataagttcctaaactaaacttgtaaaaaaatacttgactaaccacacatctcaggaaatccctgacttttccagtcctctacatggatgagtcattagagtatattttgctataggatagtccagaggccattataagatataaaaataggtaaataatcctaaagctctgaattaaatctctcaaagcaaggttacctctacattccttctttaaatctggctacagcaaagtacaggaaatgaatggtgaattcataaataattctatagctagattgctataggcacgagaagactattattcatagcctcaagcaaaaatgaaagaaaggtggattcttaagcatacaacattttcaacaactttgcatattttttatatataaaagtgaatttatgattttataatctaccataatttataatctaccatatgggagggaattaagtcatagttcacttaaatcacttaccaattaacttcaagtaccaaatagaatttctataaacctaaatctctttaccaagggatagctcaagcattacctaaacattccctacacaggctttctgtgcggcaatgtcagagatgctccatattaaacagtctctactattccttatatttccaaattcagtgatgacttcttataaggtgagatgttaacagtgagaaaaaaccaaatggttgaaaaaatattaagaagttcctgttacccttattagaagattttaaaaaggaaagaacaggggttgggcatggaggaggaagggaagctatggcctctgaagaggattaaatgatgacctacataaagtgaggaacacttaccattaattctcataactttttttttaatttaaaactttagggccaatacaactttctaaatctttctgcacactttcatttttaattacccttgtctagtaacacagcaatatattacttttaaagagaactggaacacatttttcaaatatcacatgcctcaagggatataatgataattttcagttaaattacattaacatgaactatcactaaaacacatatatacacatctcaaaagaacattatggctctggaagactctgagtttataaagacccttagtcattctaaaatgtacaagggaaaaatgtgttctgaaaaaataaagtttacttacttgtattgatcagaaattgattggacacaccaggatgatctacatcatgtattgcactggcaaaaattgctgcaagaatctccaaatctgtaaacacagcctggaaaatcagacaatatagataatattactattctacaatgatatgaattaaaagtataaacaaataagaaatctctagaatttaaatggaaaacaaaatgaagcttcaaaatgtgttacaatgtgtcaagggagagtcttagatacttgtgaacttttaaagtataatcttggaagaaaatattttatctaattttattacatctcatgatcaaatgttttccattcactgtattttttaaaatattattttaaaactctgaaattattttaaaagaaaataatagtttattttctaaatatttaagatgtctaagaatattctgaaaatgtacataaaattagtaagacattagcaattattttctttcatcgaaaccagggtttctcaacttcagcactattgacattttgggcccaataactctttgcgtgggaggctgtcctgtgcattgtaggatttttagcagaattcctggcctctaccaacaagatgccagtatcatgtacaactaaaaatgtgatagttgtgacaaccaaaaatgcctccagacattgccaaatgtccctggtggtggcaggagggaaagaaaggggaagagaaaccatctccagttgagaatcactcacccatatgatgaggtattaacataattttataatgaaaacaaactgaattataaaatatatttcttaagaaaatcaaattgctttagtaaacaactaatgaaataacttcttaggatttagaaaaattaaagtatgtccttctaatatattctatgaaaaaatatcaatatattgcttatgttttataaaacgttctttggcctataaataaaagccgtcagactagatttcaagaaaacaaatgaacaaaaagtgagtaagccagatgtgctttatgaaatgttcagtggatcatttcaaagaagcaatatcataaacagatcaatcactaaatctgtgaccaactttcataagcaaaatccatcaaagacttgattgtctattaactatagcattttcccccataagtcaataagttatacttccaatgaatccaattatcttctccattgaaaacccttcagataaaagtttaatagacctttatgagtggcaagttagtgttcttgaaatttcagaaacagatttacctccaaagcaggtgtagataatagcacatgagtagactggacaacatctgcagcatggatattgttgtgataggccacatcagcatggtaatggtcttcgagagtcataagatatgtaattaaagtatctactggaattttaaatgtttttaataaatcccgttcctgtaggaaaaaaaatcatcttaacatttttgtctttatgtgaaaaatttctccatagagtatgtttaaaaaaaaaaatcacacaccagtgttgccagtggataacctggaaatggcaactgcactctcacatgtctagtgaggaaaatgggaacctctgagaagatccagggactctgggacaaaaccagagttgggttgtcctgctggaacccaagaatactacgccctagctgtatggtgtcaggaatgaggtgccaactctaaaagtttctatgtcccattatcatggaggcagctccagtcaagcactattaactcaacccctgcatcacaccaactaaaaatcaacgtcctctctagggctgaagtttcccatttcggtcccgagatatctacagcagcctcaacttctcatttaaatcccaccctaagctggagcaaagggtcaataagagagagaaatggatatgaagaaagaagcaggacacaagaaagtgactgaaaaaactatattctaaggttagtagccagcaggggctttattcattttttttaagttagtactccattctctatgcagtcaggttcagatgactaagatgatgtctaaattattattttaataaattgcttcaatttggctatatcacatctttttcttaaatgcaaaaaaaataacaaaattgatgttatttgtggtttatccacactccacctttctgtatctttacttgtcccttggcaaaggagcaaataaggataaaagtataaaaataagcaaaaggtggggaatattaaaaaagacaaaatgtatgcataagctacagactggacattaagttcctaaataaaataaatgtaatagaactcaaccaccttacctgaaaaatggtgtgcatgataacagtcaagggccggttaccagacaactctgctattctgaaaacatgaagaccccatttgttcacatcttctagttcctggagtgaaaaaaaaaaaaagatactaaaatattagaaagtggagtaaaatatgactcaatgaacacaatcatttaaaaattacagaccttaggtggccgggcatagaggctcaagcctgtaatcccagaactttgggaggctgaggcgggcagatcacttgaggtcaggagtttgaaaccagcctgcccaacatggtgaaaccccatctccactaaaaataaaaaaaattagtcaggtgtggtggtgtgtgcctgtaatcccagctacttgggaggctgaggcaggagaattgcttgaacccaggaggcagaggttgtagtgagccaagatcgcgccactgcattctgcaatccaacctgggtgacagggcgagactatgtctcaaaacaaacaaaacaaaacaaaacaaaacagacttcagtgtaaagattgttagattgttttaaacaatgattcattttaaatgttaacagacacaccatgtaagcataggcaaactttaggcacatttacttaaatgtactgaaaattgaacagtatggcttaaccttgtgactttgacattacaacacatttatgtactttttaagtatcaatcacaaagcacttctttaatggataaaatctattcacaaaaccttaactgttttcctaaaacccagaagacatgacagatttctaactctttaaggccaaacaatgaaatgaagatgcaaataatcaccccccaaacccctaaaacataccaaaccacctgtctaaggcactttaaaaggagctttataaaatgccttcccatcttcaaaaaaagaaaaaaaaaaaaccccaattaataaacttttctatccatttaaaagactagaagtgaaaattcatgaaagggcatcatttaatatttatgatcctgatctttgaaatcatcataccttggcaaggacatcttcttgttcagttttaactccaaaccttgggatacttgaattagtcagactagagctgtgcatcaatttcttgactccactgatctgagacattggtcttttctttttctccttttccttctgagttggagaaggaatttccacttcatgttgcttatcttgagaaatttagaaaatgttctatatttattattaattctatctgttttatatcatatgcataattggaaggattataattgatcattatatattccaggaaatgtttccaactaaaaagtttccttttagagagttcagtatttacatttgaattggacttaatttgatgtcttcaaacacaaaattaagcaaataagttccattacaaaataataatatcaaatgtattccatggttacctctttgatacaatgtcctaataaaaaatgctgcaagacttagcatgacagcagactcagaatacacaacaggtggttatttccactgttcaattccattcctttgtgaaactgacttaatgaactgaatattgttcttgccaactaaggactacagtttcaatacatactttgaaatggtagaaactttatacgcaaatgtcatgaaaacagcagtatataaaactaacagctaactgaaatgggtaacactgtgggagctgaaacagcaggttttggatgacttagattaattctgctactttttatttctgtatgatagtgagataagggttaaatccccaggttttatgggagcatagagaatcataaatattacctgataagtgaatacgtacataagctaattgtgttctatagtaaaagacctaagatatcttcttactttcatccacgatttcaaggcagtgatgagcaactctaactcatccttatatatagaacatattctaagtgtttaataaatgttaactatatataacagcaattttgttttgaaagtaagtccaggatacattcaaattactgacctttatttactgcattttctttctgtggatgaggtacaagagttgtcccaggacaccaaactcagctattattagcaaacttttatttagcaattgtattttatctgcccaccagtttactaggcttgatgtacacaagacggtaaattcatcgagggcaggaatcatttctaatttatcattaaacacctattgcccaacaatggctggcatttaataagaatttgttgaagatatgaatagatctctctataaaatatattttacagtttggtactatgaaaaaatggcaatatataatcttaattcaagaattcctaaagtcctaaataaaactaagaaaatgtaccttgtcacctgcaactctaaaactcagaggcggatagtgtcgaattattaatatgacgaatgaaaacaaatagaacttctaacacttgtttggtttccaaaatgagttggcaccccaatcctcctacaaaaacaaacaagcaaacaactgaagaaaaaaatttaattgcatgttgttattctcacctaagaatgtgtttgatataaactctgacacttgatttccagaccgactcatttcagagagatgggtgagctcccgattaagcatccttttaaactgaaaaacagaaaagtaaaatgaaataatagaagaggaaaatttaagtgaaatatatatgcatactctgagatacaggaagatatgcccaaagaatttttaagttgtcctgacaatttagaacagtgccttccagcagaactttcttcaatgaggggaaaacaccataatcggtgctgccaattatagcagtcactagccacaggtggttactaagcatttgaaatgtggctagtgcaaatgagaaaccaaattttgaattttatttaattttaactacttttaatttaaataatcacatgtggctcatggccaccagactgaccagcacaaatttagactcccaagggctgaagggaaaatcaggagaaataagcaaagaaaagggaattaaaaattaagatgtattattagttatttagagaagagagaaactaatttatagcacataaaagtgttgccatacaataaaacatggaatgctttcttcaattaatttatcattagcagaaatgaatatatatactgatcaagggctcaaaatttagtcttttactccaaagcaaaacttaatagacttgagtactcttccaggactatggagaagtaaaatatttaaataaatactgtataatgtttccttttaaaagttgtttttcaagtaagagtataacacttattgtttctcaacatccacaaaatttaccattttcccaagtcactaaataggaaacaggtcaattttcaacaatctacttcacagtttttattactgatgccatagtgcctatttcattgaaagaaacactggaattaacctaccaacaccacatggcattaccagtatccaaatctcccaaagattttacacttctcccacccccatcagctgtttcttaagcattaagcatttcagagtcctttgactctgaaaacaacccgacgaggccttttaataagcctttaatatttgccttaatatacagaaacaatgtattttttctacacatagagtaactgctattagatacttgacaaaaaaaagtcagatgcatttactctaatcatcagattagcctttaaaatttgaaatttcaccataaattctcatttaagtatgaaggtaagtgttgaatgtatattttagtgatgtttgaaatataattcttagtatttaattatttagaattattttgcttctctgcataattcataccaagatggcctaactctataccgtttgctaaataacttccaaagtcaatcttatagaccatctagattaagttttaactccgcatttaactgttatcaaaacaaacaaaaaaccctcaaccatttcaatggactgttggatgagagaaatgtgtattcgcatgccagcgtagtcaaaaacaaagaactcgtcatttacattgggtgtatctcctaatgctttccctcccccctccccccaccccacaacaagccccaatgtgtgatgttccccttcctgtgcccaagtgttctcattgttcaattcccacatgtaccctagaacttaaagtataataaaaataaaataaatgctggggaaaaaacaaacaaacaaacaaaaaaacaaagaactggcatgaccagtacaaattctggttgttaaattactggtctagaaagcttagtctcaaactcaggaacactaaattcacttctttgttcatatgtttttataactcctttctaattataaaatgtacatgtgctatagaaaatgtagaaagctataccaaaaaaaagaaaataatgtaaatccccactgctggaagataaccacagataatttgttaaatttccttttatgccttttttctacccttgtatgtgaatacatatttttaaaactggcatcaggtggtatacagaacataggttactgcttgtgttcactcagcattatatcttataacctactgaaaaaaataaactttgggccttctaagaatatttgtagacatttataatagagttcaaaattttttctgtccctctttacaaagttatattttcttgagtaaattatgggctatcatataatttaatgagctaatatagaagtgtcttctatttagcctggcacatagtagatgctcaatattatttgagttctttctcccagctcactttctggcacttggtccataacttttgggccttttaaagtaatagctgatttttatcattgcaggtcagacagatgaaggatttgactgtagttataaccataaaaatagttacttaaatagctagctcctctttctcaaatcccataaagaatttggaatagcattagtatgggaaaccatagctatgtctcaaaagcacagctaaaatgtcatgcatacacaggtttaaaaaactctttgcttaagacttggagccaacccaaatgtccatcagtgatagactggattaagaaaatgtggcacatatataccatggaatactacgtagccataaaaagggatgagttcacgtcctttgcagggacatggatgaagctggaaaccatcattctcagcaaactaacacagcaacagaaaaccaaacaccacatgttctcactcataagtgggagttgaacaatgagaacacatggacacagggaggggaacatcacacaccagggcctatgagcgggtagggaggggaaggacagcattaggcaaaatacctaatgtagatgacaggttgatgggtgcagcaaacgaccatggcatgtatatacctatgtaacaaacctgcacgttctgcacatgtataccagaacttaaagtataataattaaaaaaaatttgctttacagataaattcacacttggaaaaatatactcattaggcaaagcatattccaaagaaaagagtctgctaaacattttaaacacacattcaatgaaatatctctttgacctaaaattgttcatgttatgagctaaaagttgctattaagaactacctggtcatgacaaagtcttttttttcataaaagataggagatgaggcaaagctttcaccattgctagaatctcagcagtctatacaggaactgctgccctccttgcacttctctcaataaagcaaaacaagggaagccttctgggagtgattgataaagatagatagagacccagttatcacaggtttatcttctaacttgtacacaaactagtataaggattatgttgcccaaagagaacatgtggatgctacctgcagatatgctacatatattattggatttttctaaaagaatataaagaacgaagtataattttcctggcagtttgcttaaacaattcaccaaaatagccagttagtacagataactgaagaaaaaagccagtgaaaggaatctaaatattgtacagactagataagtgacatcctgcatgttcatctttctggtcatatacattattcccagagtactttccagcctttgtttaaaacacaaaaacatggattggagaaatcctccatcacatgcccacctccctaccaaggcttataagggactccaaggaagtcaacatttcattttaacataattataaaagacaatatttgaagcaattacttctctactctaggaagacggtctaaggaatttcctaaagataattctgaagcgtacattaagttataacacaagggtattttctaaaaggaattaacattgttttccttttttgctatccatataaaagtttcagtccagcaaagctaaatgaataaccacaaaaattaccataagtgctttctcaactggtagttgatctcacaaattggttttggagtgcatagctagatgtactaaaaaaatgcactagatcattcaacaaacatttaaaaatgtgatacttctctcatctaaaaataattatataatatttactaagataactacataaaattaccaaagggggaaggactgatttaaagctaatacaatgtattcttctgggaaatcccatcatatttctcaattaatatatttagaagggacaaaacattaaactgctgtttgaaacgaaccgattgtaaaatgcagaaccatttaagcatttagtttatttttttaagtgacctctaaatattttccattgatgaatttctaattgtttttggcctaagtagtctgaaaacaatacacagatttagggttgcaactaaaaaaacgggaggatttctaagtgaatgcttttgaatcctttgttctcattatacatcagaatgtctgtgtacagcagttaaggcataaaggaaagtaaaaatgcagttgaatctcaatactgtattttgcttttcagaactgcaattcttcaatttacattaggcatttaagattgttcaggaagcaaactaaaataataaaacaaaatgtccttaaatgtaatctcctttacttctacatcacgccagtgtgctactgggtatattatatatcctcccaatatatatttaaggaggtggtatgggtccaatagtaagaaaattttcttattttttcctgacaatattctgctaaaaatcatttgaatatgctgcactgtgatgcattacaagtttggtagatatcagtattcaaagttatttaaacaaatactccattgatggtataaaaataaaaccttcaaaatgcataagaccaaatatatctatatttgctatttttacatgtttttaaaggtacagtattaaacataaagctgtccaggaaaaattttcctcaaaaagaaacgtactaaaattctatatgtagattcttggcaatattgttcataatcatagtacaaatggttcataatcacagtacaaatgtgaagcccttcaaaaataacatcagttgtgagctggctaaaagctaggagctgaattctggcggataatgagggcttcttatatttactctctatacttttctgcatttctgaagatttttagccaagaaatggctaacaaaattcaaataatggaagtctatatattttaaaaacatttttaaaaatctgaatcatccacagatttaaagggaggtaaggaatcatgactacttggacaaccaagactgaaataagttttctaatttttttagaattcaagtaaatctctaaaacaaaggggaacttgtccttcaaaaagaaagaaacaaagcaaacgacaaacactccaatctgaaaaatcctcagagtaacagaaaatgaatcttttaaaatgtgttgtgattggctcccaggttcaagcgagtggctcaaataccaaaaatctgtgaagtgatgtttcatttaggactgaataaggtttttctacctccttctattgtggagacaggatcacaatgctaatgttaccacagggcatggaaaaagcctgccaagcatggacacaatcttattgaattgtttattaattcatttcttgagattcacaaaacagtgtaataaaaactttgttcagttttgcaagtataatagacaatcaagttttcactttagtatcacttacatagttaagtaatgtcaatttttaatgtcacctagggctttatagctaaaggtgaaaaaaacgtattcctcgtcaggttaaagtagtatagatttttagaaacagccacaaattaattttataaactttatgtgcaacatactaactggaatccataaatcagtataagtaatttggcccaataatttatttgcaatgaatgtatttaattaccatatatttttcaagcacaattcaaacatataccacatgacaaacagaagaactactgcgtatctaaaaaagctattttaacactcaaactacaactgatgaaagttatacaatcttatcttgaccactattaacacgtatttcttcctagttcatgtgtaaggaaagaatacataactgatagtttgaacaaattacagtagagtctaagctttctaaataattttgtaatcagagtaaggagttttcaaaagctaagtaagtcttacctttatgtagccccaagacactgacagtaaatagtttgcttcaggcatttttgattgattatatgtatatatatatatatgtatatatatagtaagctctaaaatgtatttagcttcaaaatctcgacactttaacaacctccacaagccacgcagagtatgagtttttaaagatttttggtaattaagtatacataagaaagcctcgcattaaatcccatccagccgtcttcccatcgaatacatgccatttgtaagactccagaatggcacaaaattcagcaactattctgaataaagaaaatccacgtgataaaggaatatctaaagatctaagggtctgcatctttctctcccgagctccagggcttaatgaataatgtatgtcaagatgcttagttgcaagaaaggctagtcctgtcaaaagctaccaaataaggaactgcagggaagccgggaagagtgacaagaagcccctcccataaaaccccaactctgcaccaattgcattccagctcttagcctataaggcgagggggtgtggcctcggtgcaggctgctttgggattggttggcaagggccagcctctggggaggctttctcctcacccgacaaacgccattgaataatggtatccctgcagctctgaggccaccctgagaaaagatgaacggggcttccctcttgcagtgatgaataatgaccataaaactcctcaaaattcgtagttcattcttaagaattgcccatccttttggagggcattttctatgaattttaatgtcctctggcttcccttccttccaaataaaaactgctccaaaaatggcaatcgagcattttaattgcttccctctctcaaatccaaaacaagtggctccctggtgatgtagaaatgactgtagttctcccctcatccaacataaaagcatagggattaaacaatacgactaatgtccagaattcacagatggcacagatggcaatgacacattccctcacctgtgtgccatggctgctctcagctccttttgtttctattgttatgtatgacagagttctaaaaccttcaaaatctaggggtgggaccacttgcaattctggggggagggaaatgtgaaagctagggcactgtgtatgcataaggaatgcagtgttttgtatatagaactcaggatctgtattttgatcagaagagaatattttatttatttatttagagacagagtctcgctgtcgcccaggctagagtgcagtagtgcgatcttggctcactgtcacctctgcctcccgggttcaagcgattctcctgcctcagcctcccgagaagctgggattacaggcgcccaccaccacgcctggctaatttttgtatttttagcagagacgggatttcaccatgttggccaggctggtctcaaactcctgacctcaggggatctgcccacctcagcctcccaaagtgctgggattacaggtgtgagccaacgtgcccagccagaacagaacattttaataactgtacacaaagttaagaaaggaatgagtggctcttaggaatccagaattgagctcaagagtaatcagacattttacgaggagggttaaatgagaaatcaaagttctttctagaaaaacagcattttctatttggtttggtgtagtattaccctgtaactttaatactaaagaggtcttgtgggtgagaaacaaggaaaaactaggttttagttgattttagcatataattctgtgcattttacctcctctccatctcaaagcctgtgcttactactctgtgctttaacttgctggtatggctactctgcagtcttcctgacatttaactatttccacatgtggcatgtctgtcttagagagcatgctctctgataagcactcctgtaacactgtgtctctctgagtttctattggcctttagctgctacagtcctctgcttttgttaacatctgttgtattcatttccatcactcttactcctctacaaaaggaagaaattaaagctccaacattccactaaagctacccccagaggaatactaaggtcctccttttctctggtctccctacttctctgaagtgttccacatgtttgatcattcctactactctccctcaactcccaggatcctgaacttctttaattttccctaggcccacaatcttcaatgaccacttctaacttgaacttcagtgccatatttctgaatacaagattctcctctcgaatgccctgctagtcacgacaaactttttcaaaactgtgagacatttttctatttaaagtagttcttagtataattacttccatttcagtcagtgagcctatatttcttccagtatctcagatggaatctatgactctttcctaccattcaacaggtgtttcatgtgcgtcagacactgtcaggtgtttaatataaaccatctagctgaatccttgagtaacccggcatgttcccctatacggcatcaccttccctccttcattcaactttgttagcaagccctatcttttatccagagctgtttctttcagtttattccttaccattacccctcccgtaatctgaatccaaatatttaaaagactgagagaaatagaaagtaactttaatatcaccccctctaactccctcatttccacataaagttgagacctagagagaaaaaatgattttcccaggttcactctggtactgagaacaagaattgcaagtttaaatcttttgtgcacaatcactgacaaataatctttttagtgtgtcagcttcctcatctgtaaagtggattactgtggcagctagtctccaaagatactcttaatgagccacactgtcctacactgaatctgagttggcttgtgtaaccaacaagtgatggtgcatgactgctgaggctaagtcataagaaatcttgcagctctcatcctgctttctttgaatgtgctattgggacccctaagccattaggttgaaaaaaaaaaaggtctgactactctgagaggctatgctacaagaagtccatgttaacttcacagacagtgaagagagaaagcgcaagagagcacttgcacaagaaagagcacacatgcctggccagtcttcagcaatgccagccaccccagcccagagccagacctgaggggcaagaagccatcctagccatccagccagttcagctttcagatagctacccactgggctgcaaccatatgaggaatgccaagcaagaatgtctagccaagaccagttaacccacaaagccatgaaaactaataaaaatacattcatatttcaaagtattaggtttgaagtgatttcttacatagcaataaataaccagaacagatacatatgaggattaaatgagaccatatatgcaaagcacttaaaacaacaaatggtacaaagttgaagataagtaggtatcagacagtaaagatgacagtgacaatgatcattatgataatcattctattatactaatatttaaaaaaattctctggtttgtcatttgtttttaaaatatatatgttatatttcctttcaattgcatcacagcactccatgtctcagggccaaaatgctgtaattgcttcttagctcatcttcttgcccctggcttttccccttctagtctcatattgacctctactgccagatcaattttcctcaaatccagccgcagcctgttacttcaaagctagtaatgcctgcttcatcacatccctctgtaaattccagactgccatatctgaccttaatccccaacgccaagcctattttcagctgctctattacatttgctctgttcctgaaagactagtactcctccaccttcaccatacagctgacaatcccatctctgtcttaccaaattctcggcctaaaataccctccttcttctactctgccaacctcaaactggttttctcagtcagatttaaatcattcaaagtacatcttaggaccaaatattccagcctttttccaaattctaacgattctacatctgccccttcattcaatatttattaagctcctactctatgtcaggcactgcctgagaaagagaaacaaagctttctcacctgcagcttatattccaaaactaagttaataaatacataatacgtcatggggtgataagcacaatggagagaaagaagggataaggattacggatagaggttgctataaggtgatcatggaaagcccctctgatgagatgacgtataccaggagatctgaagaaaggaaacaagccatgtggattgcggggtgagaggtagggtagagaagggaaaaccaagtgaggaatggcaaaagcaaaggcctcgaggcaaaacatacttggtgaggctccctgaagaacaggtggaagtgtcataccacttgtcatttaaatgcaaattacactctgcagtcaggctcactgccttccccctcctttaaaaaaaaaaaaatccatccatccatcaattttattctttgacaaacttaagactcagttactttttactttttataacaagtattcatcctgaaatgaaattcctaaatacacttccttcataatactgtactgaatacatataggctaaatactccctacatagatttaaaaaaaaaatcagtataatggcttatcagtgaaataaaggagaaatgagtaatttctatcaaatactacaaaatataaatacttgtacacaactacattttaaaaagtagtcaaaaactactataactgattagctgtgtgaccttggggaagctatttaaatttcccatacttcagtttactcacatggaaaatgagaataatagtttctaccttacagggttgttgtgaggattaaattagtgcatatacataaggctcttagaacagtaagtgctatctaagggtttgctatgatttctcttatggggagaattaccacaaaagtaacagtagcatgaaaatgaatacaggggtgttatgttagaaaaattttcctttttcctgatatgatgaatgattctttgaaaggtttcaaatgtaacaaagtgccatcttcacaatatacactattgctgcattactagaaaatttggtgtggattaaaaccatgtaaaaatatttaatacttatacgtaaaaagtagttgggttctaggctcagagaattataaatgcattttgttttttcacctatgtgaatagctgctgggactttttggaagttgtgtgggacacacagcaaacctccctggtgaaaggctgtcccatgtatcccaggacatctagcctccctggcctctgcccaccaagcaccaggagtactccccagtcactgtcccctgaaatttcctgaatgttccccagtgttaagaatcactgttctatttttttcaactgtcttcaactttgactcctcatccagggtggaggatctttgaggccagaaaagtatcttattatgtccctgtatttctcaaggtagtgtactattgccacaaaaagattgttggctgatgcagatgcaaaacatcaatatttttatactgattataggtgacaggaaaggacaagggttttcaccctcagcaaaatcatcaaaaacatttaaaacagattacatatagtagataatactccttgtcttaaaacattatgcagaaacacacatacagtttcccttccctctaaaatctgcagcctcttctccctgctgaatgtgagtgatggtcccttcattcaacagacttctatttggcaactattatgtgccaggcattctaataggtgctggatgtgaaaggatttaacttattcaaataagtccctaatttgctgcaataagggagattatttaatcatattgagtaaaaagtaccaaggaaagtttccatatttctagggaataagaaatcttttcaaaaatctctgagccaaattaaaattcatttcattttccctaatctccatttctaggagactagaatctccttcctattgccacggtagctgctatctgcagagagaatctagataatttagaagagaaatttgaatagagccagagagatacaattcttatagtcagacttggcttcaccaaatttaatgaagaaactttaataagttacaacatttactaggcacctactatgcacaaagaactttacatacctcatttctaatcttggcaacattctgataagataaatattatccctattttaacatgaaaagatggaccttcttacatattcaataacttgctccataggtgacaggattgaaatgcaaacccagtccttgctcttaatggtgtatgacagctcatcatataattaggctgatgcaaactctatgataaacagtatgaatctaggagtggatttgtttatcctcaatctttttgctaactttacagtgccttgaattaaagaatcatggttactatcaccatggtcagatctctggacagggtgaggaagcaggtgcccacaggcagacagccctgccatatagtgagacacgcttatgtttgggagcgctatgtgaacaacacacagctgccctcatatgcagatgtaatgatgacgacacattcagacaaggaactgaggtccagaaaagttctgacaacacaacttgagggacagcgttacagctagagctcaggtttcttatctgtaatccactgctctcaaatgcccaaatgattttatatacatatatgcaagtgtgtttgttgaaatagaaaaaatagtttcttggcctggtgaagtgcctcatgcctgtaatcccaacattttgggaggccaatgcgggaggattgcttgaggccaggaggtcgagaccagcctgggcaacatagagaaaccaccgtctctacaaaaaatttaaaaattagccaggtgtggtggcatgtgcttgtagttccagatactactgaggtgggaggtgggaggtgctgaggtgggaggatggcttgaggccaggagtttaaggctgcagtgagctatgattgcaccactgtactccagcctggatgacagagcaagaccttgtctcaaaaaagaaaaaaaaaattcccataatgttcagttagttctctttttcagacttttcctagaaatacccctcagaatttctagaggccacttccctgctattccttgttttctcagtccttaccagatacccaagcaattaacaatctttttgaactatttcagtacatttcaggatatttgaaattctgctgatggagctgaactgctgatacattaacacatgctgtcattattgactttgtaacagaggtcaagagagaaaagatgcatttttgaatagggaaaaacaaaactaaattatggggaaactaaggctcagagaggtcaagttgtcttgctcaaggtcacaaagccagtagtaagtaacagggccaggatttgaacccagactgtctggtttcagagtactctaaattgccaaaaaaagaaaactatttcaggcattattttatatttagcctagagcctacataatagatccgttaatataatcaattctaagctgtatattatattactgtgtttgaaatatttaagaaatattgtttaaaataagtgtattagctcttggacctctccaacataaggagttttccaggcagtagcactgtttgcagtaggacttacattattggaaaatattttatcctataatcaatctacatttattttacacctttcaccttaaaattaaaagtcgtggtagttattaatcaagaagcaaatctatataacgtggtctctcatatatccagtactgttcagcttgaacaaatgcaaatctaatttttaaatgtcccttgaagaattctgaggcaaagttaaacttcaagtattaaacagaatagccacagaaaactagtgtttctcagcctccctttgctttcaaatgccttaaaaatattttagaggcagacaataatctagaattgattcataaccaatattttacataacagaatgttacatgtattttcatattataaaaactatactttctttgattaatgctagtattctgaaaacatcgttagtgccagtaaatccactaaatctgtttgtatttactgccctctagtgataatggctctacatttgattaagaaaaaactattcctttcagtaaatgaaaacatctcttgtaagttttatggagatttgagattaagaggaactccaggctgcttttttaaaaccaaataatcatctgaacaagctgagaatcgttctctaaatgatcttattttaatttttttttaacaaaaaagtctcatttaaaatagtaaacacctgcaacatgtatggagaaaggaaaccatttttgctaagaggctccttgaagctgaaataacatgagactgatctgatagctgtatttatatttctcttctacatgggctaactctcttattagatgttagcatagtattctgtaattgttgatacagtttgaattcatatatggtagagacagagttttgtataactatttagtcaatttacctaaaaccagcagcagcagcatatctactacagacttttgtttcactgaagaataatcatgacaataaatgggtgcaaaaacttcacataaatgaagcctccacaaaaataatcttgtatgaaaaagtattgtctccttatagagaaaattaggatctccaattcacttaaattggcctaaatgaataccataatcatcataaaatagttactaatgtcccctctgtacttcgtggtatgctttgtggaaacaatttaaacaaagagaatatctgtctcctaaagtaataataactagtgtaaataggcatgcttccagaaatatataatcttttacacatatcactttaatatgtgcatcttaaaataattttaagtaataaaatttgagctataaaagagaaatgatattcttttcaacaaagaatgcttgaacaattgagcatccactcataaaacaagaaacttcaacctttatcctgcaccacactaacatctacttgaaatgaatcatagaactaaatgtaaaatctaaaactaaagaacttctagaagaaaacacagtagaaagtagttgtgatcttgcgttaggcaaagatttcttaaaccacaaaagcatgaagcataaaataaaaaatggtatactggactttaccaaatttctctttgaaaaaaactgttaagaaaacagaacaacaagccacagacttgagaagggaatatgtacaaaatgcatatcaaataaaggacttgtatccagaaattattttttaaaaaatctttacaacacaataagaggacaatccagtgaaaagatggtcaaaagatttgaacaaacaaacacttcataagaatcaaaaagatcaataagcatgtgaaaagatccatgaccatcattagacattagggaaacaaaaagtaaaaccacagtgagatgccacactacatacttactagaatgtataaaatacaaaatacaaacaatacaaaatgctggcctggatgcagagcaaattaaattctcatacattgctagtgagaatgcaaaatggtatagaaactttggaaaaaggtttgacagtttcttataaagttaaaaagtagagtgaccatatgacccagcaatcctacttctaagtatctacccatgagaaatgaaaacatatgtctatataaagacctatatgaaaatgtttatagcaactctctatagcagaaacccagaaacagttcagatatcagtcaactggtgaatgggtaaacaaattgtgtccataaaatgacatactggaaaaaaatgaaatactaaaaagcaataaaatgaaacaaattaccaatagatgcaataacacaaaatgtattataagtgaaacttataattcaactcaaaactcaaaagtattgtaagtgaaagaagccattcacaaaaggctatatctttaatgtattattcattctggcaaggcaaaaccatagggacaatcagcactggacgtggggtttggggaatgactataaaaagcaagagaaaactttttgggtggtataaatatcctatattatatagtacatatatattataattacacattacctatatatctagattatggtggtggttatccaattgtacacatttgtgaaaatgcattcaactatacctctagaaagagtaactcttatgtaaattatacctcaaaaatctaactttgaaaaatattagctgatgttatcaaattatttcaattccagatttgcttaactttacaactttgcccaaagataaatgcaaaacaaaaacctcaggcatagttatgtatgataaaacaccatttttaccctttcaaagagctccaccattatttcccagaaaacaggcatacagttatccaaggtccacattagctttaatgatacaacattcagtgaattcccagttgtgaaaagcctttaggttggcagggcgctgtggctcatgcctgtaatcctagcactttaggaggccgaggcaggcagattgcctgagctcaggagtttgagatcagcctcggcaatatggtgaaaccctgtctctactaaaaatacaaaaaattagcagggtgtggtggtgcactcatgtaatcccagctactcgggaggctgaggcaggagaattgcttgagcccgggaggcagaagttgcagtgagctgagatcgcgccactgcactccagccggggtgacagagattctgtctccaaaaataaaataataagagaagcctttaggtgataaaataatagtcaaagtattcttttaagtattattattttatttttttttaattctttgtaataaaaagttccataaagtaaaatattgtccttttttgttttatttttatttgtatcaattcaaggggacaggtgcagtttgttacctggacctgatttttaaataaatcaaactcagtttagttatttcatggtgatcctgggagactgtttgtcagtcatcatcgaatagcgaatgagtatcctttgtatgctcattctaggctgtaagtaccatgtcagctgatggagacacaaaaatccaataaagtaggtatagctgggggaggttccaagatggccaaataggaacagctccagtctactgctcccagcatgagtgatgcagaagacgggtgatttctgcatttccaactgagctttgaaaagagtagtggatctcccagcatgaagtttgagatctgagaatggacacactgcttcctcaagcgggtccctgacccccgagtagcctaactgggaggcacctcccagtaggggccaactgacacctcatacagccagatgcccctctgagatgaagcttccagaggaaggatcaggtagctacatttgccgttctgcaatatttgcggttcggcagcctctgctggtgatacccaggcaaacagggtctggagtggacctccagcaaactcgaacagacccacagctgagggtcctgactgttagaaggaaaactaacaaacagaaagggcatccacaccaaaaccccatatgtacgtcaccatcatcaaagaccaaaggtagataaaaccacaaagatggggagaaaccagagcagaaaagctgaaagttctaaaaatcagagctcctcttctcctccaaaggaatgcagctcctcaccagcaacggaacaaagctggacagagaatgactttgacaagctgagagaagaaggcttcagacgatgggtaataaacttttccgagctaaaggaggatgttcaaacccatcgcaaagaagctaaaaaccttgaaaaaagattagacaaatggctaactagaataaccagcatagagaagaccttaaatgacctgatggagctgaaaaccatggcatgagaactacatgatgcattcacaagtttcagtagccaattccatcaactggaagaaagggtatcagtgattgaagatgaaatgaatgaaatgaatgaaatgaagcaagaagagaagtttagagaaaaaagagtaaaaataaatgaacaaagcctccaagaaatatgggactatgtgaaaagaccaaatctacatctgattggtgtacctgaaagtgatgggagaatggaaccaagttggaaaacactctgcaggatattatccaggagaaattccccaacctagcaaggcaggccaacattcaaattccagaaatacagagaatgccacgaagatactcctcaagaagagcaactccaagacacataattgtcagattcaccaaagttgaaatgaaggaaaaaatgttaagggcagccagagagaaaggtcgggttacccacaaagggaagcccatcagacttacagctgatctctcagcagaaactctataagccagaagagagtgggggccaatattcaacattcttaaaggaaagaattttcaactcagaatttcatacccagccaaactaagcttcacaggtgaaggagaaataaaatcctttacagacaagcaaatgctgagattttgtcaccaccaggcctgccttacaagagctcctgaaggaagcactaaacatggaaaggaacaaccagtaccagctactgcaaaaacatgccaaattgtaaagaccatcaaggctaggaagaaactgcatcaactaatgggcaaaataaccagctaacatcataaagacaggatcaaattcccacataacaatattaaccttatatgtaaatgggctaaatgttccaattaaaaaacacagactagcaaattggataaagagtcaagacccatcagtgcgctgtattcaggagacccatctcacatgcagagagacacataggctcaaaataaagggatggaggaagatctaccaagcaaatagaaaacaaaaaaaagcaggggttgcaatcctagtctctgataaaacagactttaaaccaacaaagatcagaagagacaaagaaggccattacaaaatggtaaagggatcaattcaacaagaagagctaactatcctaaatatatatgcacccaatacaggagcacccagattcataaagcaagtccttagagacctactaagagacttagacttctacacaataataatgggagactttaacaccccactgtcaacattagacagatcaacgagacagaaaattaacaaggatatccaggaattgaactcagctctgcaacaagcggacctaatagacatctacagaactctccaccccaaatcaacagaacatacattcttctcagcaccacatcacagttattccaaaactgaccacatagttggaagtaaagcactcctcagcaaatgtaatagaacagaaattataacaaattttctctcagaccacagtgcaaagtagaagttgggattaagaaactcattcaaaaccactcaactacatggaaactgaacaacctgctcctgaatgactactgggtacataatgcgatgaaggcagaaataaagatgttctttgaaaccaatgagaacaaagacacaacatactagaatctctgtgacacatttaaagcagtgtgtagagggaaatttatagcactaagtgcccacaagagaaagcaggaaagatctaaaattgacaccctaacatcacaattaaacgaactagaaaagcaagagcaaatacattcaaaagctagcagaaggcaagaaataactaagatcagagcagaactgaaggagatagagacacaaaaaaaccttcaaaaaaatcaatgagtccaggagctggttttttgaaaagatcaacaaaattgatagaccactagcaagactaataaagaagaaatgagagaagaatcaaatagatgcaataaaaaatgataaaggggataccaccaccaatcccccagagatacaaactaccatcagagaataacacctctacacaaataaactagaaaatctagaagaaatggataaattcctggacacatgcaccctcccaagactaaatcaggaagaagttgaatccctgaatagaccaataacaggttctgaaattaaggcaataattaagagcctaccaaccaaaaaaagtccaggaccagacagattcacagctgaattctaccagaggtacaaagaggagttggtaacattccttctgaaactattccaatcaatagaaaaagagggaatcctccctaactcatttgatgaggccagcatcatcctgataccaatgcctggcggagacacaacaaaaaaaagagaattttagaccaacatccatgatgaacatcgatgcaaaaatccttaataaaatactggcaaaccaaatccagcagcacatcaaaaagcttgtccaccctaatcaagtgggcttcatccctgggatgcaaggctgcttcaacatatgcaaatcaataaacgtaatccatcatataaacagaaccaaagacaaaaaccacatgattatctcaatagatgcagaaaaggcctttgacaaaattcaacaggacttcatgctaaaaactctcaataaattcggtattgatgggatgtatctcaaaatagtaagagctatttatgacaaacccacagccaatatcatactgaatgggcaaaaactggaagcattccctttgaacactggcacaagacagggatgccttctctcaccgctcctattcaacatagtgttgaaagttctggccagggcaatcaggcaggagaaagaaacaaagggtattcaattaggaaaagaggaagtcaaattgtccctgtttgcagatgacatgattatatatttagaaaaccccatcatctcagcccaaaatctccttaagctgataaacaacttcagcaaagtctcaagatacaaaaccaatgtgcaaaaatcacaagcattcctatacaccaataacagacaaacagccaaatcatgagtgaacacccattcacaattacttcaaagagaataaaataccaaggaatccaacttacaagggatgtgaaggaccttttcagggagaattacaaaccactgctcaacaaaataaaagaggacacaaagcttatagataggaagaatcaatatcatgaaaatggccatactgcccaaggtaatttatagattcaatgccatccccatcaatctaccaatgactttcttcacagaattggaaaaactactttaaagttcatatggaaccaaaaaagagcccgcattgccaagacaatcctaagcaaaaagaacaaagctggaggcatcatgctacctgacttcaaactatactacaaggctacagtaaccaaaatagcatggtactggtacaagaacagagatataggccaatggaacagaatagagccctcagaaataataccacatgtctacaaccatctgatctttgacaaacctgacaaaaacaagaaatggggaaaggattccctatttaataaatggtgctgggaaaactggctagccatatgtagaaagctgaaactggatcccttccttacactttatacaaaaattaattcaagacggattaaagacttacatgttagtcctaaaaccataaaaaccctagaagaaaacctaagcaataccattcaggacataggcatgggcaaggacttcatgtctgaaacaccaaaagcaatggcaacaagagccaaaattgacaaatgggatctaattaaactaaagagcttctgcacagcaaaagaaactaccatcagagtgaacaggcaacctacagaatgggagaaaatttttgctatctatccatctgacaaagggctaatatccagaatctacaaagaacttaaacaaatttacaagaaaaaatcaaacaaccccatcaaaaagtgggtgaagtatatgaacagacacttctcaaaagaagacatttatgcagccaacagacacgtgaaaaaatgctcatcatgactggccatcagagaaatgcaaatcaaaaccacaatgagataccatctcacaccagttagaatggcaatcattaaaaagtcaggaaacaacaggtgctggagaggatgtgaagaaataggaacacttttacactgttggtgggactgtaaagtagttcaaccattgtggaagacagtgtggcaattcctcaaaggtctagaactagaaataccatttgacccagccatcccattactggatatatatccaaaggattataaatcatgctgctataaagacacattcacatgtatgtttactgcagcactattcaggatagcaaagacttggaaccaacccaaatgtccaccaatgatagactggattaagaaaatgtggcacatacacaccatggaatactatgcagccataaaaaaggatgagttcatcatgtcctttgtagggacatggatgaaactggaagccatcattctgagcaaactgttgcaaggacagaaaaccaaacaccgcatgttctcactcataggtgggaattgaacaatgagaacacttggacacaggatgggggaacatcacacactggggcctgttgtggggtgaggggagtgggagggatagcattaggagatatacctaatgtaaatgacgagttaatgggtgcagcacaccaacatggcacatgtatacatatgtaacaaacctgcacattgtgcacatgtaccctagaacttaaagtgtaataaaaaaattaaaaaagtagatagtcccaaccgctgtattctttttgaatccttttgccactgtttcatatcacagtttttttttttttctgagccctagattatcagtctgttctttttttttttttttttttttaatgtagtccataggaatctgctgcctcacggtcagtatcgtgccccttaccccaattctaatatgacaggtttttgtctaagacagcatttcctagaatgtgttgtaatgtacagcagcttcatgtgataattctcaaagactcccactgtcaaatgttagcatattcaaggctctgccaggacctgtaatacatattctttctttattctgtttaacttagcatttctgaaacctatcttactactgaactcttgacatttattaacaaacaaatacaaacgaaaataccagggttccaagtaaaattcttatataaagcaaagggctttaaacatcagagttttttagaatggttattcactcatgcactcaacaaacacttattacatagtatgtgccagcataggggatacagtaataaacaaaacagacaagttccctgttcatgtaaaccttggacttatggggcaaaaagacaataaacaagcagacaaaaaaaaattacaaacactctcaatgaaggaaaagagggtaacatcgtacattgatgggggactataaaattaagtagtaaggaaaagctgcacttgagaaggtggtatttgggaagagactcgaatgcctagaataagccaaccagatttggggcacagcactctcaacaaaggctgagtaacacagccagtctgagggaggacaggtctacggaatgagagccgaggcaagtcaaggcaacatcacgtgggtcctgagggtatgagccttccagagggtgtgaggataccattagaaggttctgagcagggaatgataggatgtgatttacattttgtaaagctgtctctgtagaggatagtttgtaaaagtgcttgaggcaaaactgacaagacttgaagacttgcacaacagaactgaagaaatgagaagaatcaactcctagacttctgggatgatcaatgtctaggatggacattggtgccatttgcaagatggagaagaccgggggaggtacggatttaaaggagggtatgtaaggagaaagaagaatcctatgagacaagaccagaacatgtaaatacatgaagttttggatttcttactcttcaaagacattttacctcctgtccccgaagttcttcacagagttcaggataagaaaagctgccagacagttgagttttgaataagtagtaactttcaaacacttgaaagacattatattagaatagactacatccatcaaaatacttaaaaatgtttttagaatagtccaataatttggaatatgaaagcctaagaaacttccttatccaaggccgcataatataaccaaaattagaatttagtactcctagttggcaatatttttatgaaattactgttttactaagacattttagaaatgaagactttactgaaggcaataataagtgcaattaaaagtggtacaataataagacttctttttcatttgcaacaggttagtagtgtatgagaattatgagatgtaaaatagtgtagagcataggcttctctagttggcttcatgtgagttcgaatcttggccctgcctctcttaccagcaatgaaatatgcagcattttacttaaggatactgggttgtatggagagaatcagagttaaggttggtgatccagcagtgtcatgtgtcaggagctaataaattgtattgtgaccagaaacactgaaacttgttataaggaaagcaatctaattaaaacagctgcattaaaatttctacaatatcttcctaacagcttatgctatcaacagtttgtaaactatcagaatcacggatactggctgagaatgcttttggagatttcaaattggcataattttctcagaatgcactgatctgacaaatgtacagacaggcagacaggaatactaccactcttcatgaataactgtctgcctctcctggatttcttccatgttgtgtaagtctattacactttgggtgaatgtagctttagtacattgagttaatatcattcttgcaaagaagctctttataaattccttaaacttaatttgactctggacacaaacaaatgagaacaaaatacagctcaaggattaagatccttaaccaaatatgtaaaaaacacgaaaagccttacaaacagtgatcaacagttaaacatgcgctatcaccttcccctaacagctagggaagcatgtatatgaatggaacatatgaacttccatttggtgtactaagaaaacacatcacgcagatggcttttatagcttcccaaataaggttctaataattcacaaaagtgttgttccctaaaacccataataaacaataataaaacctaatgtttattgagggtctactatgtgtcaaggagagtcctatgtactctcctggaattacttcatttatttctaataataacctttaatgagcactgtcactcccgtttcacagatgagccttaaggtcttagctatcaactttgcagacaacacccaagtaaaatcctgccccctctttttttttttttttttaaccagaaatccagtcctgacaactgaaagcttatagggcatttccgcttagatacatagccttacctaaattatatgtctaaaaacttaactgtcatattgtccagccctcccccaatacccaactggcttctcttcatgattttccaactataattctgtccattattcaggtttagaatttcatgctttcttctggctgtggtcctgccaagtcttatgtatgctgtcacccttctctgtgcaatctttctcctactcattcctctcttttcatcactatcctatttcaggcccttatcactcttacacctaattccctaacggtttcttcttgctttcagtacaatttccccttgatataatctatcctgcacactaccaccagatataaccttctaaagtcaccttattttagtttcttcataatattttccttatagtcaaatgtaagggttcttcatgaattataggacaatgtgcaaatggcttgacctggcatttaagacagtctgcagtatggcctcaatctacatttctcacacctgccactggtcctataatcacatcctctgttccagagaggctcactcctccagaatgcccactaccctcctctccagcaaacatacaataaagcgaatccacatgaataccccatcctaccctgccttatccagcccctggaataccacctcttccctattagatgcctatataaatcctcagtattcaagatccagcttaaggagcactttttctgggaccaatcattctggtcctctgtattgaatactcgaactcctctacaggacaggaacataatgtattattaccctatcattcattaacacacaacaggcttacattatatggctggttgtattttcagaggtatgtctatatgtttcgctatctatctatctatctatctatctatctatctatctatctatgtgtttgaatacagatacataaaaatctcatttcacctataagaacctctggagcagatacatgtcatacaataattgggctaaaacaaaaatccctcagtgaaaacctaaagactgggttgtggttgtttgcagccaaaacgtacaaaatgaaaacctcctaacgatttattttccacatgaaattagtaccagatctagagaaaaatggacaaggatcaaatacaaataataaagtcatcaccaaactaaaaatttcattcaaaagtgatgatgttggccgggtgtggtgactcacacctgtaatcccagcactttggaaagctgaggtgggcagatcacttgaggccaggagtttgagaccagcctggccaacatggtgaaaccccatctctactaaaaacacaaaaaacagctgggcgtggtcatgcacctgttatacccactactcaggaggctgaggcaggagaatcacttgaatccaggaggtggaggtggcagtgagccgagattgtgctactgcactccagcttgggcaacagagcaagactccgtctcagaaaattaaaaaaaaaaaagtgatgatgtcagtaaagacccaaatcagggtcatatgtttaacaccagaaagtttgtatttgctacaagacagaaaccttgacaaaataacttttctgtgctttgttacttcatctgaatgaagaaggtaaaccagttgatctcacaaatctctttctaagggcttctggaatttttttttttttttaaacaataaaaggaaagagacttctcttaagcagaacaaagtccgactcctctgtaaagtggctgacagcaagtggaaaatggaagaagaacaattacctgcaaaatgactcattcccttgtaacaactacactactagggaattccttctcttaccggctgtggctagcgtcagactcatgacaaagacctcatcctggggctagaactaggtttagggttttctcattcattcctctgtttctcagctgcattttcatttttaatctgtgcaatgattacagaggcctatgtttggttttcatttctagtttccccaggaagagacaactactatcttgatattgattaacacttgaaacttctgttaatcacaatttcagtatttcagggaatcagagaaatcatttggaagagccttgaaggtcatccagggtgagagaaaagcaaagcacaagcaacagaccaatgtttagacacagtgaagtgaagacctacaggagaccctctcaacttcaataagagtcttttttatggctgtcttcatattctttcaaagaaatcataataaaggagttagtgagagtgtaaataaaaaataggctatcatagagtgctgggtaactgagctaaaactaaagtaaacaaactcagtgggccatcacatatgcaagctggtaaggtctcataaatcaccatgactgggtattgggatttcaaaggcacactctgtaagctttctcccagccctgttgattcaagctccaattgcactgggttacttatatggcagcatataaagttgaccttttatgtttaaaaatagttccattcctcatccctcctaaggataggccacagtacctatcatatgtccccaccacactacataatttatgtaagttttcacttaattttcaacacaatcctttgaggtagattatgttagtcctgatttacagggaaaacagaggctcagggaggccaaatttatttatttatccaaggttgcaactctactgtagggcagatttatatccagaagaggaattgcaaagctcctcagaatttaggagatttaaaatggaatcaagataaaggttcacatttttcatcttctattccattttactcttccagcatctaataataacctatgatatattagaacaaatcagcccatacttattttgacagtctcttttcaccccatttcagtttgtaccttgctgtctcagagcccatcaaccacctttcctcactcccaggcagccggtccttcaggggatggcttggcagttggcccaccatcctctgctaccagggcatgactcatggaggcaacaggtgaagctgacgccaactattagtgctaaaaaagactcaagcctcatgaaatataccatccataaatcgctctccagtcagctctacccctccctccatttctacagctgactgtctgttcttccttaaacatttacatccgccactgacctgtctgggatttcttttttacttcaaggttctcctaaaggttcagtccaaccaggtttcaccaaatgaaccctgcggtggaaaggggcagcaacgggcattggtcagtttgcctccagccaaggaaagtctgactcccctccttctcccactcttctctttctctgcctcacactgcctaatacgtctttcctctttctctctttctttccttatatcttcattttccaccctattcagaagtgaaacttcccttgccactttgcccccactaagaaaacagacctccaacacaacctcttaacaggctaattttaaaatcatgaacctgcttacaccttccgtgagtttatcctatatcttctctatctgctgtctgcttcccactaaggttttatccctccatcccacctccaaatcctttacagctcagattctcagatctgctttagtcacttggtctcctcatcccactgaccctattatccttctgtgcacatgttagagggcacatgctcctcctaggaactagggccaggtcagttatgctcccatcctgacatgacctagagaacaaaaaaggcaaaacgaggtactgtaggattcctctctaggaattatactttgctgaaattgctcttgctattttggaatctagtgctcactaaatacatttttaaaatattatttggatatattttgaaaatacaaccagaggtcgggcacagtggcttacgcctgtaatcccaacactttggcgggccaaggtgggcagattacgaggtcaggagttcgagaccagcctggccaacatagtgaaaccctgtctctactaaaaatacaaaaaattagccaggcgtggtggcaggcgcctgtaatcccagctgcttgggaagctgaggcaggagaattgcttgaacctgggaggagaaggttgcagtgagcctagatcacgccattgcactccagtccaggcaacagtgcaagactctaactcaaggaaaaaaaaaaaagagagagagagagaaaatacaaccagagaataaacacttgttcttctatctctccatcttccccaccaatacaacatccagaaaatagtcatctttacacttatttagaagcacatagatcttataaaagtttaactgagcattaggttttcatctttaaaaatattctgaggctgggtgcactggctcatgcactttgggaggccaaggcaggaggatcacttgagcccaggagtttgagaccagcctgggtaacatagtgagaccctgtctctacaaaaaaaaaaaaaaaaagttaaattaaattaaaaaacagaaaagccggtctggtggcacatgcctgtggctccatccactcaggaggctgaggtgggaggatggcttgagccagggagatcaaggctgcagtaagccatgatggcgccactgcactccagcctggttgacaaggtgagaacttgtctccaaaaacaaaacaaaacaaaaaacgttttgacatgtagaatactgtttctgggactaaattagagatttaaggtttgaggtatgagaaaatacctggaatcatgccttacattagaaggtaaggtaaatactggtgtttcccaatgagttgtagtcagattgttcatatgtatcaaacagacaatatactgaaatatttaaaaataaggctaaatagcaacaaataatttttcccatgaattctactttttttttttttttttttgagatggagtctcactcagtcgcccagactggagtgcagtggcgccatctccattcactgcaacctctacctcctgggttcaagtgattctcctgctcagcctcccgagtagctgagataacagacatgcaccaccacacctggctaatttttgtatttttagtacaggccaggttttgccatgttggccaggctggtctcaaacttctggcctcatgtgatcgacctcccaaagtgctgggattacaggtgtgagccaccatgcccagctgaattctacttttttttttttttttttgagacagagtcttgctctgtcacccaggctggagtgcagtggcacgatcttggctcactgcaacctctgcctcctgggttcaagtgattctcctgctcagcctcccgagtagctgagattacagacatgcaccatcacacctggctaatttttgtatttttaggagagacgggatttcaccatgttggccagctagtctctaactcctgaccgcgtgatctgctctcctctgcctcccaaagtgctgggattacaggcttgaggcaccacgcccggctgctgaaattctacttttgaaagaacaaattccccttctgtagggactgatgattcagtctgtaatgatgcattctcttcatcttctttttttgtcttttcttctatatatcctttaggcattctactgtattaacactagatagaaaaattaagatttaggcccaaacattatcttctggcataaagtaaactaatcgtttcctgatgtacaataaataaacagacatatttctagtagaagattccttatgatttatcaaaacccaattatcacttacccttatggagatcttagatcttagaaaccatactgacaatataagattaagaaaacaacagaaaatcaaaatatataccaaggataatgttaataggtttcatccttatcacagcatactgttgaaacttacttgaaatatttttttaaaaaagatacaagaggacaagtgtttagtttttaacaagggaggggactagtcaacaaatattgattacctaatttatgaacagctctggccaaagtggtcaaaaaaaaaaaattaggactttagttttcctaaacctatcttaatttttaacaggattatagctttgttcaatctttacagtctttagcctcttttgtgaaatgggtttccttgtaaataataaaatgacacctatatatatttaaagcactcatgaaataattttatctctttattaaaaactgtgataacccttccaattttgaaatttattgtcttcctaaattcttgctacaaagcctatcattaatattgcagttcattttttccctaaagattgaaaaaaacactaacaaatataaagtctttatggtcaaagaatgtactccttttataaaacttggagttgatgtaaaggcacagacaacacaagttaccttaataataaatgcacttttctttgtaattttgggtaattcagtgtgatttgtaattcttttaaaagacacacaatcacttgtatttttgcatggttctttttttcctaatttcccactatagtgaaatatctgtttttccttctctattgggtttggattggaatgatcaggtagaattaaatgtaaaataacaaaaggaaaatactttatagatcttctcaaaatactttgaagggtataatctctttaagatggctttattcatatttaagccaaaaacaaaaagcaaccaaaacactactgtttatacaaaaagcagcttcaaaatcagccagttattttctgaaatggagatggcagacattagcctgcacttactccaatatggcagccgcatctttgcctctttgctatggacacatccccagcaggcctgtactttctactctccagacctgtttatgacaggccaaggtgtttcctattatggtgcctatggctgcacagtgcactgcttgtcagtaataaaagccagaggctgtccctatagggattacagtgcagcagaccagagatgctgatgggaatgcaagcatgccctaggcaaacattgcagaatactctctgacaggcaaaagccaacaaacacatcctttcttcccagactagcagggaaagtattcagttatgtcattttcacttggaacaaactaataagaagaatgttattgctaaaataggtagagatgagaaagagcagtttatgaccatgaatatggcctctatggtttttgcctgtgcactacaaacttttaatttaaacgagatgagattgatctagcatatactatgataaaatttctgagacatgagtatctaaaagcagaactgagattaagtgagaaatgctcaggattcctgtcactgaaagaaaaagaaaaaaacctttcttgaaaggcacaaagtagaatgctcagactctccatctaccaatacaaggtaaaaaacagcatttgcattaaccaacatcatgcattcttgtactaatttatgtgactaactacaaaatgttatattgacactcactgtgtagggtgtcaggatggccaagtggtctaaggcaccagacactcactgggttgggctaaaaacaccgtagaagacctcatcagaacaataaaacagagacacaaaatattgtactaagagttaagagaattacaaataaaagttctgtggaaagtcaaaggtatccaattaggaaagcctgaggtgggagacataggacaccccagatataggatgggaagaagatgggattaaaaaaaaaggctttataaaggatgtaacattccagataggccttaaaagatggcttcgatcttttaaataaaactttttgttttagaacagatctagatttacagaaaacttgtgtagacattacagataattcctatatactctacactgtttcccatttttaatgtctgactttagtatggcacatttgtcacaattattgaaccaatactgatacattattattaaacaaagtccacacttcattcagatttccttagttttcacgtaatttccttttttctgttctggatcccatccaggataccacataatatttagtcctcatgtctcctgaggctcttcttggctgtaggtatctcaggttttccttgtttttgataaccttgacagttttgaggagtactggtcaaatactggtcaagtttcgagggtagaatatccctcaactgagatctgtctggtatttgcctcatgattacactggggttatatgttttcagtagggaaaccacagattaaaagtgccattttcatcagatcatatcgagggtacatgttatcacttatcactgtcaatgttgaccttgataacctggctgaagtagtgataggtttctccactacagtttcttttttttccctttctacactgtactgtttagaaggaagtcaatatgcacagctcacacttacggtgtagggggttatgttctccctccttgagagtagagtatctatagaagttattgggaattccgcacaggaggagatttgtctattttcccccacttaggtatttatttaataaattgtatcaatatgggtttatggatatttattttaccctttgggatataatccaatactatattattttcttgctcaaattgttctagctttggccattgggagctctttcagtttgctcttgcaactcttcagtatattcccacgggtgtagggttccatttgtttgagcaggtccttactttttggcactacaagatgctccaggctcatcttacatatttccttcctgagtccctagaaatcagctattttttttcaaagagtcttggttccttttaccagagaatggtattagaaaccaaaatgagggtgctaagtgtgctcattgctactggggtatggtagcttctagaccctctcggctgatagagcaaggaaatatttgtgtgtatactagatggtaagatgttgagaggtagaatggagagttaccttcttaatatacttttcttaatattaaatattaataagatattgtgtgcctgggttactttcagtcttatgcagaggaagaacgtatgtacattcatttatgaaaaacactggctagactattcttctgcactgcattatgcatttctgctagaaaaagctcagagattttcagatattctgacaaaaatctcaggcttgcttgatgagctatactgtaaaattacagaaggaaacaaagggcaaactccttgaaggatgaaaataaaggaataaaacatataaaacaccaccaaaaaaagtgattaatgggggagaagagtaaataaaacattataatagtcctctttggttagtatcaatattattaggtcactttatcaaaaggatagaaatcaggatggcagacacccttctctaaccctcaccccccaaaataataaaataaaaactaatgttattccttcacatatggaaatgaatgagttctactgagtatctagtatgattcctgactcagtcgagacaattcccatcttttaattcattaaatcaccacagcaactatttaacagatgagaaaactgaagcacagaaggcaacgtggcccaatttacgtttggtaaaaggcagagaatgaatccaattcaggcaggctgtctatagtagggtgctctaaatccacggaccattctgcctaaggaatgaatattttatgaattggaatatttctgctgaacgaatttgccattttctcctctagtggagaaatccaactgagggtaaagaaggaaaaatgttgattgtttaaaacaataaattagtctctaaattgttcttgcagctgatttagactagtgtgtccaaaagtatgcccagtgttagtaaatggtaggcaaaatgctttaaggtggtgcaagatgaatgttttctcattttgttattcattaattttagaaaaaatacagaaaaaatataacttgaacatcaaacctatgatttcatgtataccattacttaagatgaggcacttgggtgagtatttagatttaacaataagttgctcttagcatttctatactttgacaataaattatccaaaaaagaaattaagaaaataatcccatttgcaatagcatcaaaaaaatacttaggagcagccaggcgtggtggctcactcctgtaatcccagcactttgggaggccgaggcgggcagatcatgaggtcaggagatcgagaccatcctggctaacacagtgaaaccccatctctacttaaaaatacaaaaaaaaaaaaaggcaggtgtggtggcaggcgcctgtagtcccagctaattgggaggctgaggcaggagaacggcgtgaacctgggaggtggagcttgcagtaagccgagatcgcgccactgcactctagcctgggcaacagagcgagactccatcacaaaaaaaaaaaaaaaaaaaaacttaggagcaaatctaaccaacaaggtgaaagatctatacactggaaactacaagacattgatttaaacaactgaagaagacagaaataaatgaaaagatatcccatgttcatgcactgaaagaattagtaatgttaaaatgtccacactatccaaagccatctatagattcaatgcagttcctctattgattcaatgcaattcctttcaaaattccaatgtctttttttttcacagaaatagagaaaaaaatcttaaaatttatatgaaccaaaaaaagacctaatagccaaagcaatcttgaacaaaaagaacaaagctgcaggcatcatattccctcatttcaaaatatattataaagctactgtaatcaaaacagcatgttattgacataaaaacaaacatcaaccaatggaacaggatagaaagcccagaagtaaatccaagtatttacagtcaattgatttttgacaaagggtccaagaacacacaatggagagaggacagtctcttcaaatagtgttgggaaaactggatgtccacctgcagaagaaagaaactgtactcttatctcacactccatataaaaatcaactcaaaagagatataaaggcttaaacataagacctgaaactgtaaagctactagaagaaaatataagggaaaatctccacaacaatggtctgggcaatgatttcttggataggactccaaaagcacaggcaactaaaacaaaaatagacaaataggactacattaaactaaaaagtacctgcacaagcaaccaaataatagagtgaaaagacaacccatggatcaggagaaaatatctgcaaaccatacatctgataagaggctaatattcaaaatatataaaaaattcaaacaaccaaatagtaagaaaacaaatcgattaaaattagacaaaggatctgaatagacacactttcctcaaaaaagaaatatgaatggccaacagagatacaaaaaaaaaaaaaaaaaaaaaaaacaatgttccccagccctgcacagtggctcatgcctgtaatcccagtgctttgggaggctgaggcaggagatcacttgaggccaggaattctagacaagcctgggcaaaatagcaagaccctctctatacgaaaaaataaaaagccaggtatggtggcacacacctgtagtcctggctacttgggaggctgaggcaggatcattgagcccgagaatttgaggttacagtgagacatgatcacgccactgcactccagcctgaacaaaagagcaagaccctgtctcaaaaacaaacgaaaactcaacaatatctctaattctcagggaaatgcaattaaaaccacaatgagctatcacctcatgcctgttagaatgactattttccttttttttctcttcaacttttaagttcaggggtacatgtgcaggatgtgcaggatgtgcaggtttgttacataggtaaacatgtgccatgtttgcttcacgtatcatcccatcacctaggcactaagcccagcatccactagccattcttcctgatgctctccctgcacccatcccacccgccaacagaccccagtatgtgttgctctccaccatgtacaatggctatgttcaaacagatgaatgataacaagtgttggcaaggatgtggagaaaagggagcccttctacactgttggtgggaatgtaaattagaaccaccattattgaaaatagtatgaaggttcctcaaaaatctaaaaatagaactaccataaaatccaacaatcctacttctaggtatacacccaaaggaactgaaattggtacatcaaaaagatatttgcactcccatattcatttcagctttatttacaacagccaagatatggaagcaatctaagtgttcatcaagtgtgcataaagaaaatgtgatatatatatatatatatatatatatatattatatatatatatatatatatatagattatacaggccgggcgcagtggctcagatctgtaatcccagcactttgggaggccgaggcgggccgatcacaaggtcaggagatcgagaccatcctggctaacatagtaaaaccccatctctacttaaaaatacaaaaaattagtggggcgtggtagcgggcgcctgtagtcccagctactcaggaggctgaggcaggagaatggcatgaacctgggaggcggagcttgcagtgagccgagatcacaccactgcactccagcctgggctacaaagcgagactccacctcaaaaaaaaaaaaaaaaaaaaaaaaaaaagattacacagccttataaaagaaagaaattctgtcattcacaacatcatggaatggaactacaggacattatgctaagtgagataagtcaggcacagaaagacaaatattgtctttaataaatgatctcactttatggggaatctagaaaagtcgatctcagaaacagagagtagaaaggtgggttaccagaggctgtagaggaggagggagagagaaatggaagatgtcgatcaaacagtacaaaatttcagttagattggaggaataagttttagtgatctattgcactgcatggagaccccagtaattaataacgtattatatgttttacaatttctaaaatagatttttgacattctcatcacaaaaagataaattggtgaggtaatatagatatgttaattagctttactaaatctttctatgatgtacacattttaaaaatcacattatacccaagaaatagatacaattaatatttgtcaattaagaataattgacaaataaattttaaagattaataaaaaatacattaagttaaaacattcaacatataatagcagatatgaatgtacacagaaatgacaaaatcccagcactgtgggaggccgaggagggaggatcacgaggtcaagagatcgagaccatcctggccaacatggtgaaaccccatctctactcaaaatacaaaaattagctgggcatggtggcatgcgcctgtagtccagctactcgggaggctgaggcaggagaattgcttgaacttgggaggcggaggttgcagtgagctgagatcgtatcactgtactccagcctggcgacagagcgagactctgtctcaaaaatgacaaagtttgagcaacattaatttggactgtaaattcttaaagaatagaaaagtcatgtttttcttctaagaaatattatgtttttacattgcaagaaatatgtgacacagagtttttcttaatctctcttttttagtatattctagacaggcaagcacatgcaatttattgagcacccagtgtgtgctaatgcaccaaacggagctttacatacattatagctaatggtctcaataactttttcattttattttcccctttcattatcgccacttataaatgaaaaaactgagctccagagcggtaaggcctattgcccaaaatattagataggaaacaacagagctggaatttgaaaccaagtttgcctaatgaaaaacatttatgttcttttcactgtacaaagctgctgtaagtatcactggtgcctactccaggccagggagtaaatatcattcatccttatcacatacaaagtataacaaaacaaaaacaagaagctctgaatactaaataataataataaatactttataaaagataaactattctctaagagtaaaagataataaacctattgtcattgtagttggtcactgaacttaactaatttcctaatggacgcagcagaattgtttgttgtttaagcaaatatcaaggcataccccccaatccctgttacagggaataaaaaaagtcttcttcaaatgcctttcaaaactaatgtgaatattaaaataaagtgctactgatctctctacattctagaaagatctcagactaacagtgtcaattaaactattacaacaaatagccatgtaaaaactgctcccctactagagctacgctatcacaaaattaaccccagcaatctacagttctagaaaaagagttggtccctcctgctgaaaaagagaaaaccaaaccctacatattttgtgaatccactgaaaataatgacataaacagcactgcacatccatcatgtatttatatcttaagtgatagctacagtctatgtaactatcgcagaaatcttcttaaactgaacaaaagcattatctatcatcctttctctctagaaaaataccagtttgtttaatctacccataacattagaaaaaatacttcttttatcatgggcaatccttatgtttcggaatttttttcgaaaacgtagacagttcataatgctctcagacagaagttaccactactaccccaaatattaagtcaaaatgtaactgaaaaaaagaaatttatctagtaatgattaatttattgaataattaaaaattaggagtttttgataattaaatgttgggaataattaaactttcactaaatactggcacaggaactgaacggatgacaacagagacaagttaagatttgttttaatcctaagttttatgctaaggtaacatcaagggctctacttttcagtgaaagaaaaatttcctttaaaattgtttccctcttccattattacttaaaagcaaagaaagtattttttctaacagtgattataggattctcaatctttcatattaactttaaggtactacatgtaagctacataaatctttcccaaatctacctttattgagtagatgaaaaagcagatatcgaactcaaaacatctaaatgttgattttctataattatagaagatattttcttttgaaatttaaagtttgtatttaggcatattaacacttttttaatctaagatttaatatgttaatgtagaaaacaactgaggctgttttctctctataaaactaacatgccttttccaattaacttagtttccttcttagcaaaagtttaacatttatatctgttgagttacactgtagttgcataatgtggaaatatcttaagatttagccacttctatgaagatcctatatttgttataacacccctcttgcccagaagaaaatacatcaacaaaaagtcctactatatgttctgcattgactattacaaagcagtagggggagcagccagagaaagctctgagacaaagcacccagcaaagcaatttaatttataggcaacagaaacatgctagagaggtttgccaaaagccaaatacacaaaataaattccataaagaagtcatgaccacatttgtaaagctggcctaagtatatttggaatgaagtatagaaaaatctgaagtctcttagaaagggtctggattctaacttcaagacagactttcagcttgaaacacagtcatttccagccatgccaaacctcaaactgcccccaaaattagagcagaaacaaaatacatttttatagtgatatgtcttgggaataactcaaaatgatttcgttttctcctttgaacctcactgaacttacagggaaggcctggtgaaatgtgcattattaggtcacaagaggataacgttacagggttccatagcataatccttgaaagccctgaggcccaggccgctgtcctgctctcctctctactgactcccatcctcaatatactttccatgagagaaaggtaaccaaaaacatggtgaaactattctgcttaaaaggtgttttactgaaaaggcacattgaccactaacccttattacatttcacatgttctaaaaattagtaaggtctgcattttcagttttagagtaaaacaggaaaagtacttagttagctcttctgtctggcattctgtaactggaatttaagaaaagcctaaacttctaattagaacttcagaatgttcatgtctgtattataccacaaaaactgtaaatataatttaagcatttttatgatacagaaatgtgcgctatagacagttatctaagaattataaaaatccatcaaacttgaagtgtctggtataaattacaaccgaatggtaaaaagacattttagccacgtaggcaaccaatgaagtttgacctaaaacccaaataatagcaataacaacagatacagtgcctactattgtcagatactatattagctagctcttttgtatatattctttggaactcttacactgacttttcaagatagttattatggtgcccattgtatgctaaggaaactgaagctaaaaaaaattgaagtcatttctctaatgtaactccattagcaagaaacaaaaccataattcaacttccaggtttgcctgcctccaaagctttgagacctcactaaaattaccctcaattgtagcaatgaggttccaaaggaaatctgtacaaatctcaggcagattaatgtgcttataagggtaaatgccatagatttaatcactcaaattaaatgccatctggaatctcttaccctacttggtacaagcatcctacatgtgttacagccaaccctagccttggccaagaattcaataattttcctgcttcaatgccatcaacaagcaagaaacatatataataccaatacaggaaatacagctagttgctcctagagcatcatttaaaagctgctaattggctaagatgccttttattgagaagtctaagaaacagaaataatgtgttaacccagtttgttaaatgggtttgaggaatcagtttcctccttcctaatacctaaatccatctccataataagtattctctatcaccatttaaaaatcctgatctcttactagtgtttttattgtgcttttcaatctattagagtaaattttttaaaacctcaagagagaacacagaaaactgtcataatttttcaaaggctaaaggagaataaactgaaaatatcagtttgaacacgtgtatgtaaaaagaatggatggtaataaaactaacaactgaaaagcaatgtttctgactcattcattcatactcaagaaatatcaaataactgagtggagatgatgcaagctgtacacatttccagttcagactgaaggtgtggcaacactcacaggggccttccgatcagctgctccaactcagtttacagcttttgtggatgtggcttattcatgcccttgttatgaagaagaagggtaactttacaacctttagcaagagcttttttttctttctgtgctaacccttttttgtctataacagtcatgtaagcttagcactgatttagaaataaataagttaaagaagacacgaatggcttggacattaaaagtttaagcaacagcttaagctgagctaagtttaatgttaaaaattagtgtgacagcaataatttttcaattcagctctgtcgtgggctaggaaaaaatatcctaatttttcagccacaagacataaacattgctagaatgactacattttgaaaaaattatcttctcactttacctagatttcattttaaccaaacagaccaacctctcctattaaacctgtaaattaactcaaagtctaatctggggccttcataataaagattttttttttaaatccctgtcttatctggtgcctttaaaagaaaggaatcattttaggcaattattatgacctaaaaaatttttaaatcttaacgtatagattaattccttgacagctgaagtcatttacaatacattattaaatttcacattcagttttaaatccaaacatagatctcaacattaagaatatggattttagggaaagtaactagctgctcaaattcatttagctgaaaaactactgtcgaatcaccttgaaaatatacactaatgcttgcacattgctaagtggcttttgattctgctcttcattttcttacacagaatcaaccacacaatagaattaagaactcaggcccatggcaaagtgctcccatttagcagttaggacactggacatattcagcatatgtctactgctattgagaatcaaattatgaaaacaaactatattttataaaactaagaatttgttactcagatgagaataaaggtgcctaatgctacagcagggggtaaaagtcccagtaagagagcaataattggtcattctgatgaggagctgtgccaaatttagaaatgaggcacaaatgacaaaaaaattgatcatcagtgtggacatgggtaggtcagtgtgcatatgggtaggttagtatctgctggccgtgtctacagagccccttttatttatttgaagccaacttttcacttgacaatgctacctacaaaagcactgttaatagataagacaatcaagtggctgttatgccgtggcctttttgtaaaaactgcatgagaacaggtgggataaaaaccatagaaaggtagaaaaaaaaaagcatcactcatttaaagatatgtgcacatagatgaactgtaagataatataaccttcttgaccttgtaaataggtggccaaaaatacttaaatatcttgacgaggcaactattactaattgtctcacaacattaccagtccttactggctgaatccttcagccatctgcatacgacatgcacaggcaaatagccactaaaaacatacacaattccaattatctccttgcataactaaagacaaaaagaacaggaaatccaaaaaatacagcaaaactgaaaacactataccttgccttccgtgctattttaaggctgtcccaggctgaaggttacttctcagccctcaaaactccattaactgccaagaccagcaccttagcacatatggcacagatgcctagttgaagcctccttgtactaaatgacctcaaaaaactgggctttctttccaagattaatggaaacaaaagtaatgatcataaggaaccttctaactctgttaatgtttcctgcggatatgtatggccaactgaatatataaaggctcagttcttgcggggtaccctgacaactagatgaattagggtgaaggttccaagttcgatgaactcttctgagtttgagtgccctaggtggtgacattcaagtgatttcacagacatccaccaattcttattttcaaccgggaatcccaagaacacctttaaacatgcaatgcccatggaccctactgggtttctgctgcaagggctcagtgttacttaggaaccctgtgtcttgggagatacttaaatttagcacgtcaaattgcttttggaaaatgtttatctggcgtgactaggggaggcaaagcaaggaaacaggaacctccctctaaggagcagaatagccaacatgcagtaagcctaaaaaacctctcaatttatttcccggggctatgggtaccagtggctcgccggcatgggaatcagcagcctgggggcaccagtgacagcagaaccggggcttaccttgttggaggccatctcactgacggagtgcctggtctgtagggtctctagctggtccagacaccagtccagctcctccagggtctcgctggccagtttctggtaggcctcctctgcgaagagacagggaaagggggactcagttctcaagcgcttcacgggtccgctagcgagttcaaagggggccatcctgccataccccgccatgctcggatgcccggtgccggcacatgagggctgctccttcatattgcccagcccggcagtgcaacgggggcggaggctgtgctcgcggggcggccggcctcggggaggcacggtctctccagcttggcgtctcgggtcggcctccagggagggcgtgcaaagagcggcgagccaactttcacacagcgacgcgagcggaaaaaccactatgcgacttttcaactgtgcggcgggcccgagtcccagtccaggagcccggctctagcggatggcgagggggtggcgagcgcgcttgggtgcccgccccgcagaggagcgtctggtccacagccggatctcctcggtccccaacccggagccgcggccccacgcccgccccgcctgccgagccttctgcacggcacttgaagtgaatgaatcagccgcggccgggtgcgcggccaccacgtttcctgttttctttctcaactcctcgggcggcaggcgcagcgcggctccaacgccgcagctttccgggaacactccccctcacgcccctctcggccctcggcgctgcctggctcctcctcaacccccttacgaaaagattccgaattgcaaaagcctgtccctgtccgtgccacccgccgcgtccttcccctcgagctctgccccgggggccccgccacctcgcagtgccatccccccggcgcagccgggcgccactcgctttgaagtgcagacgaggaggcgcgggcgcgagcgtgtgtgtctgtggggctgctgtgggactgtctgtgctaggagagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctccaggttgcccagaccgctggagcctctgcgactccacgaccggctgcttcctgcgaagtttcacaaacaaggttatttaggaccctcaaggtttctgagggtttaagttttagggtttctgggggttcgtttctaaaggcttaggattcacctacttcaaggaggcagggttgtgggaattaagaccgcattctttttctacccagcccagtccctactaagtaccagacttctaaatgttggggcggacagaaacaagcaaacaaaatatacaatgttgtggggtcggaacgctttataattcacaaatttgacaataggctgcattttcatatgccgaattgcctaagagttctcttaaaggaacagcaatgtgaaagaaccacatggtaaggagaatttacgcatgtcctgcatactactcctttcccctgtgaattgcataagacctagatgatcttgggccaaggaagaaaatctggaagggtgtttctacccaccatgtgcagagtacactacaattttgagaaaacggaaagaccatattcaaaggcatacagaaaagcctgttctgtttacaaaggctgacccagggcaccagggacactgtccctaagcagatcagttgtgggagaacttttctacattagcatgcaataagcaaaccattcatagtgaggagaagtcaaactcccaagggtccatttgataaaactttgtcattgtcgagtggaaagaagatactgagaaacttacactaagtggtgggatcccttgtctttgtctttgaatctacaggtattggagaagaaattctgcccttgaaatttagactccataaattaacatggcacaacaaataaagttcatggactgaatttaggctcctgggatttttgagatagctttttatgtgaactttgtaaaagttagagtaacttttaaagtagttgttacatgtgccacgtggcttattgttatcaagaatacttgaactatttactgttcactttgagtactctaggttaaaatttgcctcttttttgttctacttcctccaccccgcagtctatgtaaatatatactttagatggacaaacaactgcctaaaccttgccaggtgaattaaagtttcagattgaagcttttttttcccccttaacaagcttaaagatattaataattttaaatggtaaatataaaatacctgctctgtatagcttccccaattctaagaatgtaaaaaatattacatgcttgttataaaaattgaagcattacacacaaatataggaagtccattgtaaccccacaccctaaagatcacaaacaatactttcgcctatggctctaacacaatcattttcattttactgaataacttccatatgcaagtatagcatcacctagttgccatggtagtgcatctactatatggtttggttttgatattttcctctctctctcattcccataatataggaatgtaggaaattttaagaggacattgacttgttttatgatcatttgagctgtccatagttagcctatccagtggattaaagatgcataaccattgtgtctgggatttgttcagtgccatcttttcaatcattggttacaatgaagctgggagtcccctctgaggttcggctttctgtggctcctctcccctgcactccaactttctcaaagcctgagcctcaagtgatttcccagtagctaagtaaactgcccccttcctccatcttcaccaagttcccaaagctgttcagactcaggcttcaaatctaacaggatgtggctccacacattatatttcagttgttattttttaatgtggaaaataattcaggaaagttttggctaatgcttcaagacatcatgcactttatacacaggatttgttcttaagaaggtagtatagtgacaggaggaacaatttacttcagaatatccattttatgtccaagccatgcaccagccacttttgacagacaggatttgagtatgatgataaaatggggtaagcatatattttaagttctaacatctgtataaataagaaaaatgaaaaatcactggaacacatctacatgctagtgagaaaataattactaacagagtaaagtttgctctgtgaaactgttgctcaaataaagaattattcttgatattagcatagagctgagaatattgcttttttccaaattcctaggtgagtaggcaatatagctagccacgatttttcaggatcatttgtaaagcttcacttttaggaattttaaccccaagtgttctaagacatcaagtaactgaccttttcatcccgccgaacaaacctcaaagtggagttgccaactatcccacaggaaattgagtcaccacaccaagcaacacacctaaatgtcgacagctagcaggacaaaaacagtgagccagtttaattttggcttttaccaagaacacatactgcattcattaataaaatacttcccctcaacccctgccagagtagtatacactgtggctctccttaaaaatacatgaaaactctttaactgcaccaaatcttgctaagtcaaggaactaaacagagaaaaacacccaagcaaaaactattggctaaactccctaaaggctgggagagggctatggaacagcaactgagaaataaattgagccttgaaggcccctgctacaacagcatcagttttcttcaaggcacctttgaactatgtaacacccgcattctgctgaggctcttctgtgaacaaacagtcctcaattcttgcgggccagcacttggcttctgtcacagtgatatgcttagaggttcccctgacacatggcctgaaactgtgccaggggctccaggagaagatgctgaagaagcagcttccttttgaaaaaggaaaaaagtaatcacctcagagccacagcagttagctagaggttgaggtcattttttgtgaaatgttcagtccattactcttacccacaactcacagtgatgttgaccattgaggtaaaaggatccactgtacgggatgtgtaactatgtggacattagtttctttgccaacacttgaaggtctgctaaaggactgtatcggcttgtcataattcctagatagacctattggtatacatgaagagaacaagtccaaaaaataccacttattttggacactatttgtatgcccttaatttaaaaaaaaaatacaaattataacagctgaggtcgggcacagtggctcacgcctgtaatcccagcactttgggaggccaaggcgggcagatcatgaagtcaagagatcaagaccatcctggctaacacagtgaaaccttggctctactaaaaatacaaaatactagccgtgcatggtggcgggcgcctgtagtcccagctactcgggaggctgaggcaggagaatggcgtgaacccggcaggcagaggttgcagtaagctgagattgggccactgcactccaacctggacaacagcagaagactccgactcaaaaaaacaaaaaaaattataacaactgatccagattttttttattattacactttaagttctagggtacatgtgcacaatgtgcaggttagtttcatatgtatacatgtgccatgttggtgtgctgcacccattaactcctcatttacattaggtatatctcctaatgctatccctcccccttccccccaccccacagcaggccccggtgtgtgatgttccccttcctatgtccatgtgttcgcattgttcaattcccacctatgagtgagaacatgcggtatttggttttttgtccttgtgatagtttgctgagaatgatggtttccaatttcatccatgttcctacaaaggacatgaactcatcctttttcatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagacccttgaggaatcgccacactgtcttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtcatgatgagcactgatccagattttttaaaaataaaagaactacaacaaaaagctcctaagagcaaatacttaaatctccctaaccagttccagcttctcttctcttaattcttacaaaatttcccctttgttctacggaaggaattgatactgtctacagtagatagaactggaaaaaatgatttctgtttcaccgtgtattgctttgagctagtcattcctttagtttgctacagtaaaagatttgtgtaggttaggtctaacttttgctgacttaattttttttcctctatacattttatctgatgggaaatacatgaaggctttggattctctttcaatgtgtacatgtaataggtttaagcagagtttgctagtggcaagctgctctcatctccaagtgtatttctggcatcaaattattgttttgaagtattttaaaattgtataaaatatataaaactttatttagtacttcataaagcttccaaaggaaagatgtgtgcaattttgtgacggttttctttttcttttatcttctcactaactacaattgtttttccgaatgttgcctatgcctctagtagaatttttatatgaaataaacatgaggttggctttcattgacttttagtcccaccagtaactcaacatttatttagcactgactatgtgccatgcactttattagaggctgcagaaacaagatgatgaaaagagtgtgtcccttacccagagtccagcagaggaggtaatttcagcaaacaactgtagagtgcactctcacagaaggaagcatgtgggctatgggacagtaaaagaggactatttaaatcagacagggacagaggtggagtgggaaaaggctgagtcctcaagaatgaaataaaagagagtgggaaggatttttaagagaaaagatgagcaagcacacagacctatgatgaacaagatgtctgtgtcggccaggcgtggtggctcacgcctgtaatcccagcactttgggaggccgaggtgggtggatcacctgaggtcgggagttcaagaccagcctgatccacatggagaaaccctgtctctactaaaaatacaaaattagtcgggcttggtggcacatgcctatattcccagctacttgggaggctgaggcaggagaatcgcttgaacctgggagatagaggttgcagtgagcagaggttgcgccattgcactccagcctgggcaacaagagcataaaaactctgtctcaaaaaaaaaaaaaaaaaaaaaaaagatgtgtgtgtcaaaaaagaaataaccatgagtagggccttgcttaggggaacagattctggagaaatctgagaaatcctcagccactggccatctcaaagactggccatgtcaggcatctgcaggtaggactatatcttcaagagtaggagtcacagagtgactcagagtactgtgtgacatgggatctgattttattttatatggaaaattctagtgctatgcaattaatggaatttaagaaagtaaagttgaagtcagtgcaaccattatctttgaccatattaagaataaaattaaataacttatagaccatttgcttctctgacgattattcttatctaagacaatctctgtattaaaatcctacgcagacatatgttcccacaatatgtcaggtatgaacagaaggactgcccaatgtgacttgaaagggagtggacttcttgctcttaaaaactacaaccttgtagtcactaacttattaatcatactgtaataagatggagaaaaaaacaatggaattcaccagaatttctttcacgagagtctgcctgcattaaaatgttcgataaagctatttatgacagaaggtgagactttgaagagctttggtttgggtggaactaatctgtgcctcatctacacaggaaaggggaggaatatgccagttgctagagagggaatatgtatgtgtgtgcatgtgtgtaagcgcatgagagagcgagagaatgtgtgtttgtgcacatgcatgtgtgtgtgtgtaagagaaaggagtcagcttggtctctgtgtgtgcatgtatgtaagggcatgaaagagtgagagagagagagagaatgtgtgtgtgtgtgtgtgtgtgtatgtgtgtgtaagagaaaggagtcagcttggtctaaagggtaactccaatttgtacatttttcctttctcccaatcatcaataaggttattgaagatgtgtgtgtgtgtgtgtgtgtgtgtgcatataagagaaaggagtcagcttggtctaaagggtaactccaacccgtgcattttccctttctcccaatcgtcaataaggttactgaaggtacaaaatcccgacttgttttgttttgttttattcattgaagggactgagcttgaaggccagattggcccaagcagaaatgtctctctgagctgacataagagaagagtcaaagaaagaggagaaagcttttataagaataaggaggccttttgtccaaaaaattggagtttgagctaagtttaattaggcatctaggttgggggcttcatgtgacatgtgtgcaactgtgagtgatattattctttgaaagaaactggaagagtggagaaagattccaatctctattccacttcatacaagcaattccaggcaattcagctactaatctttctagggccttatttcacctatagattggagataataacaagagccttgtaagttattttagttcaagtgagaggttgtgagttaaataatcttgcattgattgcctaatagattcttttcccttcctcctccattgtatcttcactttctcctggactcaagtctctaacttaaatgcaaacattctattaattttagtgagcctatcaactaatacctaggtataacctcggggtccagaaacttaatagttacctggaacagtttttagggtagttagaaagaaaaaagaatttcaaggaatgaacagggattcattctgaagaagttcacttagagaacacaggccattcaggaagctacaaacaggtagggatataaagtttagatcagacagtggacaaagataaagatggagaactagtcttggaggacttgtatactattctaagacaatattttcttctaaagaggccattaaaaatcttctaagtgaggaagtcacatggtcagatttgcttttcaaaaagattactctgggaatagtataaaggcagatcagaaaagtaaagaccagttaagaggttggtgaccagataaggagaaaatcctaagcagtccctgaaggggaaggagaagctgcagaaagttaggaggaaaaactctcaggagcaaagaaaaaggaaatgtcaaaggaaaatattgttatggactgaatgtttgtgtctctccaatattcatatgctgaaatctaatccccggtgtcacggtatttggagggaaagcccttcggaagtaattaggtcatgagaatggagccctcatgaattagattcgtgccattataagaagaggccagaggttgctctctttctaccatgtggatacatgctatgtgggcagtctgcaaccctgaagatgccctcaccagaacctgactatgctgacaccctgatctcagacttccagctcccagaactgtgagaaataaaagtttgttgtttaagccatcagtttatggtattttgttatagcagcttgagctaagacaaatatcaaggctttgccattgatattcagtacagaccgtatatacccacaggtttgcgctaagataattttcattccaaacacatatttcagcaacacaagactaaagagggtgttaaagaatgctactgaggaagcttttgtctgggaagttgtttgaacaaagttacaggacaatttttgcaaacaggtttaaaaaaagttacaattatgtatgctatttacgtattcttgttgtaattttaggaatcaattttatttccctggggggactgtaggagagcatctgtgtttccatcatatactatcaatcttaggatataacagtcttttgttcttcacctttgtcaattactgcatacagtattccttagagaaaacaaggagtttgaacagattatctttagcacctacccagctctaacattcatttattatctgatttctgaaattgtactatctgggttaggtgttggttttaaggttgttcattatagttagcctggatggggtcagctatgtttgtagagggaattcctaaactgaccagttacttgtcaaggatcccatccaataccatgatcctggaattctgtgagtttagctcaactgttcttcaggggtacatgttttctatttgaaattgaggtattctcagaaataaagctattaataaatagaaagttctggagtatatttacactcactctgcttatctccactcctacccctaccatattcccatccaatactttgccagttgacttaccaatttcttcttaatttctgtaactgtcaccttcagtcaaattctcatctgtgtatttctagattcatataatggtctactactggatctccttggattcactttttctcaacacagtcctatttataaagtcagaataatcttccttaaaccctggttttattgtttcattcttttaagaacctgctgcacaactctctcctacttattgtattaatgtcacacttctgttcacataggcctttttcggctgcttttcaatacctttcccttttatttacatctaagactatcccatccaagactgcccatcttagccaatctttccacctggaaataatttgctggcttctgcctgtatgacttttctaatgtcatttttatatttgtgtctaggcctttctataactgtctagaaaattcctgacatttacaggcactcagcaaatatttgtgagtgaataatcagtaagtatgcttgttttctatcagataagaatatttatttccaaacgagattcaaacagtaatactggcctgggtgtggcttcctacatgtaatcaccctcgtctatctcttgttctcagtcttttgctttcaaactctttctctttttttaaaagagtattaggaactaacattgccaaaatttggtaatggtcaagcagatcatggtgtcttactgaagtgaaatattaacattaaaataaaaatgacaagtattatggtatatcattcatatgtaatgatccttacaaaatagagtaaaattttaaaagaattcaccaatacaccagtatgatgtttgggagaaacagatgaatgcacaaaggtgcatctgatgcaaacacccccagaaaaatgagcataagttcatattatcaatatttttcactctaaaagtgttcactgacttccctgaagtcaccaaggactccaagttaagaatactttcctgagtgaagaaaagaaagcaattattttaatcaacactgccccagaatcttttattcggaatcgctatctctgctttcttcttcttcttttttttaactttctcataaatctctgtttagcatttatatctctctcactatgagatacctaagggttaagaagtaatgccaaagagacatttgtccagttgaagactgggattaagaaaaaacacacagccgggcatggtggctcatgtctgtaatcccagccttttgggaacccaaggcaggtggatcacctgaggtcaagagtttgagaccagcctggccaacatgatgaaccccatctctactaaagaaaatacaaaacattagccacgcatggtggcgggtgcctgtaatcccagctacttgggaggctgaggcaggagaatcacttgaacccgggaggcggaggttacagtgagccgagattgtgccactgcactccagcctgggcaataagagcgaaactctgtcccaaaaaaagagaaaaagaaaagaaaaaacacacaaaagatttcccgaaaagactaggcccttttaaacaggctatgaacagagtctcagaaaggtaatttcttatgtacaatttttaatctcattacttgcattacaagcaacacatatgagtgataaactattttggcctactggtaaacctacatttgttaactgtgtgtgcattatagagaacaaatttcagaactcaagagtatatcggttatatttggcttatccagttgtatatgaactggctccatacacgaataagataaattagttttataattttacaagaatatctatggagatttagatttggctaagaaagttattatacacacagaagaatccacaacctataagagctcttcatgggaaatagtgtgatagatcagaaagagcatggacttttgagtcactcagaacttgaattccagccttgccattgttctagttgtattatctgaaataagccatttaaaagacctgagcacattgtatacattgagaattacagggttattatgagaaatgcataagaaatgtaaagtaccaagggctgtatctgacatatagaaggtattcaatcaatagtaggtatactgaaccactttgcagagttgtttaaataagttaattttaaataaggtagttaatatttgagagtttccttccttttccacagattctcaatcctaaaacagttactatttttccatcatcaccatcaaccctcaaatattaaccagttctgagccaaatgtgagtgaacaacctatgatttagaatagcttttagaccaggcacagtggcttacgcctgtaatcccagcactctgggaggctgatgcgagcagatcacttgaggccaggagttcaagaccagcctagacaacatggcaaaaccgcatctctactaaaaatacaaaaagtagccaggtgtgtgtggcacatgtctgtagttccagcttcttgggaggctgaggcaggagaatcaattgaaccctggaggtggaggagatggtgccactgcactccagcctgggcaacagagtgagactctgtctcaaaaacaaacaaacaacaaaatagaatagcttttacaagaccacaccaaatcatgaaaagtcaactatgtaggaagaatatgtatttgtcattggttaatgacagagcatcacttacactgaggttactgggaagatcatttcaaacatttcccaaagaatgttccaatcaatattgtccttataagattctccttactaatgacgttttgtggtcaaacaagcttgggaaatattgtatatgtaggctttttacagtgatttctaatggacacgaacctaccaaaagctagaaggtccacagcaaaatgagatatttaattttattaacaagcattatctaaacctgtttgattttagaatgcatttttcacacaacaactatcacctcttgaagaatacctggaataggttttcctatacctatacctatatgtcaggtaactccaaaacattaacaaatacatgtgtttagtaggttcccatatggttgaaatctccactaacgacattttatttctcttcctcctgactttgtatgctatcgagaaatggtcagagagtaatcttcctccctccctttcttcttttctttctctctttttccccctgaaagagaatagtcaaaaaatccatacatatttattgagcctctctgatgtgatagttgctgtgaaatacaagaacatgaaagattcagcagcctgggcccaggaaggaaccataataacctgctgagaaaatcagacacatgatcggctgctgcctagagacagtgtaaggtagcatataaatcattcagcctgggagtgctactgtagttcgagcagggagagggaggtatggactatagctcagtgtgctgggtttcaggaagaaggtgaacttggatgtaggtcttcaaggaagactgtggttttaatggctgtgggaggagggagtccgctggcattgttttcaggtgtaggaaatgtctgcagcctgaataaaggttgtatgtgtggacagtaaatgggctgggtggagtagacacattccagggaggagaagggatatagagttgaacacttaaatgtgtggccttgagctagtggatattgtgggaattggataagtgcactggtagcctaagaggatagaatggagaagagagaaggatggagactaaggagctattgtggtagtccagatgcagtggaaagcaaagagttgtggaggtatccactttagtggtctacgatgacagttacaagcaatagaaagagtatgacttgggaacagtggttcaaatgctggctctgcaacttagcaaccatggggcaaatttgggcaaattaacttctctgtacctcagttttcttttttgtaaaatagggctaaaaatacattccctagaaggtggcctccaggccattttcccacactttatttgaatgttaaaactaactttaatctaaaaatcatatattcatatctctatcttttttggcggttcagttcaacttaaatgtgttatttgttaaaaacttgtaattatcatctattacatgtaaaatataagagctgcttttaatagtaattcatctcctccctatctttttttaaaacatggtcaaaattaacaaaacaatcttgtatttttgatactagtagtggtatcactactactagaggtacaaggactcttgtacctctctgaaaagtagcataattagcaacagtattgatggtatctgctattttagattatttaaactgtagtcactaaggtaagcaaggggaagaaggcatgtcatttatgtgtttttcatccttaagattagcgtttggaagcatatattattccacagcaatctggataggtcttgccatgccctgatcttgtaagcccaaattttattttgaatactccagctttgcacttaaatgacagctccttgataaaagaaaaacaattgcctaacaattttcttccaattgtctgaaaacataatgggtgtacatacacacacacacacacacacacacacacacacacacacacacacaatctctagggcatatttactagatagtattatgtaatgtgtagacatttttaattatgataattaagacaaaaatatgtgtagcaagtttttgatttgagacaaatttgagatttactaaaattattatatgtgtgtccttctgaagacttcatattttcattatatatcttcattcttgaagtataactcttaaattgttgaattaagttttatgaattaagttgttttgttttttgtttttttttgttgttgttttttttttttggccaggcacggtcgctcatgcctgtaatcccagcactttgggaagtcgaggtgggcagatgacttgaggccaggaatttgagaccagcctggccatcaaagcaaaaccccatctctactaaatctaatcttgtgcctcaagcgaggcacaagactcacttgaacctgggaggcagaggttgcagtgagctcagatcgtgccactgcactccagcctcagggacagagtgagattctgtctcaaaagaaaaaaatttttttccatttttaccaataccactattctcaattcatccactatttcactaggaattactaattcagtttacataatttattcaatgaataaattattcaatgaagaagcttctgggtatttaggtgctacatgctaatttcaattggcatattttgtttttcaaatttgttcttggtgacccaataattatacctgtccaccttgaaagtgtctttcttcatcaccttcaaggccaccgctaacaagacctttgaaaagaagtaaacagtagagaatttcaacttctgtgatgaccaccgtcttcttctgaatccccagactccactcatacaaggttttggggaagtttaaatgaaatgaagcagtggcttacaaagtttattgacagtaaactacagtaaaatttatattttatactataacctggtagatttgtttaaagtaagaggtgctcacttttgaaggcatgtggatgctggctttcagtaatataaaaaaaatgtacaaaaaggttttatacctatatttatttttaaaaggtagaggagagcagtggactcctatttaaagaaactcttgtgttttataaataatagtcatggcaaaatttgtttacagtctttaacaaaccatgcatttcagtataaattaaaccaataaaaagaattatatatataaaataaaaaggaaatgtatatataggaacagtatataccatacacataagagtaaatatatattcgagccaatacagagaattgaaacataatttaacatgaaataacatttatccttactatgtatgattcactctgatgttttctattttatttaattttaaagtattaattgtgaccccttaaattgattttgaaatctaccaattggtttgaaaacactgaggtaagaaattaccttgcttaataaatgttagttttgtttccctcttccctcttcctccctttttataattaaaaaactctccctctacttctctacttcacgtgagagtagaacacataaaaagatttcagttaactactgtgcatattttttgaagtaatttctccataatgtgtgagttttctcagggtactacaagtttaccaacagaacacataaagcagcggccactcactgaaatgcctataggagacagatagaccatatgaatgaatgaatgacatggttgctgggcatcctggttgcagtggctagaactgtggagggtaggagcagaccaccatatatcctaggcatttcattggcaaatgaacaggagaaggacacctttccgtttggccctcattttcctagatctttcctcccttcctctgtcaatccctcctacatagcctatgttcccaaagcaccccttgtattataataataattattatgatatctgtccttaatcaagaacttatactggatttttaatgcctttaggtcttccccaaacttcagttcatctattcgaagtccctataaaatctacctccttagacttgtctgcccccattattcccctgtggttgacctcacctccatctctatcttttgtcagcaagtttcctcagagttccctctctgcatacttgttcatgctgggttatttgtttttgccacttgatcatctagacctttttccctctttccctccttctattcaatttctgcctttcactgctgtacaaaggaggggcagggaggccctccagggtggagggaatcagtcttgagataactgagagattcagggtgatgagtcccaaagttgaagagaatccacatacttcttctgtttttgttttacctagcaaggagccttttctatagacaaagttgggaaaccagaggttatgacgtgattcatctttgcctacttaaactttagcttgattcatcacttctcaacaaatacttgttgaaccccaccagtaatacgagaagcttggtattctatgaggtgctcaacttccaaagcttagttcagaagaattctggcctcaaggcgtctaccatctagaagcaaacaactaacaaatgaacaaatgcagtgatttcaaaagaaattaaggtgtgctgtggtagaggcatgcacaggtcagaaaagttcagaggttccagacaggcttcctggggaggatatccatgccccgcctccacctggtagttcatgatcagagtttgcaagcttggctgggatagagggaatagcgtgtgaaccacagaaggagtggatctggtggctcagacacggcaagaaccagctcatggcactaggctgcaggcacaccatgcacaaaacagtcttttctttccccagttctccaaattctctaaagtggaagcctaggggtgagggtaagaaggaggtaggaagctacaaccactggagcaaaggacgaaagaaggggcttgagtgtctaaaagtgcagaaactcaaccgactggacgctgagacaatgtttaaaaaggagtttttttgtttgtttgttttcttgtgtttttttttactttaagttctgggatacatgtgcagaacgtgcaggtttattacataggtatacatgtgctatggtggtttactgcacccatcagcccaaactaggttttaagacccgcatgcattcggtatttgtactaatgttcttcctccccttgctcccccaacccccaccaggccccagtgtgtgatgttcccctccctgtgtccatgtgttctcattgttcaactcccacttatgagtgagaacatgcagtgtttcgttttctgttcctgtgttagtttgctgagaatgatggcttccagcttcattcacgtccctgcaaaggacataaactcattcttttttatggctgcatagtactccatggtgtatatgtgccacattaaaaatgactttttaaagtggcaactgtgggaggcaaaggagaaaaaacaggagctgccagataagggagtgaagagaacccagcactttgagaattccgttacattttgcagcttgaattcttcactttttgctcccattatgtgcctctttctcctctccatgaactgggccctgtggacccaggatcctgctgtctttgcagggcaaagaatggttagaaatgaattcattaaggtgagaaaccattgctggcataattctccttcacggaaacctggcacttaaatttaacctgtttggttagatccagctctgcctcccccatttttttctgcagaaacaaggctggcagatccctgttcctcttaatccttgaatggaccaaatgctgggttatgctggggcagtgagggaccttacaaacactgaaatttaagagaacagtttttggagtaaggcagtccttgtttccaaatctgagctttgccactgattgactagcttggcaccttataaaagtgaattaacctagcttgttttctaatttataaaatggagaaagcagtacctatatcacagtatgattctgaaaattatttaaataggactatgtatgtaaagcagtgcctgaaaaatagcaagtggtcctaaagtcactatgatgatgaattttatatgcaggcacctagagcatgttaggatttttgggatctttcccagctcacactgaagcttcactcttctccaacagtctgttatccaatgctggataactgagatagtcttcccagcatttatcaatgtggttaggaacagtaatcctggaaagcattctcaaattatttatctaattaaacaagcaaacctttttagcccagacatcctaaatctctgtagcttgtcttcgctgatttggtcagaatagctcagatggtaggaagggctttctgggtagaaaaaaataaattagcagtctggaaaacaaaagatctctgcttaaaagagtctctaaaacagcctgatcagcctgtgtattttgccatattatctagcattagtaggggactgggaaaaatccagggctccttgtagagatagagactggcaaatattatgtttgatgcatgagaaccaaatcagaagttaactctttaagttattaaatcactaaacagtctatcacaattatgtgtttattactagactgaatttctctggggctggaaccataatgaattcattttttgatctctggtgctaaacactggctgtcatatactaggtatccaataaatgtttgttgaatggaactgaaaaagcatgaaacacttcccctgttaaggcttcttttctataatatttccatagtttctaatgcatctgagaatcattaactggactgttagaggaatatgaatatggttgagggagctacaaacttcatgctctgagatgtcacatgattagtgtaacttttgttccaggggagagaaatccctaagagagtgactgttctccatgcccacccacccacagtgtcctatagagcctttcattctccagatgcctataatgactatcacattgatttgtttacatatctattgccttgtcttccttataggtacagagtccatacatcctaattggcctggaacttccaaggtctatgcctgttataccagtgtaattatgaatagcattgcctttcattctaaaaagtgttctggtttgaatgctaaatcatctagacaccctacttatgagagggttcactgtacatcgtttagtcccccaactcccctccccttggaaatctgggtactaccctctaccgggggctttccactatggaggcagctctctcaatcacagcattcaggaggtgtaagtccactcccaacagaacagacacctgtctacaaagagactcttggtggaagaaaaaaaaaaatcacttccgtaagtttaagtcttccttttaaacttgggtctcttttgcacatcagaaacaaagaatctctaataattacatccctaaatgtactgaagtctagaagacatgcccatttgaaaactctaatctagtaattaaagcttctcaggttaaactgcaccttaataatgtagcttattttgtcaagatcagttaaggccctgtaatgtgatttggaataaatggacagacagaaattaaaatgtgctggacaaggtaatcagaaatctcacttcatttagtcaataacaatggcaattcagcgggttccttttactactgggatgtaattgtgcttggctttaatttcttgtaatgatggaacaaattaaattacttcatacttttaggaacatttggctacatcatgttttggtgcttccataaaccccactggaaattaaatcagctctgtggttgctcattctccctctttagtgccatgtctgccttctgtcagcaaaatggtaatattgtctaccttaatccaccagatgcagttgagttaaaagaaattacctctcccacctctttcctttcaaatctccctatttgtagctatcaaattttggcatgcctgctggaacacagtcttgttagaacaagcacggtaattctctcgtgagactttaggactctctctacgacaaggtcagaatgtacctgtgattcaaatttagatgaggatatgagttggtaagaacatgaagagcatcagacagttttcaggacacccactacttttattttgtgctatcagtttttcctttcccaaattgcaggtggagatgcaatctttaacgctggaaatctcttgctatatgccattaaaattaattagtctagcacattttatctttaggcccttacctagggcaggtaaaatattctagcacaaaataacacaactttcctgaacaccatggctactaagttcatatggtaaagattatactatacattaccttgcaaatagagtgttgcagactgatattaaatatttaaaatgtatgcaggattattaataggcaacattgtggcagagactgctaaatgtcccctaatattgatgcttttcttcatcacttgttttcaaatacctgttttcatgtaagcatgtgactgcccaaaatagagaaaattcacagcctccttggttgccaggtgttgccatataactaagttttggtgaatgagttggtagtagaagcgttatgtagatattatatgatgtgctagaaacttcccttaagagaaatttgtcatctatctttttatctgcctgtatttattgttttctctttcctactggctagaatgtgaagttgatggctggagtcggagcagccatattggatggtgagttgaatttagcaacagaggctacacctcacagtgcaataagatggaaagagcacgtgtccttgaagactgtactggatagaggtgccatattaacctcggactgccaactttcagattttacatgaaggagaaatatctgtcttccttaagccacttctattttaaatctctctatttactgctgaataaaatctcaactaacgcaaacaccaataacaaaaaattcctattcactcatgatataggattataccttagtcttttttgtgtcatatatctgttcattcaccatttttgctttgatgttcaataaacatctcaaatttaacatatctataaaaattttttaaattttacgttcaggggtatatgtgcaggttagtcatataggtaaattgcatgtcatggggtgctggtgtacagattatttcacaccgaggtaataagcatagtacccctacagcttagtcttaagaagaagtatgttcacataggccaggctgagacttggatgttggatgactttcttccagcttactctgatttgaatatattgtgtggtagtagatggctaaactgcttgctccaaaactatctgacaatgctttttagaaagtctgccaaacaaaactacaagaatcaccctggagcttcccttaggcttcagatatttgtcttccctgccctacttggaaatcattccagcctggaagtcattgtgaggaaccaaaaaatggtctccctaccatgaagaataacactgcttccattgttgggaggctctccttcctacaggcactgtccctcactcattagacacttgaataataaggatgttcatatatttattggtgttggtatcagttagacagttgaatgatacaaatgttcatatatttcttcttattcaatagtctcacaagaacactattcttgtaaagtcattaaaaactggatggtcttttcataattatttccatgatttgtcatctaaagccagtgttctctcctcctgtcaatctgatagctttaaagctaagttctgggtgggtccaagtcatgcctgaaaggtttatcaaatgacatattgcagtcatatggtcggagcacaaacacctctgaatgtacaatattttaaagcaaaacagtttatgtgtaagctctatgaggttacggaccatgactatcttatttattaccaaatccccagctcctagaacagtgcccctcaatataaatctgtcaaatgaataaacgaagagtttgcctgcagtagtaaacttgttatttgcacacactcgaggcccacctctatgtgtacattgtcagtgagtcagcctcgtggatgactctgcaggactgtctgtataacatccactacagttaccaggggacccaattttcataaattgctccagcatcacaccctcctcttacagagactcttcctgtccattctaatccctgacacgttgtcatcctcactcagattccccaatagatagaaatgctgttaaatatacttgggtagagagggataggcatgctcaaactcgttttgggaaaaaaaattgcaactgtcagaaatgtgttagctatcttcacagattatgaaacataaatatcaattatctgttcacagcagtgaaagcctgcatatttttttaagatagcaagtataaaacggctataagtaccatgttgagtagagacctaccaccgaagtagagaccttcactgaaatagtgaagggatggttgtgttgcagggtcagaatgattacccactggttgacactccctccaggactaaaggcagcatcaccagcgtccactctgcttctccactgcttactgttaaggagcaaggcaatagcattatctaagtaggaactacttcattctttcaaaacctggaatcggctgatcagaagaagaaaaacagtataaaaatacagaaagacaagattctctggctgtcctaatgaatgctagctagctataatagcatggataagacatataaccaaacatataagatctattaattaaggggaatctctatttgtattaactcatctattttctctaaaaccagtatttagttatctcccatacattggcatattgtgtatatttgcagaattcaaaatgttactgatgtgacttttttccatcagacatctgagctatccctcaactaatagttgagctgttcctctatagctcagtatctgagttagaactcgaagtaaaaaggtataaataagtcatgctataaaattcaaaggcaatcagatgtttgagactatagttatacagaaaagtgtccttgttcttgggaggaatacatcgaggagtttagggatagagggctatgatgtgtgcagttttctctcaggtggttcagagaaaaaaagacaatgtgtgtgtatgtatatttgtgtgtatgtgcacatagagtgatactgcaaatgaggtggaatgtttacaatgagtgaatgcatgtggttttttttttttttttgcactacccatgaagctttccagtgtgtctgaaataacttccagataaaactttttttaaaggcaatcagaacagtggcaatgaataattcaattatttcatatttgagctgtctttcctgccacccccaccccctataacactacatacatacataggctcacataagtgacacttactatacttttttgcctatgtaatgagtgttggcgaagtacgtgagtgggaaattcagtcttttgcattcaagctctaagtaattctaagagaccttttagataatgatttgacttttaagacaacaattttgaggttataatatgatgtcatttcatataaacagaactgcccttttgtcctttcagatttgattgaaaatggcccatggagtacaaccacctgggaacatatcctcgagaaagacagttgaggcttattgcctaaaccacaggctactgaaaacttggccaaaggcgactactctagactggtgacttcaaaagtgctgatgaatacagtgaaccatgaaagatgcattatttgttttgaacattttactatgattgatgacccagatttggcaagttagttcactcccagtggagatgaaagtttcactgccttctttctttcaacattcttgttgagacagatttcacttttattggccaatgtactaacaaatcacttgcatttgcagcataatgaattcattagcaacactgtggatcaatgctatacataatattcctgagtcaacattaactcttaattaaacttccttattataatgcctctggaaattttccttcaggctactaaacttcaagccaacagtctaagtgttaatcagtaatcatgctagtaactttttgagatgggtcagggccagggccagggtcagtgatccatcatgaatggcaggtttaaaaatggatatacgtgatcaaaaatacccataagttgaccaaagcattctaacctttgggttattctaacactcagtgtatcagccttctgagcaagccaattttttattgccttaaaaagtctaaaagaaagataaaaacagagataatcagttttgtttggcaatggcaggggtgtgggaaatgaaaaagaagaaagttaaagatgagtgaaaataggatagtcttggcactttggtatgaaattgaagtacttatttaaactgatgaatattgtacagaaatatacagagagcagtgaggggctaagaacctaattccaaggtaactacaaggaaaaaattattgatctggattgtgaccagaattcaagagtttgactgttgtcattgttgctgttgttattaagttaaaaaaaatgagaaaaaaatatacttttttctagtatacttaccaggaaaggaaagagagaaggagggagggaaggagggagacatggagggggcagagggagagagagacaaagacactgacaaagtctggaaaaagacacaaattcagatttaagatcccaaaatatgctacatttctgcccccttcaaaatattaaactttgctaaaatacactggaaattttttttattgtttattttttaaatcaactagcagaccaattagccaagatgatattttcatccttggtactctttcaggtgagctctgtgggctaccaccagaaagtcctagccaaccaagctctcactgggtcactctgtgctagctagactacatagcctcctaaaaaagcacgcagccctgatgctggtcctgccaaagtgtggtttgctgtcatgtcctacaggctacccgtttcccagtgatttatcataataaaccaaatgggaatgaaatacccagaaatatgccataaatctactagtggtgaattttcaatattctgcacaccatggtgatttgttaattcagttggatctctattaaacctctctaaaatgtcattaaaccatctgttttgacttgttaatcaaacaacttttaaaaatgtatttagagtatcagtaacccttgaattaatgcatccatcagtaataatcccctctccaactttagatttatttttaagctctagcttttttccccaccattccaacaaatagcctgacttccaaaagtaagaatcaatcacttcagttgtagaaatgtccagagggtgccctactttcgaaacaggaagtaacttgatccagcagtcccacttcttggtatatatccaaaagaactgaaatctggatcttaaagagatattttcactgcagcatatttgtaatagctaagatacagaggcaacctaaatgtccatcaacagatgaatggacaaaggaaatgtgatatatatatacacacacacacacacacacacacacacacacacacacacacacacacacacacacatatacaatgaaatattattcagccctaaaaaaggaaggaaatcctgtcatttacaacaagttggatggaactggaggacatcatgctaagtggaataaaccagacacagaaggacaaatactgcatgatctcacttacatgtataatccaaaatagtcaaactgatggaagcagaaagtagaatggtagttgccagaggctgggggaagatgggaattggtagatgtggtcaagggttacaaagttttagtcttgcaaaataagttctggaaagctgctgtataacataagtatacaatcaacaatactatattgtatacttagaaatttggtaaaagggtagctgttatattaagtgtccttaccatgaaaggaaaacaaaacaaaaaaacccaaaaagatgggaggaaacttttggaggcaatgaataagtttatggcattgattgtaatggtggttttagggtgtatacctgtctccaaacatcttgcagaataaacatattaaatctaaagtttccttgggaaagaagatgagaaaataattgtcaagagactgtacaccaataaaatagtcaaggagtacaatgaaaacttaggaatcccatttcttcctttgactcacactgtttgatgatatcattcacatcggcatttggaagttattgagacatttcaacataagattgtccttatgatctatgatttgggactctcttataagaaagtccattctataccaatttgttttgttccttggtaactagaccttctttaattggatctaagaattaatattcctatctcataaagaagactaaaaggatccaagtagatggagtttcaaaggtggtccccataaaagcatttttaccttaagcaaagatgtcccaatttttcctgcttgcttttcggatgctgttctaaaaaaaatgtaccttattccttctactaaaagaaaacctatcaattcattgattcattgaacaaatatttattgaacatgtagtatgtactaaacactgggtaagattccagatatgcaaagaggaataagtccctgcccttaagaaaactcacagtgtggtcaagctaacaattctagagcaactgtgtgataagggctccaaaagcacatgcaggaacacagagagaggcactcttagtcttggaggggcttcctacagtgggcaatttttgatgtgtcacaaaaggaggagctattagggcacaagaagagcaagggtgaagtgcagaaaggagtgaatagatggggaggggacccaggcaaagagaataacatcagcaaaggtgcaacttcatgggaacacagtacatttggaagcctgcccaccatttgttacagcagaatgcatgtgtgggtggagatgaggctgcagagatgggctggagaggattatgagagatggatgactagcaaaggaagttggtcatgtccttatgtggtgggggaccatggaaagatttttatttataagacgtggtttattcttcattctgtggcaaaaagcagatactatagtctgaatgtttgtgtccctccccacattcatatgcgatgaaacctcatcaccaatgtgatggtattaggaggtggggcctttgggagataattaggtcatgagagcacagcccttataaggggattagtggcttataaaggaggcccaagagagctgccttgccccttccaccatgtgaggacaaagccagaggcactatctatgacccaggaaatgagccctcacaaaataccaagtctaccgtgccttgaccttggacattctagtctccagaactgtgagaaataaatttatgttgtttataagccacccagctcgtgatttatttatttatttatttatttatttatttatttatttatttagagagagagttttgctctgtcactcgggctggatttcagtgccatgatctcagatcactgcaccctctccttcccaggtgcaagtgattctagtgccttagcctcctgagttgctgggattacaggtgcttgtgaccacatttggctgatttttttgtatttttagtagagattaggtttcatcatgttgcccaggctggtctgaaactcctgacttcaagtgatctgcccacctcggcctcccaaagtgctgggattacaggcatgagccactgtgcctggctatgatattttgttacagcagcttgaatggactaagacagaaggaaaaataggcctttctgtagcgtgagctgaaagacagaaaatagccataggtttctaaagagagaaaaagatatatgtttgacaatatgtttcaattagtactttttttgaaatgcagtaagttacctataccttattccatttctaatctatatgatggcatttaaatattgactaggtttctgatacagtttttggagtctgaatgtcactgcatggatgaataaaccaaacagatcggattcatatgggtttgccaaatgacaaatttttttccatgtaagattagaggaaaaactgatttcacccaatttcctgccttatttatattagaactgaagtcaatgctgttatccctttgcatgttcttttgtatttaaaatctgatatagaattgtgctgttacagaagaaataatttaatgcattctgccctcttatttctcatgagttttcatttaaaagaaaacaaaaaagaaaaaggacatggacttttctttatttctagactttataaactttttagttatcaaataaacacatgtattaattaagtaggtaaaatattgcatatattaaaaggtacttggagactcatatgttgtcagtttttcatgactcaaaatttatgaaaaaccatctaagactatcgtaatgaagttcaattgtagatcttgaagtgacaaaacatgaaccacattgacttgaggtccagggcttaaaactgcctatttgagctctaggttaaaagcatgtgtgaaatgcaaagtctgacatctgcacagctgactattgtgaagtctcagtatcattgttcataagtaaagcttgtccctaagccataccacaagcattcccagaggatatagatttcatttgatttaacatgattgttgatattggtagtgtatttcacgtgaacttgtgaaatcattgtctatacagacaattgagacactaaaacttttttttaagtattttttgttaggggctagatctgaggttttttattcatttgttcttttgttcactcatttgttagttcagttatttactcaaaaatgtatattgagcaattcctatatggcagacactgacagatgctggattcagtgatgagcaaagcattcgtggtttctatgcccaaggatcctatcccgtggagtgtagagtcaagcaaagaatgtcaacaacaaatgaaaattttaatcttattaatgttatatgcaaaaatgtaacacctccaaaaaagacaatttatttcctattaaggaatgaaggcagtccactgaggaagatcaacatgtaagcacatgtaaagcaaaataatcaataggtaatgtagtttttgaaaaagaaggggctttaagcaggaagtcctgggtttggacttgggtttcaaatctagctatgtactcttgggccacatacccaagtcttgtaagtctcagtttcctcctttttaaagttagcctaaaactacctcgctcatctaatggtgtgagaattaggtaaacagccaggtagctcatcaaattgtaattattataattgttattttttgagtcatgaaagttttcacactgaagggaacatttcaacttgacctggaagagtaagtagtttatcaggcagaaagaatttgttagggtattccagagagaaggaacaaaatgtgcaaattcaagtagtcagaatcaaaatggtttcttaaaggaatgacaaacagatcagtgcagttggagcctaaagttatctaaataatccgttagaccttttctttaactgataaaataaagcaagcattccaaaaatcaatttaaatccatcttcctccttatacctctccattccccataccatggaaacacagttttacctcttttacaatgagttgtcagcatgaagagacttggttcattaagattagcaaacttcacagcattgaacaaaagataaagaaaagtttatagcaaatacgttccatgtgaaagcatctccagcaggttcagaagatgcaatgaaaagactaaaacttgatatagggatatttcagtggtgctcgtaccagcgtcctaacattttgttctaccttagtaaaatctatcccttattactcatcctatctgtagactctcttatggaacaagaagcttttttttttttttccctaatcccgtggggaagccctctccttccctgggtgattcctgagcaaccaggaaaacagcagtcacagtcaacacagctagtacttgcagaaaatctctcttctgtgatgctctgaatgactcacagttccagatggccttgtcagcctttatccgcattccactcttggcaccattaacctggtctactgtggttgcaacaaataacttttcttgttatgaggaccagtgttttgaaaaatttaaaatgttataaaattaaaatgtttatatttggaaattatttccaaatataaaaggagcctgtcttcattatagattatttggaaaaaatgcagaggggtgcaaaagaaaaatggaaacaagccatcttttttttacccataattctaccactcagagacaactactgtgaacattttgatgtatttatctccagtctttctagaaggtagatcactgtaagagatttctgaagcagaagtactaagtcagaaggaataaacatttttatacctcttaatgtgtattgccagatagtttttgagaaatattacagcaatttctacttttagaagtactgcttgagagtgatgttacatggtattctcactaacacatatacaatgttataaatatgtccaaaaataaaacttagcaactatgttatctccttgtttcaatttgaacttattacaagagtgatcaatttttaaatttaaatgttatttttagcaaagttatagatgcaaatagtttagagaactaagtagtaccacaaggattaaaaaaagagatctcctgcagtgcatcccccacccacaatacatacatgtatcttccactccccagagggtacccattttcaaatattttagctgattcatttgctatactccactctatctctaaatgatataactttacagttacttcttaatagttcatttttttgggcattgcttattgatacttcatagcggaagataaggatttacctttgcaacacttcacacttctcatcacccatccttctaatatattatagtcttacttagattgatagtcattgtgtttccatgagcagaaccaaagaaaaactataagcagctaaactatgtaacataccctgattacctttttttctttgttttccttcttgaaaattcttgtcttttgttagtttctttgttcccttagatgtccatatatacttatcactaattcaatcccaaacttttcccatattacaaaaatctaagtatggctcaaacacatcaagaattttattaaattcatcttcttgaagaaatctcatccagaggcctctttgacctggattggttattctccatgtctcttgctcagctgtcactttgggatgttctttccttattatcccaagggtaatgtttttagagtttattcccttgttttggtgagcacgttttccagtagcttcctgagtcagtatgcatcagagatacattttttaaaggctcgcacctcagaaataatctttattccatgctcactcttgatcaatagtttggttgagtatagaattcttggttgagaatcactttccttcggaatttaaaaggcatcacttcattcttttctaggtttcaaaacgaatcttcagaagtctgatgcccttttgatttttgatccttctatacgatacgataatgatccttagaacaagtcacaagtctcttttttaatactttatattgtgctaaatgctccaattaatgagttctggaaatttttcttcaattttgtcctcctgcagttttctcttttttctagaatttctgattttagatgttagatttcctgaactggtcctctgatttcccactttttcttctgtattttctacctttttgtatttttgctccatttccatagagatgtcctcaatttacctttcaacccttctattgagtttttaacttattctatcatgtttttactttccaagagctcttttcctattctctgagttgttttttttttttccatagcatctgcttttgtttcgtggaagcaatgttaatatttatgaatacaatatcaagtgtatttcttctcctctctctgatgataccttcttcctgcaacatctgtacttttttatttctcttctttttttttttttttttttttgagatggagtctcactctgtcacccaggctggagtgcagtgggaccatgttggctcactgcaacctccatctcctgggttcaagcaattctcctgcctcagcctcctgagtagctgggattacagttgcctactaccacgcccagctaatttttttatatttttagtagagacggggtttcaccatattggccaggctggtctcgaactcctgacctaaggtaatccccccgccttggcctcccgaagtgttgggattacaggcgtgagccaccgcgcccggccaacatctgtactttgaagttggtctttttccatttgttttggtttctttcacttactttttctaagtatttgataaatcttatctgtctactcatatttaaggctagagtactaaaaatcagattggaagctctgtttgcataggtaagatttgtcaactacatccactttttgatgatccaactgaacagtttcattcagaaataccttgcaccattatctttgggttttttctcttgggttggtgaattctccaaaggttatatcaatctcctgtccagaaggcttaagcatagttggaagctgactaggggaagaaggttgggactttcaaccttcggaattcattcaacaaatatttgagcatctatatttggcagcctctattctagccaccggagacacagtggtaaacagaatttaaaaagccttgtgttatcatgaacacaaatatataagtgtttatttaatccctctgttttcagaatggcactcagtcttcaacctgcctaggccccccttgtctagggacggttttacattcatcaggaagtataccccttgtatacttgtttttcagcttccaaaattttgttgctgttatctcccttcccactttctttgtccttgtcatttatgcctataaacatccattgatggttttctgaaggcagaggagttaaatggatatgttaattactatagatgtaatcagaggtcttcatgttgtttttttgttttctgttttactattctaacttggcatttatagatcttctttgtgagtagtctgaatttgtctttaatgatttaacattgaaacagtattttccttacttatttgcataagctctttctttgttagtgtattagccattgacctgcaatatcttttaggatgaccgattctgaagcctgctgactgagttgcttgtggttcctgtcatttagaatgtatgcaggtcatgaatcgcttagatggaacagatggaatgaaacttgctctaaatattttaccaaaataaatacatttaaataatgtaaagaaaaatcttcaatcactaggctttgaacttataacagaaaggtatctgcttttaactatattaattcaacaaactttattgaacagttggtaagtatgaagcatcatctctctgagaacaaaataccaaggaactgagtcccatccttacaggattctcaggagtaaatgggtcaatacatagttataaaatgatgagggctgatctatagcagaagtacaaagctgagaacaactcacttgacctgctaagctggggaattcaggaagggttcagatctaaagagcagacatttgaggtggttcttgaaatatgagcacaatgatggttttaccaggctgcaaaggtgacaaagtgcattccaggctgataaaagagggcatgcaaaatatggcaggtacaaaaatgtgtatttaaggaagaatgagaagtttctggaagttgctgaagatacagaaaataaagtggggggcggggggggcgggtggttggagatgaggaggagatggtaggcttgattcaaattatggaaatgtatttataatgcaccaacttgtaaagacactgttgttccctacccagcagccactagaatttgttcaggtgtcaggcggttggtgcttcaagggagatcaggcccctcccaggaccaggatgaaccatgattacttcccagccaatttcatagcatttctcttgccaatgaatggcttagatataagcatatgatgaatttgtttctaatacagatctgagaaagaaatctgttaaggaacttctggtaaagtttttatctttcttaaaaagtgacagaagaaaaggaagttgtataaatatacttagagctgctgtagtcatcttgagaccataagaggataaaactgagatcaaaaactactgtgctgaggatgggtgactagaaagaaggaaagaatctggattcttgatgcatgtttgtactactagaatcattctatcactaccttcttattatataattcaataaatctcttattatttaagctattttaaatgaagccttctgttatatgcagcctaaacaaatatactgattcaagctcccagcaaattctgtcacacataattcaaggaacgtttgttaataacttcatactattatatggggaataaatgattagtcaagaaagactttctgttttgaaaaattctggaaagatgataatacagtatgtagatttattgtcatggctaatatacatctacatataacatgaattaccttggagtagtaataaaagggcagagtaataacttgtgcagagccctagactagaaaagttgaaaatataaaatggaggaaaaagtgagttatgagattcagtaatatgaaagtataagaaataaaagaatccaaaagccatagaaggttgaaactgaaaagaattttagaaagcgtctaggccaggtgtggtggctcacacctgtaatcctagcactttgggaggccgaggcaggcagattgcttgaggccaggagttccagaccagcctggccaacatggtgaaacctcatctctactaaaatacgaaaacataactaggcgtggtggtgcatgcctgtaatcccagctacttaggtggctgaggtggaaggattgcttcaacctagggaggcagaggttgtagtgagccaagatcgtaccacttcattccagcctgggtgacagagtgagacactgtttcaaaaaataaaaagagagtctagcctaaaccccttaattatacagattgaaaaccagtcctggagaaattggaagtcctcaaagagtttaccattaatggtggaaccaggacttccacacaatgttctgacttcctttagagcactttttattatatcatatagttccttacttctcactattaatagagattattttactaagagtaagtataataagagctgatcagaagacctgagagacataatggagtttcaattctaatttgctgttggctccttgaaatgctttgttgagaaggagtaaaaagcttacaaaacacacacacacacacacacacacacacacacacacacacacacacacaatttcttaattatgtctaccatgggcatgggatggtaggaatgccatgtaactagtttccatggatggaaaccacctaatgggaaatagagaaaaagaaaaagaaaagaaattgtgtgtaaattttcagctcattttggcttagattacatgatgaaacttatttctttgaaaaactcatttgattttgaattagattatatggaacttctcctttgtcaattttaatttcttgtcttgttttagtttgcttttctgagcagtagatatcctcccaattggagattccgcaaaattagtacttagtcatcttggttcctttcaagtagaaaagtttcttttaaatacttcaaatcattggtatgcacatttgttgcaaaaaaaaacctcattctggaaaatgttgcttattttattatccaaaaaataggtatttattaatatactgcatttcttttaaataaaataaattacagattttcttccagcatccacttatttggaattgggtacatatgaagaaaagacttcttataatatggaattatttcaaaagctattattacttcttataaatataaagcatacaagaaattctcaccattttctaagatttacattagaaagatataagtattgtcttttagaatactgtttttatttttctaaatattccttataacttacttattaattttatcctttctttgttataaatatccattttttttaaagacccatactatcttttcctatgcaatttaacctaacatattttctgtaaatgaggttatttagttatccatttttctacctcctgttgcttggcagtcctcaaaaccattgcagatctttctagagagcagtttttaagaacagtgctttacttttcaactcttgatcaacctgatgagaattctttgaataaaccagaaggaaggctaaagagacaaaagaatactatagtttccttaaagttaatgagccagaatcctttggcccactttggcattgaacaatgtgaataaaatggccactctcacatcagtaatttacattttatacagtgtgtactttacactgatatttacaaagaggaaaaacaacagttttttacatgtaagaggagctccttggcagataaaagaaaaacttactcccattagtacaacactggagtttaaatctagagaacaagtacttcagaacctagtagaaaaagtccctgatttgtactttgtatgaacaattaggtttgagaatattgctatataatcacagaaaatactggctattatactacgtgaagtcttcagtgacaaagagagaaacagaaaaaatagttaatgccataacaatgaaaatgtggaatgtgaggaacgcccagtgaccgtaaatatctaccttaataagcctgacaatttgtatacagttcatgcaattaacaagtgtgataaatatgattattactctcaagttgaaatcaattttcttggctaaaagcaaagaattgttattgagcagatgggattacttttctttgccaatttatcttcataaaactcaatcaatgccttgccttaaaaatgtcaaataactcagatttcaggataacacatacaaactaatctcttctgcctgtctctacctgatcactccctacttcaaaagctccaacaacatagtataactgacacaaatcaaagcaaaaactatttttctcactgctacatggtcttatcaataatccagtatttcaatatctaataaaagataccacaattcaaagcagtaatgtgccccaagctaccgatccacaacatatatattgatatctaaaaatatatggatataacttgttatctactaaataagtttctttgcagtgtggtgttaatagccagaattttaaatacataaaaacttgggttcaaatcctaactctgccacttaaatgctatatgacaattggtcaagttacttaacctctctctggtctcaagtttcttgtctgtaaagctgtaatagcttttagagtgctcttctgaatattaaaaaggcattatactcttagcataatgtctacatagagtaaatatttaacaacaaaataacaaatattaggtgtgttattggagaattggagttttaaataaaggagttgtccctaaggtacattcaatttaactatgatatttaaaacttcaatttttcacattatttttccaggaaaatatttcactcttatttctccataatttgttttgaattgtaaaagagatttgcaagcggctgaagcagttacactatactgtatatctgcaggatgggcaactgattttttttttcttcttttttttttttttttgagacagagtctcactctgttgcccagactggagtgcagtggtgcgatctcgctgcaacctctgcctctcaggttctagggattctctgcatcagccccctgagtagctgggactgcaggcacacgccaccacgcctggctaatttttgtattgattttcaagatttgtcaagagctcctaatattttcttttctcaaacacatcttaggactaccatgcatatcagtcagtcagctactctggaggtctgctgcaaggatacacaccttccattcccacccatcagatacttgtctcctttctcccccactccaagacagcaaccttccagctctagataaaaagagctagtctttcttgcataagaacaacaaagacaaaaaccattttggtagtgtatactgcagattttaaccaaaacttctctgaagacctctgatttcctaaaaaacctcttcatcccagtgcagttgctctttcctaaatgagcaaccgcgcatctggtcaaatttggtgaatattctgtgctccagaaacaactgattccatcccctttaatctcttcttctcttatatccatctccctccttgttgtttctctccatgtttacaactagttcattgatttaaaaaccaatgtaatacacaaggaagtatgcacgacaatgtttagtgtagtatggtttgcaatattaaaaaaggccatcagtaagaaaatagttaaaggataaacttgatatacatactatgctgcaatttaagaaaactggtatagatttatacgtactaaaataaaataatctccaaaacatagtaagtgcaaagatcaatcacagaataacatctgtagtatatcacttttgatttttaaaaattacccctaattctaaatgttcatatatataaatattcagttaaaaattctgaaaagatactgctatggtttgaatgtttgttccatccaaaactcaggctgaagtttaattgccattgtaacagtattaagaggtaggactcttttttttttttttttggtgacagggtctcacttcaacacccaggttagagtgcagtggcatgatcatagctcactgtggcctcagcttcccaagctcaggtgattctcccacctcagcttccagagtagctggaactacaggcacatgccaccatgcccagctattttgttgtatttttttgtattgatagggtttcttcatgttgctcaggcaggttggtctcgaactccttacctcaagtgatccacccacctcagcctcccaaagtgctgagattacaggtgtgagccaccacatccagcaagagttgggacttctaagaggtgttaggtcatgtgagctttgccctgatgtaagggttaatcctgttatcactggagcaggtttgttataaaagagtgagacgtttggtcccctttcctctctctctcccaatctgtctatctctctcccttttgctttctgccatgtggtgatgcaacaaaaggacccttaacagatgccagcaccttgattttagatttcccagcctccagaactgtgagccaataaatttcagctcatgataaattacctagtctcaagtattctgttagagcagcacaaaatggattaaggcagatatacaccatattgtatccatcactaagtggatactttcaagaaagacagcaagactaaggagcatgaaaaaggactttctcatattctgaattttaaaaatattttatgacatgaatatatttatctattacctatgtaataaaactagacattaagagaaaaatctcatggtagaaatcttaggaaatagagaaaaattagagaaaattaagaaaaagcatgcataatttcacaaaccaatggtagccactgtaaaaaaatgttatttcattctaatacatttctacacacatatgcacacagtgcatttttgaaaacataactgagtcttttctaattgacctcttactctacaaaatttgaaatagccaaaacaaatttttgattcctataaagagatagcactagagctggaagagatggctcatgcctgtaatccctacactttgcatgactgaggccagagaattgcttgaggccaggagtttgagaccagcctgggcaacatagcaggacccatctctacaaaattaataataataataataataataataagctgggcataatggtgtgtgcctattgtccttgctacccagaggctgaggcaggaggactggttgagccctggaagttcaaggctgcagtaagctatgattgcattacactctacccagtgtcaaggaaaggaaaggaaaggaggggagaggaggggagaggagaggagaggagaggagaggagaggagaaggggaatgggcaggggcaggggcaaggcaaggaaaggggcaggggcagaggcaagggaaggggaaagggcactaggacctatgagccaacataggctatggcttccactagtacaacttaaaactcagctgaagacatgacacatagaaaagggttgctgtgtctgtacacacacacgtttcccatgttcccaatcccagtctgtggtcagtgaaagtgaagattgcctcagagcctgcattatctcaagctactgacctaattgctaatgctttactctggtctatttcctgcatgacctcagaatgtgtcagtgtaaattccatagtaagacagtagttgcacattttggagtgtggattctgctttgaaacacaaataagtgtgatgaacgtgaccctggcactctgtagccctcagtttcctcaacgctaaattgatcactacagttccttctagtgtaaacagtcccacgaagaatcgtgctgaatggatgactacataatggcctgctcctagagttcttaaatcaatccttaaaactggctgcaaaatgacttcactcctttaacagtgtgggacttgtctctgttctccagaatgctcaccagatggtgaagaagtatctctctacctaccaacatcgtcatattgcttcttgccactcgctactcaaaaactgtgaaaaacctgtgggagcaagtatcagctgaaaagggtggctttctccttaggcaaaagctacagggcaaaacgggggccccaaacttctatcacgtcaaagacatgaaacagatgatccctagttttgatcttctttgaagtttattaaaaacaagcttgaatctgtaccaatcctgacaggtgtgaatgtaagactcacaaatgagaaatgctaagctttcctaatgttcaatttaatcttatagaccatgaaacatgttataattaaagatctgaactattaatatgaaggagatagcatatattcttaccccaaatatgactaactaggtaaaatcttcaaaatataatcatggcctgattatcagccattgtggaggagaattttaaaaagttcttcattgacatcccaagtttatgttttagacacttctaatcaaacatgaatagattaacttcaagtaaaaattaatagtcacattattgattatcatgattggaaatgtatttgaccagaacaatgaggaaagagcatagagtcctgctatcttcaagtatgaatttacacttttaactgatgtcaagtcatccatagtatgaaaactcatttatttttatttgaaaaatttaaaaccatcaaaatggatagtgtgggagccaaataatatataagcaatattttatgagaactacaaaactattaagagcagtaactagaattcggttactgccgttccttatttcagaagagaaagtcaaatgttttctgatatttaagaagtaataacttcctgttgttcagttatgctttctataattatatatgataagcaacagaaaaataggtctggttttggctgtaatgtgtatattcaattcaatattaatttggactttaaatcattttgctatcaaatattttgaacctcatgaccaggaagtaatcaggtaaaaaaaaaaaagaaaaaaagtgggtttgttacctgacctatctcttaagttcaaactttctataggtatttttctctacctttgtccatatggttatacaattatcactagatgcttgaattactaaatggttttgtatatcttttcctcaaatttatatttgtcctattattggcttagtctctcaaagtattacttttatgatattgctataatggtcctctatagtataaagttgagcccacaccatttatcctgccacttaacaatgtccttaatgtagattatatggtttggccatgccctaaccaaaatctcatcttgaattgtaatccccataatccccatgtgttgcgggagggactgggtgaagataattgaatcatagggcagtttcccccatgctgttctcatgataatgaatgagtttcacaagatctgatggttatataagcttctggaattttccctgctggtgcttactctctcctgctgccctgtaaagaggtgcattctgccatgattataagtttcctgaggtctccccagccatgcagaactgtgagtcaattaaacctcttttctttataaattacccagtctagggtatttcttcacagcagcatgagaatggcctaatacagtagtatatcacacttattaaagagttgatagtaaaatagcactctcagtacaataagaatagaatagttccttttcatggtaatgaatagcttttcttcgacatctataattaacaatgaaatcagaaacaaaaagaagctgtctccactattactgaatgttgctcagaaaattctaacgtaagcaaccaaacaagaaaaccaaatatgctgtacaaatatttttaagagagaaggaaatcattctattttaagataaaaattctgtaactcaaaattcaggagaatcaactgaaaggtataaaaaaggtagaccattatgatttataagaaaggtcaaacattataaagcatgtatccacaacaggtttttttctatataccagttagaaaatagataaatgatcctattcataatagtaataaaacatatcaaatatgtataaataaacaacgaaaaatgtaaaactcttgtataaatattattgcaaaacatcactgaaggacatttttaaaaacttgaagaatatatctagtttcctacatgggaagagtcaatattataaagatatcaagtcttagattaatctatgagttaaatgcagttacttttgccctaaaatgttaaaaggctcttaattatgcaattcgaaatgtgatgtctactttcttcttgaaagcatttttcctggaaccttctgatgactctaacttaggctgcctgctttctaggcctactactacacagttgtcatactgggatttattttcataaacatctgggttggttccaatgctctttgtatcctaggttttctgtataggattcccgttgctttgttttgcttgaatatatcttcgagtaatacttccttttaattaggaagaatctgtaggaggtaaagttgtaaacttgagtccttccatgtttaaatacatctttagtttgtcttaacacttgatagtttgactatcaattttgggttctagttcttcttcctgagaactttgaaaccttgcctagtctgcattcacttctaatcttgctgatgagaagtttgatacctttgaaagatcctttttttttgttctctggaaggattaatttcttatacttagaattccaaaattttcatcagcatgtgtatacacatctagatatgtatccttttttccttgttcggtgttggatgaaacttttcaatctgaggacttgaattactcttcaggtcaaggattttttttctgttattttcccacatcctttcccattcctccacttctaccacattcttcatatcttttttacttttccatcatattttatatccttggctttttgctctatattctaagatatttgcttaattcaatattcaagaatgaatattacttgaattgcattttatccaatctttatatatacatatatattcagtattctgctatttatggaaatcagatcatacttaatggttatattctccccctgaatatctctgaaaatttaatattgacaaatttttcccacacttttcattgtctctgtttcttctggaaagcagaagataaattgtctcaggaaaataaatttgtcctgtttatttattagttcctttttgtttaggctactggtttttttgtttggtttggttttttgtcttttttcaaatgtctggtgatcctttcttgactgggaatatttgtaatttaagaactaggagtttcttaagtagttggcagggatatcataaggagctctgtagtacttataaactgcttataagcaacttaatgcaatttcaatcaaaatcttaatgggtttttttgggggggacttgacaagtagattgtttgtataatttagcacaacgatgtgagaataacccaggaaattctaaaaaataagattaagagggaatatgttctcccagatattaaaatgtatttcttaaaatccataataattataacatggggctttttgtctagaaataggatgtaaagattaaaaaaggaactaaccataaacagtagaagtggcatttcaagccaataaggaaataatagattatgtaatacctaggattctgacaatttagaaaatctaggaaaagaacatcagagccctgaaataaagtaaaataaattccataattattagagatataaatatatgatgtaaaatgattaaatactagaagaaaatattggtgttggaaaagaattgctaaggatttataaaatatatttatatagagactatataaacaatataaacatacaggctacatagggactatttaaacttctatttattaaaatagagtatctgtaaaagtaaaaatagaaatgaataaatggcaaaaaagtgtaaaaaacaaacataaatgaaaagttaatattcttaatctctaaagaacactctaaaatcaataagaggccaggggtggtggctcacacctgtaatcccagcacttcgagaggcagaggcagtcagatcacttgagtccaggagtttgagaccagcctgggcaacaaagtgagacacctgtctcctaaaaaataaataaaaataaaatcaacaagaaaaaacaaatcagcccacgaataaataataaaataataaaaagcaaatatgtataattgccattagacacacaaaacagattttaatattcttgaagctaaattaattcttattaaaacaaaatactatgtgattcatcaaataaagagaacaattaaaatgataaaatatagcaacggaaataatgtagaaatagagactgctgatgaagtatatataaactttctgcagggcaatatgacaataatagcaaaaataaatctttaaaatattgggcaattctttagtttgacaattctaattctagaaatatatagtaagaaaacaacccagccttgctataaagactctacacaaagatattcatcacaatagtgcttataatgtgaaatctggggagagcttcaaatatttaataatagaaaattgcttaagtgtagtatattcatgtaaggaaatgccattaaaatgttatatagagaattgtatttaatggtaagaaaagtgttcatgatgcaatatactgtgaaattttaaaagcagattataaaatattaccttcagtataatctcattgttgttagtaaaactccttctctctctacatacacactctcacacacagagacagaaaaattatctctcaatggcataattattgacagttcgttttctcccccttgcttattattattttgtaatagatatgctatagccactcaataaatatttgttactaatttcaaaaagtatgtattattatatccaggttgttcatggaatttatcatgcaaacaactaccctcttgagagagtcaaaagtggacactataaattatgaattcatataaactatatcaggacaatgggcataaactgagtgtcccaggcacggcaaaatgtgcggataccctggagatgtatcttgactttaagaagtttacaatctttcttggggatagaagattaaaaaacatgaaaccattagaaataatctcccacaattagttttgtaaaagcaagtgcttaattgtacttgacaaacattagatgttactggaggtctaagaagtaagagctgaatactcgtcagaaaagctccctggaggaagtggggactgagtgatacttttagaataggtaagaaaaagaataatgagaacttttcaaatggaggttggggttgtagaaggaaaagaatcaagtattcagaggtagctgataacgatgttgtatatataaaatcaccctgacttttgcaaggggtccgtctatacagaagagtaaaaagtaaacaatctattaacaatgtactatcactgcctccactttacacaggagaaaatcgaggctttagaaggttacataacctgccaagggtcacatagctaaaagtggagagctgagatttgaacctaaggagttggtttcagagtctatgctttccaccctatgctgtactgcccactacagtcaagctctggcttcttgtataaatctgatgtcactctttgtgggactgcttataacatttcctcacccagaatccatacctcctcctttctgctctgtcagagctctttgtctattcacacacagttcaaagaataccttctccatcaaatttttctaacaattccaatcttggaattctctcctaccttggagttgagaacaccactctcctaaatttctgcctacttctcagccactacttctcaatctctttgttggattcttctttctctatatttttgtttttttagtctactcattgcctgtgtgagtaccttcacccccaaaactacaatacctacctaccattgtgctgaaaaccccagcttacattgctcttccacattccataaatttctatctggatgtgcacagacacctcaaacttcatatttccaatactggcatttaccctatctgcagtttttactatcttatggacagcagatgccagaaatctaatcactgaaaccagaaacccatgtacaattcttgagtcctccctctctcaagcctaaaatcctggaagtcaccaagttctgtctattttactctataaataactattagattcttctttcatctgaactcccttagttcaagccctctttgtttctcatatgattattgtagtaggctctgaactggttttcctggtacctgtctttcccctgcctactccaattctacctccacatcaacatttctcaaatttgaggggtcatagacttccaaggacatttccacaatccctgagaagtatacagtttccatatgagaaatcactgtagctaaaagttaaatacttttcttcagttgattatgtatagctaaggcaataattcaagcattagtaaatacaaagccaaaatgcaggcacattacgcagaaaatgcctgttcttgggtttttaaaaaatacgttaaaaaaataaggccagatgtggtgactcccacctgtcatcccagcactttgggaggctgaggtgggatgattgcttgagaccaggagttcgagaccagccaagaaaacatagggagaccttgtctctacaaaaatttttaaaaattagccaggcacagtggtgcgtgcttatagtcccagctacttgggaggctgaggcaggaggatcgtttgagcctgggaggtcaaggctgcaatgagccatgattgccactgctctccagcctgggtgacagagcaagaccctatctcaataaataaataagaccacaaaggaaaaaaattcttacagagaattattgaagtataaattgtgtcaaaattgaagaatataataaaccctaagattaatagtcctgtccttgagaaagatcatcaagtgatgcccccatgctttaaaaaatattccaagctttttagcataatatctaacatttcttagcagttcctaataggttacttctctgtagttacctctctcactccttccccatcacctatagtgccacaatctgtaacctgtttgaggctctctcacacctttcatactgcaatatttgctcgaactattgacccccaaccttactcatctttcctttctaactaactaacttctcctcatcctcaaagccccagctcaagaattttcatttctggaagaatctctgattttcttctcttctctagtcttgaaatggtatgtgtgaacccacagcttgttgtaatgtcattgtcctttctgtttaacaccctcagttgctggtccttgaagtctgggactgtcttaatctactttaaagtcttcaagccaagtacaattcctaggcatgcaatacatgtttgttaaatagatggatgacctttatttatatttatctttcccttttctgctacaattagttaactcattcatttcttcattcactaataaccacttatctgttattttctgggaatacaaaaattcataaaacatcatccttgcctccaaaaaacactttattattgtgccatccttctctctctttctctttctctccttctctaattatctagttgtgtaggtattttcttcaaaggaataacaggtactcagaggaacacttatacactgttgatgggagtgtaaattagttcaaccattgtggaagacagtgtggcaattcctcaaagacctaaaaacagaactagcattcaacccagcaatctcatttctgggtatatgcccaaaggaatataaatcattctattataaagacacatgcatgtgtatgttcattacagcagcattaacaatagcaaagacatagaatcaacctaaatgcccaacagtagtagacaggataaagcaaatgtggtacataaacaccatggaatactatgaagccataaaaaagaatgagatagtgtcctttccaggaacactgatggagctggaggccaatatccttagcaaactaacacaggaactgcatgttctcacttgtaagtgggagctaaatgatgacaactcatggacacatagagggaaacaacagacactgtgacctatcagagggtggagggtgggaggagtgagaggatcaggaaaatcaactaatgggtattaggtgtaatatgtgggtgatgaaataatctgtactacaaaccccatgacacaagtttacctatgtaacaaatctgtacatgtacccctgaacttaaaagttaaaaagaaataaaaaataaacagaatagtagggattcattacaatatcttctctcctcctcataattcttaaacctgtgtagaagttcaatacatatttgtggaatagccttattacgcctttagggaatggagcaatgccttgcctattaatctatacttctatcagagtttcctgctgtatggaaaacctgagtgttacacttcaaacaaatgaggcaatttatacatttttgttgttgttgttgttgttgtttttggcataaatgtgctaagtgagctggagtttcagaagagaaactgaatgttatatgtgaatccaggtcagtagcttggctctgactacaatactgatttcattcaagataaggaaactaattggtatcaattttagttgacattatatgttagttttataatattcaggaatttttgaaggattatttgatttttatttttatagatgttcttgctctttaacactaaataatgaggaaagataatagggctaacatttattaagcatttatgttggacaggcactgctttaagtatttttatatgtatcaactcattgaattttcacaactcttagatctatttgatagctggggaaactgaggcacagagaacctcaagtaacttgcccaaggtaagccagctagttagcatggaccagtgattcaaaaacaggcagtctgtactccttacaactgtattatgctgcctataaaaggaccactagactaataattatgaaaccagatttttaatcttaaattagccatataatagtagagtgcatttaaggatgtcatctgagtttcattgtccttgtaccccttacagcctgtgagaaggaacctttatatagtctttcataaactgtaaagtgttataaattcaaagatttcttataatatgttaaaattacttttaagagttgagaagtccaaataaaagcagagagatgagaggaaacactagcactaaatgttcagacacccactgaccacgtcaagctgcacattttgttgctaaacctaagggagagattagatatgaggagagtgggaagcaagaaggtatgaagtctgggtatttagggactaatagaaatgattttctcgattagtttaagaacattagcaattacttacgggataagcacagttaaaggaatttctggaaggaataaaactataaaaattagtcaaattgttaaaatatcagaactgtgtaaaagcatataaagtttcatcatatctttcttttgaaaaacaaacaaacacttcatgttctagccagttgctaatagtgatcagttgatgaatacacctcatgtttcacgcatataaaattttacaccatgtctagtccataggcattagtgtaggagtcagaatacaacctgaattctgttcgcagctttgtgccttgtcgataaagcagtggacatctctccacagggagatatgtttcctcccgtgatatagaggatgttgattcacttgtctcctctctatttcgaaaagatgctctgaagattagtgagacaatggctgtaaagctctttgcactgtttacaacataaatcatacacagacatactggcatgagaaacgctatcatcatctcttttatacatgagaacaaccataaggaaaacaaacctcagagacagtcctgtattataaaaatgttgggtagagatgccaaaagttgtagggtaggaaacagcaacaacaacaacaagacggaatccaaagaatatttgcattctataatatattctacagagtctcagacgggaccttcgttgagtgctcccaagtattatcagtagccatgttttttttttctttttcttttttttttttttttttttggtaaaagggataaatagtgatgtcaggagatgctgcaaaatatattccagtgataagcatatggcaagcaattaatggatgaattcgcctctcttattgccatgttgtgacaaatactctaacttatttggcctttggctccctaaagggtgctcagaaatgctgtttagaaagtacttttcatgaagagctacaacaacaacaaaaacaaatacaattcaaatatctactaaacatatgaaggagtactcactctcattagtaatcagagaaatgcaatgatcccattatagagccctgtcatttgaaaaaaaagaaagaaaatccaagtgttttttattagaacgtggagcaacaggaattctcattaccttctcaaccactttgtcaaatgctttctgcttatctgctgaagttaaagatatgcatgacccatgaatccactcctaggtatattcccccacaaaaatgtacgcttatgtgcatcaagatacacgcacataagtgttcgaaatatctttattcataatatttccaaactggatatgttcaactgcataaagaaagaagattggacagtaaattgtggttcctttatacaacagaatgctatatatcatgatatatattatgatgtgcaatcctcagctacatacaacattgatgaattttacaactataatattgcacaaaaggagcaaaacacaggagtatctacaagatgagtccatttacataaaatgcaaaacaaactaaattgaactgttgttttggcatgcatacatacgtggtaaatcataaagaaaagtaggaaaagtaaaagtaaagtcaagatagtggtgacctatctggagaggatgaaacaggaaattatagggtctttctgaggggtgatcatagtaggtatttactttagaacaatttgttaaacttaaaatttaaattttacatactttcttaaattttgttatatttcacaatttaaaaatttataaaatgataattttacaaagcctaaaagatgaattatttgggggcttttacttctctttcatctgtacaactgctgatgaaaatcaccaggtgtgtataacatgaagcatctccttaaatgacatgcatttattgggaaaaaacacaaagtccaaatggtaaaatgttagcaaggtaaaacactgaagatttttctccccaaaactgccaaacaagtctggtttaactgaaattgacagcaaagacaacagagcacacttaattgaattttaatctcagtgatctctaagccatgtttgaaacataaacagacatgtcagagttctttatgatgttggacatgaattcattttcataattcaaaggcatactttgcttatgaatctctttaacaagctttggctgaatattcttttcttccagatgtttgctgttgtatacacacagcttccatctctttgcagatgatttaaaacatagttagaaagagtacatttatttaacaaaagagtaagagtacagaattcaaatagatcgtctgtgggtgtatataatgatgagtacataagtctcatgcagtcctcataaagacagcatctattaatctgaagaagtttctcttactaatttgcaaacctaaaagcattttacattactaagatattaataaataggtcaattaatacttttgatagagtagagagactcctaaataatggacatgaaaaatgattttgtaaaagtacggtttcattttaaatccctgcttaagcaatttgtaggaggcaagatagtgtggcagttgagaggatggtctctgaaatcagatctgaatttgaataccacctctaccatttactaacctaaacaagtcatattacttctctgtgtctcaatagctacttcctgaggtgttcttacaaaaacacaaataaataatccatgtaaagaactttgcacagtgcaaatacatagtgagcacgcattgagttttatttatcatcatcatcatcttgctgtacttttgtaaactcaccttctcccgtctttttctactctaaggtgctcttccaagctactttcctcctcagctatcgttcccctggatttccagtaagagagggtgaaatcatgcctgcttatcttctttctcttttactgatacttcactgaagtgaaagtaaaggaataaaaacacaacacacccacccacaaaggcacaaataataaaggaaacaagatcagcaaaggagagatttctactgattttttgaaatcagaaaatagctgaagtgccttagcataatcgaggaaatggttacggagagtaaattccaagagaaagtggactaatgtgttctcccgaatccagaaagacttactgcttggaggcagcagaattaaggaaggcaggagtttagcgaggggctgaaagtgtattaaaattatatggagcctttggatccaaactaactacttcccttacctactggaagcggagtctttcttttttggaggaaatcggctagagagatttgaaactgatgatactaggcactgtagcaaactaggagaggctgcaggttgcgaaataggtgcttatttgaaagcctatagagtttgcaataagaaacccaacttttttatttgtcatgctccccagacattagcagtcagttatatgccccaggcgcaaatctcgcaggcagaaagtggggtaccccctaatcatgaccttggggaaacatttcaaagaacacaccggctttgattgaacaacctatgatgcaacagtgcaaccctacagttgacgagccctatccatgatcacagaacttctgacattgtttcttgccatcattgtcattgttgctttgttttgtgtgtgtgtgcatatgcacctgtatatgtcttgcttttaactaagaatgaacagcctcttaaggaaactctccataatgaagaagagaaactagaagaagcaaacatcaactgaagaaagaaatctacaggaaagagagagacagaggaaaacctcaagaggataataatctgtgaccttagataaaacacacttctgacataagaacatataccattaaaaaggagaggatgaggctgggcatgttggctcatgcctgtaatcccagcactttgggaggctgaggtgggcggatcatgaggtcaagagatcgagatcaccctggccaacatggtgaaaccccatctctactaaaaatacaaaaattagctgggtgtggtggcatgctcctgtagtcccagttactcgggaggctgaggcaggagaattgcttgaacctgggaggcagaggttgcagtgagccaagattatgccactgcactccagcctggtgacagagcaagactccgtctcaaaaaaaaaaaaaaaaaaaaaaaaaaaaaggagagaatgagagtgctaaattatttttaaatcatgaccaaaataaacattttaatagtaaggttggaaaataaaaatgtgtgtgaacaaatcttctagaagaccaaaaaacaaaaagacaaaaaaggaagaaaacaattaagaaattaaaggatatgatctaggagatccaactaagataatgagaattcaaggaagaaagaacagagaaaatagagggcataaaattatcaatgaataagagcaaacatttcagaactgaaggactcatatctctggagtgaaaaggtctattgcgtgcccagggcaatggataaaaatgcagaccaagacaattgatcatgaaatgtgggaacttcagtaaagaaaagaaggtcacaaaaatttctacacagaaaaagatcaggatttcaccaatagaaaatactggagtgatgcctacaaaatgttcaaaaaaatacatttttaacatagaatccaattgcagttaatccatgcctgagacaaaaaaaggtttaaacaaagggctgcctctgaatagtatatagaaaagatttctgaacagaaaatcttaaaaactagcttttatccccaacttggatactaaatatagagacaggcaagaattaggggtcttcttgtcattcttctgagactctggagctcctgagacttctttttcactaacaccattgaatccgggaatcaacaagctgcacaaagttataaagattgccagacttcatgtttctggaaaaaaaaaagtactattttttcatacagctgagacctctgaaaagatggctcaatgggcaagatgccatgagaaatcaaagccaaatactcattctgaagtcagttttgctcagactttgtatactgccactcaatttttcaagtcatcagaaacataactaagaatgagtgactttttgctatcaactaatgacccaccattcaacgatcttgtatgacaaagtagaggagtatcttcttatttttaggcttattaaattacaatggaaaatattcattaacaatctcataatgaggcattctagatgcttattcttacctaaagggaatggaacaaaaaataaccaaaaactaaaaagatgaagacaaaagcctttcttggtattatagtattcttttacaaaggatatggtttatcatagtaattgattccctctgttacactagagatactattatattaaatgcctaaaggttaaacttaggtaacagtggagctatagttctttcagaaataaaataattaaatagctatgtatgccaagaaaccttactttgaacatttctattgtaccatctcattattgctggctgcctgattagcaagcagtaaacttgggtaatagctttcctctgatatcacttcaagtctactcgagttctagaattacccagactaccaggactttacttgcacaatatgctgaaatgtttataacattatgctttcccctcctaattctcaagaccattttgataactggctaagactggataatatcaacaaatatgaaataattataagaatcattctttcttaaaataagaagagtttccagaaacagaaactaaaacagaattcaggctaagctgctaaataggctatctcagggattctcagctcattcttgatgaggatagattgctttttatttcccttaagtgttccgtatttatttcacaaatattacttaactgtgtaccatgtacaaagccgtgtgctagttaagctggttactgtggaagaaataaagggagtgggagcatctagcttttttcttcaaaggagatgggggaatctgtgggagttagtggtaggggcacctacagaggaaatagctgaaaaggaggagctggggaagatgaggatgaggaactaagttgtgaataaaggaagggcagagcaatggtttttttaataatattggaatgggatttgtttttagcactgctcccctttcccttaacagtccccttgagctacaaataaatgtaactggcaaagtggataataagacttcagaatcttctagctaaccatgatcaatgtgtcatggagcccagtatacaaggagaggttctatttcatcaagaaatatgactgcacttttagtgggcaattggttgttatgaaggtccagcatttatttcttcttccttttgaaaaataacaccctgatttcctttggggaacatccccatggtcagatgggaccactgtgattgactgattggttcaggagaggggctatacccttaattatgtgggagctactagaaagagatgctctctttttttgttggacataaaaaacctggaaaggtatggcactagattgcagacattggtctgtctcatgtggatagagcagagaatgaagccaaaaatggagagttcttctgatatcaggcatcagggagaaaacaaaacaaaaaacaaacaaaagaataaaaatggagagttcagatacaggacccatagacagagaaactaaatcctcatgaagtgttctaattgaaacagtatctatggtctacctaaacctcatgggaaccacattaaatggcggataaagccattaatatactatacatagaagagatacatccacaaggacatcttaccaagtgtggacacaagtgtgtaacaaccacttattggtgtataatattataatccacaacatcagattttactctttaaattcactagggagtattctcaaaggaatggaagaaacaaagctggctatcagtgaggggcattatgtgggtaaatataagtagaaacttcaaaataaatttcttaaaagcaattttcactttctgaaagtttatatggaattggcaaatgacaaggattgtgatcattgatacatgcaagtcaacaagcaaaactaaccaaagagacaaacagacacatgaataatgaggcagttctgatgaccaaaaaacacaactttacaagactgtttgggtaatttattttgactggtaatacatcatgtcagtttattttatttaagccacagcaacgtttgtcttcctgacgatagttattgcattccagagaagtacaatacgaagtttcagactagtgctgggcttagtcacacagagaactgcagtaggttttctaagcccctgctcactgtatttcacaaaaatctcatcccttctaccctccactctctaaacacacatccaagcaaatcacaccaaggcataatcattgaagaacaccataacttgccaattaaaatttggcaaacagaaacattgaagcaaaactgaaaaaagaatcatgtaattaacttagaagaaagcttttttcttaaatattatttttcttcccattcagcatgcacaagaagcaaactttgagcactaacgtgttcctttttagcctttgcctgtttgtttcaaagacaagaggagaagagtctgcttaaaagccaaatacactgataaatgtttactgataaaatcttccagatgggactactttcaaggaaggtcaattacaagccttgtgtctctccttttaatgatatcctttaatgatccccttcctctcctagaaaattaagtcacaaaaacatcttaggctgagagtgacccagtaatcctcataatcacattgcaatgacagacaagaagatcaaagtacaggtgcagtgagaaatagggttttacatcctattataaaatgtgaacttgccattaaccaaagatcaaatgtacctttaactcccaaattcccaacttccaatattttttaaattctgtggttttctggattaataaactttctctaatataatattccccctcccaatttttgtactaaacattggtggttttttcttcacatatggtgattatgttttcatatatccaataactaaataattttagaaatttggtaaattgtgttgaaactctaatagcactaagaagttcccaagctagttggtaagctattgtctccaatactgcaaagagaaaacctagcaatggaaattacataaagataatctgatgctaatatgttagttagaaagtgaattaggcatctagtaatggcttcaataagaaagaggtttatttttatctcatattaagaaaatgtagcctgggcatgttggctcatgcctttaatcccagcactttgggaagccaaggcaagaggatcacttgagtacatgagtttgagaccagcctgggtaacatagtgagacctcatctctacaaaaaattaaaaaaaaaaaaattgctgggtatggtggcatgcacctgtggttccagctactcgtgaggctgaagtgggagaattgcttgagtgcaggaggctaaggctgcagtaagccctgatcacaccactacactccagcctgggtgacagagaaagactcaaaaaaaaaaaaaaaaaaaagaggaaaggaaaaagaaaagtaaagaaaataatctagaaacaggtcaaggttggaatggtgacaccatgtttatcagggacctaggttcctattatctttctgatccaccatccgtaacacatggcttccattctcaattctgccatttaggttacaagatggctactgatgctccagccagcaccagcaccaaatcactactacacaaacgggaggaggagtaaaagtgagtgcttctaggcaggagctccctctgctaacatgtagttggctgcatcaatctcttagaaagcctgagaaatgcaatcttttgactaggcagatgtcacccaatataattaagattcagtcagtcatctttattatattggttactaaatgaacaaatctgtaaggatattcagtcagcaccagcagtctttgtcacaccatagaatttctcaatcctggatggaatttggtctaatcccttacttacagaaagggaaatggagagcagaaagattaagaaatttcccccaaaggacacaactggttagccaaagaactaggtgcagaattcagatccttgatctatcagtaaagatccggttctttactggagcaaacttcagtgaggtcagcccaggaaattcagctaaccaacatgaacaaataacacatcttactacctgggtcagaccctgtgactcacacttcaggctttacagtcataactgctcatatgctgtaacatccaccctctttggttataaagtgagaatcaccatattcaccacaagtcatgtacatgtttacatggccactaaataaccaacaaaatgagagatgcgccgcaaaatgtgacagtacgagttactgtttgtaaaagagcagaatgttccacactcatgggtaaaaattggtacttgaacttcatgagtgactctagatcttttatggtggtggctttttaaatacagacaaacacatgattatggtatctcctgaaactgacattctcaaaataacatccactattatacaaaggaagtttgaatgttttgaggcttttttgcttttaagccattgctcttacctcttatctcttcttcgattatggccatcacttacttcctcagactccacccagctgcattctcaacaaaccacagtccaggatgagaacttctataatgcatatgcttccttcagcactttgagatacattattaggccctgctctcatgttttacttcttttatgttccaagcttcttgagggcagggccaatactttctttattttccataacacccctcatatgaaaaagattctagcattctttcacaatgtcatgcttagaacattccaatatttttccaacctatctcccaaactgcttcccatggttccactgattctcttctttcacccctactcacaacacagggtacccgagtgattgctccaaaatacagaacacagcaagccacatttctacatctttggcggtgcgccactgtctataaactttttaataaggtcgccctaacttgctttctcacatagtcttattccttgccatttcctctgtttgcgccctacatactgtaagttactccgaaacattcatctttttctacatgcctgtgactttgtacatgtagttccctttgtctgaaatgccctttcttctttcgtttatggagattccaaatggtctccaaggtatatgtcaattattatccatgaaaggttttgctatatatatccagtattttctgggggatggggaagcttaaacaaaaaaaacttgaacattactctacacacagtccattatgacatcttagtctatttggaaaactccactcgtgtagaaattgtgtttatttcagttgactgtgaatacaggttctgatgcacaggagctactcaatagtttgctgaatgaatgaatgtcagttttcctaaacagacttgaatgattttcttgagagtctaactgcttgtcatactacatcttgtctcatttgattctagatccacagaagctagcacagtacttagatgtaaaaattgttatatctcttttgtttttccagttaatcactggagaccagggctgccctttcaataggaaatctaatatctctctttttgaaaactacccctctttcaaataacccaagaacctcagggattattcagtctaaagcagagtcgtgcttctaaacttcaggtgtagagaggacggcaattggtatgaaggcttctgccactgccatgtggtatcacagtgaacaatggtcctgtccagacctgtgtccttgctggtttgggtctccatgcccagccttggactccaagagtttggctctttgatttaactcatttagtaaagatcagccctcactcaacaatctaagatgctcttcttgagcaggcagcttaggtttccccttcctctacacagatacattaatccctctagggcccgccgtatcagcattctctcccgacaatacaccatgggactgccctttttcatccattctcatgggtttcctcagtacttctaattgtgggacaaagtgagaaagtctcttttctcctggtagactcctgaattcttaggtagtttggtccacgctatcctcaaactgtaccaagaggaggggtagcttttaataagaagggggaaattttgtcacactctttctccaaagaaaaagatgacaggccttatgtttatatagctaagggaatccacttaatgatttttccaaaaataataaatacaaaaacccctagcaggttttccaatagtagagttagaagtggacagtcagatagaatttctgcctctccagtcaccctcttacataggcatggtaatatttattgaaattcactataaaggcaaaactggatgaggacaattgagaaactcttgtcctaaatatcttttcctgactggccaaggaaacagtgagtctaataatcaacttttttttttttttaagtgcatagccctaccagtccaataagacaaaaaagattcattccaaaggaaagatctggcatttcagggtcacatttaagtaggagaggatgcatacaataataagatatttcaattagacgacaaagtcagccataggacacagtaccagtagtgtcttttccactaagaattggggaagggaggcttaaaattcaccttatgtttgtttaacaaacataccagggaatccttccttcaactgtgcccatcgagttgagctacacacatacaacataatccaggggagactgccccaaactgaggctttatttactaatttgcagtacctctgaaactgttaattttttccctacttttttttttttttttttttttgagacagacttttgctcttgttgcccaggctggagtgcaatggtatgatctcggcttaccacaacctccgcctcttgggttcaagcgattctcctgcctcagcctcccaagtagctgggattacaggcatgtgccactactcctggctaattttttatttttagtagagatggggtttctccatgttggtcaggctggtctcaaactcccgacctcaggtgatctgcacgcctcggcctcccaaagtgctggggttacaggcatgagccatcgcgcctggcccctacatttttaatgcctctaaaatccagacatgtttttataatcaatggcaccttggacttgatgaaataaagtaatcaaatagttttaataaatcaaatacctttaaaaatataaacaatttaaaaattgttctaagacccaggttccaacctcaggatctggatatgaccataatgctatattagcatattaaagcagagacacagacaatagcggtaacccttcaaaggggaaaaagcctgtcagctgaagatgatagaggaacccagtgcttctcaaagggggttccccatccagcagttcatcagcatcagcatcacttgggaacttataagaaggaaaattctcaggacccaccccagaagtactgaatcagaatttgtggggcatagggctctgtaatctgtgttttaacaagggcatgggtttgagaaccactcatatggtagctaaataaagaagacacttggtcagtatatacttggcatgcctggggagggggagcataacacttaacagccgaatgttaagactaccataaaaggaggaagaatctcaaaacccaatgcaggaaagccctttaaagtctacagttcctagtttctgactccatatatgtcaaagcagcttctaattagaagtttgtttctcaaggggctgaactacaaggacagaatgaactgatctggccaatatggtatcctgtctacttgtcaatatatttctcactgtgaattccctaattcatgttcttgctcttgcataaagttcatgagttctgagtgtcagtgacagcacctgatctaattgggttctgagaaaatcaattctgaacctgaaaaactaaaggtcagtctttgaaatttgtatatattacaaagacccagtccaaaagggcccagaacatacctaatactcatttaaatggagtatttaccaggtcaagagaagtgaagaattaagggcaattaggtcaagattgcaaactggcaatcctcaggccagatctggtccacagatgtgacttgtttggcccacacacgttgttcaaaaatgggaagtttcgcattaaatattggatttcttccagtcttaaaaaagcaaaaaaaaaaaagatttgacaatagggagcccacatcctggcacttgagcactagcctggagctaggcagaagctgtctcctttaaacaggttgtagcttccaggtcaccccagtcccaggaatctttattgacttctggctggcaagcttctccctttatgtgaatatgatctgcctgacccctggtttgagacgagtttgaagacctttgagctacataatcatttttcatggaacagatcattagactgatttgaataaaatgaattgctcagaaaattagctttattttgtacctttagagctatttgtatgtgtgagcagggatgtagaggttagttacttttgaaaacagacagtgatgaaggcaaatgttgccaggcagagtataaagagaaccagcctgggctgtctagacttggatctgccacttactaaatgtaaaactatcccacagccgtggtttgcatatccactaatgggaatgataatatctactatacacagggtttatagtgataatcgaattagataatatatgttcgagactatatagaacctcaaaaatgttagctgaattaaattttgatggttttgttttctgaattttactttagaaattgttcctaacagattacaaacttttgaaaaaacaatcaaaattaaacctcaatagtcttacattgtgatcaaataatggaattaacatttattgactgtaaactatgaaccagatagtatgctgggtgctttaaatacattgtctcatggaacccataaagaattactgagttagtattatctatcttttacacattaaaatccaaggctagaaaagtttaggtaatttaccaaagtcacacagtaagcgttggataaccaaggtccatcttactccaaagcccttacatgtgtgattactgtagtgtttctcaaactaacatgattatacgaatcgcaggctagtagttaaaagcgtaagctctcctatttatttccaagcttactgaaccagaatctaaagggatacatagccttgaaatgtgccacattttaccacagccccatgtaattcacaacagcggcaaggaaactgcttaagaaagctgataagaatcaaagtaagtagaaaaagaattactttgcgttttattcaatagaagaaaggaaagaaagggggaactaggaagaaaaggagggaaggggagggaggaaagaaggaacaaaggaaagagggaaggagagaggaaaagaaagaaaggagggagggaaggagacaggcagaaaatgtcctggagctaaggcctatggcatttgaaggatgatgtgaatgcacttactagatggatgctttctttctaactgcacccagcctgtttactgcaaacataaggaatcagccaacaggaagctcagcttgccactgcagaggagtaaagcactttgaactacaggcattttgtacacccaaattacatactgtgatacacatagtatttgagctgttccgcaagacagaagccaattattcttggcacgtacttctgtcgtgctatccaaatcaccatccctcacatgtggaactgtgccacatcaaacgcaccaagtcacaaattccttaaactctttgagatgaaagtcaaattttggagaaaaaggatagtctggtatatacaccatatagccaaaaagatgtgtgcttaacttagaactgctgggtctattatgagaaaccggggcagcaaaattctgccttaggaacttttcagagttttgtaaactgaatttttccaatgtaattcagtattatcattgccttttctaatcttagttatttcatttatagtattcatcttaaaataattttccagcctctccctttaaatgtttttaagcacagtggaaaaacatagacactaaaacaaggagtagaggttgtaggtaccatcaaattctattgagaatcacagaaactatgcataagtcctgaatggtagcattatttgataatcagatcagttagttaacccactccccttaccccttacaaatcctgaggttaaaggatttaatcaaaactgtcagatgatatgaaaatagaaatcaaatgataattgttaatagtattataaagaatttaaaacataaatcctgcaagattaaaaagcagaaagtggggtattagatgcaccagctttgtgcttcttaagctttaaatatgctgtggaaactcctagaaatcttgttaaattgcagattctgatttagttccaagattctgatttctaacaagcaccgatgtgactggcccaggggtcagactcagtagcgagtgggtcaatttaagaaggcttgcattggtgaagttctagagatgtgatagagaatctccccataggagggagtgtgacctaacactagtaatacctagaaataaaatgtaaagatgaaagacagatggaagtgttcgtgtaagtgtccagttgctccagaagaaattggttacctatgaaatagaaatataatcttagttttaatgtgagaagaattctaagaaagtaaacagatttacaactaatatataattgggtttctcaaacttaagactctgatgaggatactggatcatccacccagaaaaatacagataatgtacatgcacatactgcacacacaattctttacacagtttcaggaagttcactgagcttcctttggaaaggtgtgaactacctaagggctcatatcacaatttaagactaccaatgcacatgtgtagctggtatagaggaacaacttgtagttttaagactaattgatagagagggcagattagaatctgcttatgtgtttgactgatgatgttattgcacaaaggcttatgatttctcagtcacttctgtaaaatataaactggttgaaatgtatatttttccaaggtaagacattaagtatcttcatattaggtaggaaaaaaaccaccatgttaggccgggcgtggtgactcatgcttgtaatcccagcactttgggaggccgaggcagttggatcatgaggtcaggagttcaagaccagcctgaccaacatggtgaaaccctgcctctgctaaaaatgcaaaatcagccgggcgtggtggcgcatgactgtaatcccagctactcaggaggctgaggaaggagaatcgcttgaacccgggaggcggagtttgcggtgagctgagatcgcgccattgcactccagcctggggtacaagaatgaaactccatctcaaaaacaacaacaaccaaaaaacaccacaccattttacaaagttaaatatatactactttggaaaaaacacaagacaaaaatccaggtttgaaaatgactgcacagtacaggggtttctgaagatgtaaagggcaattgttgttttatgctggtagcatacatcagctttttttctccaatagttttgaatatcccaccacctgcctttttaaactagtgagaaattataattatttagagctgtcatttaaaagtcatagaaaaccagttaatgttttttgaaaaaaacagttattgatcacccaatcttagataagcaacttaaaatctaaaagcaagctacatctgtgtgtgtgtgtgcttgtgtgtgtgtgtaaagttatatgtcaagacataatatgaaatatagacataatgctatgagagtgctgagggcatttttctttttcttttttcttttttttgtttgagctggagtcttgctctgtcatccaggctggagtgcagtggcacgatcttggctcgcaacatccgcctcccaggtgcaagtgattctcctgcctcagcctgccaagtaactaagattacaggcattcaccaccatgtctggctaatttttgcatttttagtagagacggggtttcatcatgttggccaggctggtctcgaactcccaaccttcagtgatctgcctgtctcagcctcccaaagtgctgggattacaggcatgagccactgcacctggcaggagtgattatttccaggatgagataatagagatgtatgaaggaaatcactgagttagctctgagctggattcaggatgagtaggatttcagtagaaggagaagtagaggggaggcatttcatataaaggaactcccaaaagcaaaacattatagagggtaagagtggagggaggaatatgctgtttggtctaagaagagaatgatatttcatcatacttgtaatattactacttgtgtaggctcttcttgactcggtttgctttaaccaacagaacacaaaaaattggccacatgccagttctgggcttaaacattaagaaagcctggcttttgtgttcttggcagccctgagttgccagggaagaaattctgactaccttgctggagagttcacatgaggaatccacatggagagagagaaaagccatgagactacatgaagaaagaaagaaagcaggtcatctcagctaagcccagcctccagtctactggagtgactgcagccatattggggaccatgggtaagaccagcaggactgcccggctgagcccagcacagactgcaaaatagaatggttgtgtttcaagacatcactttctggaatagtttgtttgcagcaatagaaaactgaaactgagtgtttatcaacattttaaatcactactgccttttgataaatacaaaatgcgtaaacccaactggagattcagatgtagcactgtccttctacactcactagtcaagacttattttgaattttattattttgtatcctaatcctaaattttgtttaggatacaaaactctaggtttcttctttttacaaataaaaactattataaaagtaaataaccatcaaaaaccattccctgaatcacctcttctattgctcctccttaacagtagcactttagatggattagtgtacatgtgtatgtgcacacatgtgtgtatgtgtgtgcatgtgtgcatggtaatatttggtcatagggaagattaagaaaaggattagggctaaaaggctgaacatagggtgatatcttcggttttagagggaacctaggacagtgtttctcaaaattcttaccttaaaaaatattggccaggtgcggtggctcacgcccgtagtcccagcattttgagaggccaaggcgggccgatcacttgaggtcaggagttctagaccagcctggccaacatggcaaaaccccatctctactaaaaatacaacaacgacaaaaaattagccaggcatggtggcaggtgcctgtaatctcagctactcgggagtctgaggcaggagaatcacttgaaccagggaggcagaggttgcagtagtgagtggagatcgcaccactgcactccagcctgggtgacagagtgagattccttctcaaaaaaaaaaaagaaagaaattaaaaaaaacaaattcataggaactcaatgtgtgtgtgtgtgtgtgtgtgtgtgtgtgtgtgtgtgtgtgtgtgtggtgtaggcctgcctatccatactgaaacagatttataaaagttattccctatgcgtgatacattctcatctttttctactctattccagttctttttttcttactgatagttgtgacccactatatcagtttcataatgcacatagaagttgaggcactcagatgaaaaacactatctaaaggggcattaatcattaaaaaaaattcgttaaatcctgtatgtgccatacattgttctagtcccttggataaaccagtgataaaacaaacacagttccttctttcatggacaaaatagtcattaaacagcaaccacaacaaaacatgcacaaagtatgatttgattacattcataataaatgctgagaaagaaaagtatgggtgctataagaagctctgataaggagacttcactgaatctggagcatttaagtggatcttttcatggatgccaagttaaggaaagcccaaagtaatagaggtcaatctttagaacatttctgatctgccaagggctagcagaggacaattgcaggaggtcgctgaataagccaagtggggtggaagctgggctgacactccgcccaatcctaaagctggctttaggggctggtgcatgctgtagcctattgggcccagctcatattaatcctttccaacaatttttggcttgtgggatctagagaggagaggtcaaggagcaagagtgaagtatcccccttagagtccagaagtaagagaagtaaaattatttaccatctttcaggggcaaattatgagatccatctagagttatgaaaaactgtgtccaagagactcccaggctggacgctgacagtaattacttgaaggtgttaacatatttggaaaaagaaagttcccattagaatgagggtggttggcaagtaaatcaaagacaaaggagacttgccttgtgctgcccatggagagagggagcgcctgtatgagcctcgagagtgtgcccatcctcctgtgatgatctccctactgctcacatgcatgtcctaggccctcaaaactatgaccactgagccttctgatcatatgtaaatctgtctattctaaatccatgttatgtactatttagcattctaaacctacccataagagggagaatgcgtatgttggcaaggccaaaacactttgtagcttttaaggaatcagctgatactctggctttaaggctcttgtgagcttttgagagtttgaatcagcttactcagaggctgtgacaagatcacctttctgagactgcttggttgaggacagattctggaatatagttaattctccagggaaaacactactctgtaaggacctgtctgggtaaccaactgtctttccctaggcgatacccctagtaactcctaacctccaactacacaccattttaaatttaaaatttctacaaggtagcagctccagcatgtacacagcacacagctaactgttgatgaacactgcctaggcattgtttcaagcactatgtagattatcttatttaatccttataccaagggaggtgctatcggtattcctattttaccattatgaaaactgaggttagttgagcaccgtggctcatgcctgtaatcccagcattttgggaggctgaagcaggtggatcacttgagcctaggagtttgagactagcctaagtgtcatggcgagacccgatctttacaaaagatacaaaaattagccaggcatggtggtgcatgcctgtagtcccagctacttgagaggcagaggtgggaagatcgcttgagtccaggaggcagaggctgcagtgagctgagatggtgccactacaccccagactgggcatcagagctagacccagtctcaaaaaagaaaagaaaagaaaactgaggttaggaagcacaaggtctcacagctagtaaatggcagggctgggattcagggcagcctgattccagactgcaacctttaaccaatttatgacattgctcctgtcaatgcctccacacccaggaggatttgaactatgtcaaaaagtccatttgttcctaaactgtggcttgcaaagctacttttctttaaagggagggagggaacaaatgacctctatccatatgctgtgataatctatacacttttcttggtgtctcatagaacttcaatgttttctcccttgggatattcaatgcttcatgcaaactagtgagaagtggctcgttctctaccccaaatcccaccttttcttcttctggcttttctgtggtctcactggggatagttcctgcagattttcaacttgtttcaatttgcctccttccaagctatgactatgcaagcatgatcctggaattgcagaatggtcaacaaaatgctggcttattctctggggaaattctacagttttctagggagatcatagaaagctatttaggatcccactttccaataggctcttgaggttatgattgttccctggatgctttctattgtgcaactgccctaatgtacaactggccatttatacaaattcagtttataactaagacattgttttgagaaaaaaaaagccatactttctttcttttaaaatactgataaagtgtgggatgtttgaatgtgttctccacctgcatttttctattctaaatcccaaggggaatgagacagagaccaaagccacagctttccaagaccacaaagcttgaggtctttgatgttccttatcttctgagtgaaactttcaattatttggcaaagaaaacaaggctcttaatgggaaaccaaagaagccaaatcatctgtgtaacagaactgagtacatcgataattcatttattcaagaatgtactgagcaacctagcatggctgaggcactgttgtgtatatatatctgtatcagtgaacaaaataggcgaagattgttccacatggtagtttccagtctagtacaggagagagataataaacaatagatatagtaaattatgtgttagaaggatagacatgctatgaaacaagcactcatacatacaatagagcagacattgggaatggtattaatgtgcgatgcatttaaaaaatgggatggtcatggatggcctaatggagatgaaacacaagcaaagacttaaagcaatggaattggccctaagataccgggggaaagagcacttcatgcagcaccaaggtcttaaaatggaagtgtgactgatgtgcttgaagatcagcaaggaggctaatgggctggagctgagtgaatgagagaaagaagagttaaaaagaagaccagagatgaaacaggggtcaaattgggctacacgttgtgggccacaataatcacttttaactctgagggaaatgggagccattgcaaggttatgagcagaggaatgacatgatttgcactgactgctgtcttttgaatagactgttatgcagcaagaggagatgcagggtctcctattagacagccactgcaatcatccaagccagagaagatggtggcttgcaataggatggtaaccatggagatggtgacaaggatgctgggctctgggtatattttgagagcagaggcttcaggagttctaatgtattagatacgagatgttctaaaaagagtagacacagggatattctcaagctttggcctgagcaactgagatgaagaatttatggttagagcacattgtgtgggaggcagttggggaaatctataattcaaccctccctcccttccttcctctcttctttctacccttcccttccttttttctttttctcttcctttttctttcttttttttttttttgagacagagtttcgctcttgttgcccaggctggagtgcagtggcgcgatctcagctcaccacaacctctgcctcccagatttaagcgattctcctgcctcagcctcctgagtagctgggattacaggcatgcaccaccacgcatggctaatttttgtatttttagtagcgatggggtttctccatgttggtcaggctggtctcaaactcccaacctcaggtgatccaaccgccttggcctcccaaagtgtctacccttcccttcttccctccttgttctcttccttccaccttccctcacttccttctttccttccttgcatgcacacctgcaaatgccagacattatacccagtgatacaacagatacaaggcatcttcactagcaagccaaatatgaatgataaaataggggtacagaagtagaattgatggtaggggacctactatattctattattcctttcttaaaaatttagattctgatatgagatttgaataattcacatttctgaaccataactctgaaaatacatcaacatttgcacattgattcttcttcaaaaatcatgttaaacctaaacttaggattccattattaaattgatggtatgttttttgcctactctgttatcaaaaacacatcaacaaatcaaaataatcaccgacatgaatgaaacattcattactacatcttagaaattgtgtcttttttgtttctctagacactatctatcaaaatttctgaaaacttagctaactaactgcactatttattggttttattctaagaaacataaagcgaagtggtacactctggtagaaaggatgccctagggtacaacaaaaggcagataagcattgtgttaggtgaccaatcttggaaacagactgccaaaggtggactcctggctctgtttcttactacttgtgtgaccctggcctagtatttcactcctccgggcctcagtttccacaactatgaaataagaacaataatgtatccaatctcacagatttgtggtgaggattatgcaaagtccttaaagagtgtggcacatagtaagctgtccataaatggcattacatattgagatattgagtgtaactaggccactgttactgctactaccatacactagaaaattctctcctccctttccaagagctaatttttatcactgatattatatacccttttgggggtcattttcaatagtcatttcttaagaaaaaagcaacaagagaaataaagttgcaaagatgatgtaaatgtttaacattattagttaaataactgctagaacatgagcaactacaaaaataattttgaagtatactttgatgcagaaaaattttttttttgttaaatgggaaaaatgtgttatagcagtaagtcaccaaatatgatccctttaaatatatacaagtatacaaacatttggaaggatttaaagtatatattaatggtggcaatccttacatggataaatttatagagttttgatgcttttatgacgtatttttattttattttctgaacatgatagctgggtagtgtcaccaactgagatatataaggaggcacaaatttagaggaaaagctaaatttggttttggatatgaagaattttataaacccatgggatactcagttgggaatttccaataaatattggggttccaagctttgcagaagaggttaagatggatttctatataaatttaggggctttcagcaaacaggtggtaattaaaataagaatgcacaagtcagtcttggaagacacacagagtgaggaaagcaggaatggagaatgggatcctgggaaccccaggtcaaaggaagggtggggggaaaggaaaagaaagagtgtacgacctcatgcaaagatggaaaggtttttgagagggatacactggcaattgacttagagaaacttgatgagaaatgaactgaaaaatatctacttggtttggcaattgggagagcagaggaactacagcagtagttgcaacagagtggtggggctgcaagctaacttcaagggggtagaggaataagtggggggaaaagaaaaagaaaatgataagtgtaaactttctagaagtttgggtgcgaaaatcaatagagatatgtggtaataactgatggaagatacaggatcaaagaggaagggaattttttccttaggaacttcaaccagttttgaaggagatgcagccatcaaagagtaggtcaaagaaagagggagaaggggcgatagatggagcaatgtccaggaggagacattgaaggggatggggattaaatttgggggtagtcttacttttaagtgcactaaacagaaatcttaccataatatagaagagcaatacagattgagcaaaatataattttgtattttttgatgatttggggtcatcagtttgaacaccaaaaattatactcagttgtccagacaggatgcgctcagtgtttccaaagatgggttgagcttattgcccctttcaaaaaggccccaaatagctatgtctgtggttttcaaatgattttgtagattttctttttctgttgttgttttcaggccatcagctgacatttggctaatatcagttgtgactttccctgaaatctcctacccagcctttcttaatttgcttcatccaattatagaaggtttagaaccacatgaccaagcttgtatgaatcatcactaaaatatgaacatacatttctctggctaatgacctacattatcttcagtgagtgaacattgtgaacatctattttgagtgcttagagacctcctttgcttccttccttatgctgatctatgttctagaagaaaggggacactattagggttgcaggctaagttcttaatagttaggatgtatattgttattaataattgaggtataatagatatcatgcttatcaacacataatgtacatatagagaaaaggttaatggaccactctgagcttacttatcaaagtctactgctcttccacaaaacctacatggtttgttgaacaatttcttcagtcttctgcaagccataatctatgattacataaataattaataatagttttaaaataactttgcaatgattttggttgtttagatccccaacaatgtaaatctcacaatcttctggcagatttataattattaatggaaaacacatttcttatctcagtcgatgaattagcgtttgctgtagtcctaataaatatatatagtaaatataatatacagccaaaaaatgtgtaaacgtacaggaaataaaatgggaatctttgtccaaattcattagcaacctgttttcagcatatatagtactgaaccacattataatgttttttgagcacatatattcaagaaattaaaattgtataaagcatacaattccccattatataatcagagtaaacaagaaggaatgatttccaggaagctcatcccttggattgttttctatgtatatgctacatgtaatttatattgtatgacgatgatacaaacgaattttttttgccttctgaccctgatttcccaaactttcacagctcagacctgcagagacaggttttaaaaacaacatttggcaagaacatgtgcaaacgtgatcaatgagcatcgaggtacacgtatattttactacctttcctttcttactcagagtgcttttaaaaatcagcataactgcaataaaaagaacccacaactgccctattattgaattacaaagcaatgtgtgtcggaaacacccctcagcattttaagagggtcaaaaggaagatgctctgcacgtactccacggctgcaggaattctggtgaaaggagataccaacccagagctgtttaaatgatgacgctgcagccaggcaagaagtagagaaagtgactggaaagctggattgcaggcagaacaaggaatggtgggggtggtgacaaagtggactgcgaaaggacagaaatgacagcaggaatgagaaggatttcagatgtgctactatgatagacgtcccattccaagtctccatgtttcaagcaagtttttaaaaagtttcaagaaagatgactttctgcaagatgagaggttgctttaggcacctaatttcaaataactaacaacagctggtaattattcaatacaatcattagcaacaataacagcaagactaaataccaataaaaatactttatagtacacagtggctccatgtgccagttccttcatcttaatttctctacgtttagccactaatttctttggcttcacagtggctttacccaacatcccaggatacaatttctcaccacagaagttacaaatttccaagattactgctgaattgaattactctcacttacatgaggcaggtctcttattctattctggggtctcactgctatcaataattcaactttttataaaaacaaaatcttccttaaaaattgcttttgtcaaaacattgctatgaccatctgtttttaaaaaccattaatggctgtctactaactttaatgtaacaaaatgtattagtttgacagaccaaggctttcatggcctaaattttacctggaccctccactacagacggccacacttgtcacacacatacatgatccaatatttgtgcatcacggtgggagtgtttgttcctttttatttacatttcttatctataagtcccaactcaagccttacttccccctggagcatttcctggctaagctggctctcaactctctcttcttctttgtagtacttatatgactttttggttctattatttgacattgagaactgcagaatcgctgttgcaggaatatgctggaactggatcttgttaagtgttaaagattcaagaattctgcaaaagaactgttgaaccagtggtagcttggaaccagccatgggaggagtatttgcaccatggccatagacaaacactgcagatcaggtttttaactttttttttttttttgtgaggggtggtgggatggtgagaaaaggaggaaggagaactggcttgctagcataccacacaatagattgtcaaattcttcttactacatttaaaatattttgtcaactctctactatagctttccagtataaattcaaatgcttccgggactaagtaattcatgacctctcaaggagttaaattccaacatggacatgtatctatgtacacacattaaagtgtaggctccataatagctagctattttgtattcttcatggtgcccggcacagtgtgtggtaaaaagagatccttctacctttctagcctcagtttccagggcttacattgccctttaacttctggccttattgaaccttggaattgtttcttgaacgtatcaggtatgtcttaccttggtaactttccaaaggccacttacttgccatggctggcccaggctgactgaatccctcctgccactgagtgaccctgtggctttaacaggcctttcaacacgttgtattttaattgtctatcaattcaaccacctctctgctatacaataagctgcttaagtgttattttttccacctgcgtatctcatggctgaggtccccagcatatagaaggtactccaataaatatttattcatagtgaatagagcaattcaaacaaattaatttatataaggtaggtctgctctagcacttttccacaatattgattactcaaaaaaaataggcctcatggactttatgacactgttgcaactacacagcaaccatcgaacataaatttcaaagaggagagagtttatttacaattctatgagcactttaagttttgctttcttcccaggcactgagggagtatccctgaggttgttctcctctctttgtgtttagatgtctgtacttgctggtatgcctctgtcctctttctgccctgcttccacaccaatggcagacgcaccacaattcaagtgaaacctggtttatccccaagaagtcttcacagttgttctgttggtctctgcttaataccacacaaataaaacttaggccagaggacttgggagagtgaatgaatgaaacaaggaagaatggaggaaaaaatataaaagtaaagtaaggcatgagagaattgtataaagtggggtggggaggatacaatttaaactgtttttaagaaaagatataaaagtaaagtgaggcatgagagaattgtataaactggcgtggagaagatgaaattaaaaaaagcttctgagaaccaaatgaggttgtaatactccaaaattcttaattcaaatgttcttcctgcctcctttaaggttcaaaagatagctggcgtgaccatattcacgaaagtgaatttctctttaaattgccaaaatcttattatcattattattactattatttttggtttacagatccaggaatctttctaatgatggagaagcaaaataagaataaaatgcattttataaaaatcctaattttaaataccaagagagaagaggaaatttatgctctctatatattgtataggggctaccagcatatggcctctgtccacagaagtacatttatctgggaaattgaaataattatttagtgagctcaggcaaaagtaagttctaacaccagagcagaggacatagcctaatttcatgaaagctgatttattattgtttataaaacaccaaattgtcattacattttctaccctacgtataacttgtgtttttccagtggtgctaatatgacaaaggaaataatggaagactatcataaagaaagcttaaaatatggtgacttttacatcagtaacactatttttcaatcattgagtcctgctgtgcatcttgacattagctcttcaatcatactccaaatggagtaaaaattatcagtagaggaaacattctatgatccatttcaattccactacctttcccactgttcatattcagagaaatggatatgaagtgctagagacaagagcagaacaaattaaaattctgctttttctgtgtgtcattgctttttgagatggggtcttgttctgctgcataggccagtgtgcagtggtgggatcatggctcattgtaacctcaaactcctgggctcaagggatcctccaggctcagcctcccaagtagttgggactgcagacatgcactactctgcttggctaatttttttattcttagtagagtctgttccccaggctggtctcaaactcctggccttaagtgatcctcctacatcggcctcccgaagcaccaggattacaggtgtgagccaccaagctcaatcaaaagtcctacctataaactaaagttccacagagactgatggttaaaaatgcaaattgaaatcaaatcagcaacactctaaaatctgaaaagattcattatttctccaccagaacactttttataaacaagctgaaggttactttaattttgttcaaggttgtgtcctacctttctttgatctatcccacagcatatagtcaagtggtagccccatgacgtgcacttcactaagaggaggtcagagttatccattcattcattgattaaatacatatgaatcaagtctatgtgtcaggcactttgagtatcaacaattccaaaatcaacaagacacaatgtaagctctcaagaacatcacagtttatggtagccaagaccatttttaaaaaaattgataaacatctactctgatgtacttagtgcccaattctttctccctttctctttaaaaaaaaaaattattgtactgctcaaagcaatctacagattcaatgcaatccctatcaaaaccaatgtcatttttcacagaaataaaaaaaaacttaaaatttctatggaaccaaaaaaaaagcacaactaaccaaagcaatcctgagcaaaaagaacaaagctgaatatatcacactacctgacttcaagatatgttacaacgctatagtaacaaaagcaacatggtataaaaacagacacatagaccaatggaataatacagagagcctggaaacaaatccacatttttacagagtggactgatagatttagagtagacagagagcataatgatagatacatttgattttctataaaggcaccaagaatatacattagggaaaggagatctcttcaataaatgatgctggaaaaactggacacccataagcagaagaatgaaagtagacccctatctctcaccatacaaaaatcaactcaagatggattaaagacttaaacataaaactgctagaagaaaacacagaagaaacacttcaggacattggtctaggcaaagattttatggctaaaacctcaaaagcacaggccacacgaccaaaaatagataaatggggctgtattgaactaaaaatttctgtatagcacagcaaagcaaacaatcaagagagtgaagagacaatctattaaatgggagaaaatatttgcaaactactcatctgacaagggaataatattcagaatatattaggaactcaaacgtctcaatagtaaaaaagcacacaatcccattaaaagtggacaaaggacataaataggcatttctcaaaagaagacatacaaatgtccaatatgaaaaaatgctcaacatcactaataatcaaggaaatgcaaattgataccacaatgagatatcatcttaccccagttagagggctattattaaaaatgcaaaaaataataaaaaataaaaaaaaaataacagatgctggctaggatgcagagaaaagggaactcttacatatcaccagtgggaatgtaaattagtacagccactatgaaaaccagcatggagatttctcaaaaaactaaaaatagaactaaccactatgtccggcaatctcactactgggtatttatccaaaggaaaagaaattggtgtatcaaagagatacctacatccccaagtttattgcagcactatacagaatagcaaagatggagaatcaacctaagggtccctcaacagatgaatggataaagaaaatgtggtatacggccaggcacagtggcttatgcctgcaatcccagcacttttggaggccgagacgggcggatcacgtggtcaggagatccagaccagcctggccaatatggtgaaaccccatctcttcttaaaatacaaaaattagccgggcatggtggcactcgcctgtagtcccagctacttgggaggctgaggcagaagaattgcttgaacccgggaggcggaggttgcagtgagctgagatggcaccattgcactccagcctggatgacagagcaagactctatctcaaaaaaaaaaaaaaaaaaaaaaaaagcaagaaagaaaggaagaaagaaagaaaacatggtatacacaatggaatatgattcagccataaaaaagaataaaatcgtcatttacagcaacatggatggaactggagatctttatgttaagtgaaataaactgggcacagaaagataaatatcacatgttctcacatatgcaggggctaaaaaacttgaactcatgaaggtagaccgatagataccagagcctgggaggagtgtgtaggtgggaggggaggggatgaagagattgattaatgggtgcaaacacacagatagaataagctctaatgttccatagcagattaggtgactagagttaacaacaggtattgcatatttcaaaatagctagaaagaggacacacaggcatgataaatacttgaggtgatggataccgtaaataccccgattccatcattatacatattgtgtatgtaacaaaacatcacatgaaccccataaatatatacagtaattatgcaccaacaaagataatttactgaagtgaaattcatatcacataaacttaaaaatagtaaagtcaagaattcagtggcatttagcacatttacaatgttgtgcaaccaccacctctatctagttccaaacattttcaacattccaaagtaaaaccccttacctattaagaagttcttttctcaagaccacttttaacttcaatgtatgggaagccttcatttcgaaacaggttttgaaaaaaattctatgcccacaatcacttaacttaaatattagaattgagactaatggagtcaaagagtcctgtaacatcagacacagcctcttagggtttttaaaatggcattctgcattctctgttttttttgtttttttttttctttggttttggttttttcagtctgtcaattttccagattcctatctcccaaagccggtagatgtctcctttgatccagtagctaaggcatggttgaactgatcatatttataccgaatttccaaagatcaatcaacgagaattctcgggtctatgtgcttgtttatttagccctgcctctatgcctgaacttcatctggaagtcacacatagtcttctttctgtcttcagccatgagcaatagtgtatttgcactaaaaacgtttccatggcatcttcttctttatttaattttctatcagcagacccttctttgatacttcctttttctgcccattctggtaattcagttgactaaaacacaaaactcttcccaggtaatctttgtttccctttcataatctgccgtttatacatctacttaattcataattttgctaaacatctccaattatttgttcctacattgttatcttgccatcaaaatattgattttaatacctgtgacccctccagtccatttaaaatattaattaccaagtttcctgccttggatattggagttcttaatactaacatcaaaccaaatgttttatcctcatttctaaagctctactccattgcagacaccgtgacatctaacacttagcagatagaaaaaaagtatgccattgtaaatctgaaaacttctgggcttgcatgtcagagactggaagtggtttgtttgaaaggagcttatactgaggcagcatagcataacacagtggttaaaagcaagtctgtgaaagtgagaaagactggggtccaaatcttggctctaacacttctaagctacgtgactctgggcaagttgcttaaattccctgagcaccagctttctcatctgtatgatgtaaaaaaaagagcagcactgtttagtaaacatggtcttggctttataccacttcctaatatttctacaactgtcaagtcaatcaacatgttaccttagaaactgtggaaaaggtataacctttggaaaatgtaatcaggggggaacaacttttcctagcccaagtccagcttctggttctgccctgacaggtatctgtaagttataatgttttactaggtcttcatttccttacttataaactgagggaggttgagtgaggagttctatttgtttgcattttggctctgcaattcaggggttttatttgacacgtgaggaccaaggagtagaaaggagcaatcaagtgcagtggtttggtcaagatcacataaaaagtcttgctgtaaaaccaggagctagtcctaaactgctcaccagcaagcttgatttatactcgagtagaccatattctcttgctcctccagctgcagctccactcctcatttatcttagcccaggctgactctaagctgctttcacttctacctcactgcatttcgccctgataattttgtagcttacctagcctccctctttgagatcccttcttaaaagggtcattctattaacctacccatatcagttactttactactgctgatctatcgctacctgtcaattcatgggaattacagggtgcactgggacaagagtaaaatgatccaacaaacataatgttgcatttaaaaaaataagctaaaagatactgatgactttttataactacaacatattcgtttgtgaataagaacatatatagtaaaaagatgaaaatgtgaacaggttgactatttcctaaatttatggcagaggttgttctggagaggatggaagaaaaatgaggctggcagtgatggtggggaaatgcaacctccaaaattatctatctatatatttttattaaaaacacccacagtaattatggcaaatgttaatgtttgtttgttctaggttttggatacatttaagatctcttgctttctgggtacatttcttttcttttcttttctttttttttcaaattaattccaaaagacttatatctgctacatgaagaacgaagcaagttcagctctcttgctgaaatgttcaaatgctgaggcaaggcctgtactacaaatttgtgtaaccaaaaccacagtgctctcaatgctcctagtgttgcattacagcagttagaagagattgagctattttgtttccatggctcattaagctagagttagactggtgtccataatcaaatttactgcacttacccttgcttcttccctatgaagtacagccagaccttagggaaaatctcaactattccaggtccatggtaatttggtccacgaaagaaattaacacacctgaaaaggattaaattatttttccttttcaaaatgatcctcttccttaagcttcctctgtcaattgactgccaaccttatttgctaattcccatccctcatcgggcttcctagcacttcctgctgcaaattagtgtgcagtgaacctgagcctgctctccaaaacacatccagactcttggggctttctgggcttccgctagggtgcctggtgcaaagggggcctaaatcaatcaattaaggcctgggaagattccaggcaagaggaagggatatcttgggggacaaaaggaatgtgtaggtgggaagaagggagaaagtctttcttcgtttttcactgcaggaaatgatctggacagagagcaattcgaatcatagacagggagggttgggcaggatgcgatgggggagcgaatgacagacacaagtgacaggaacaacttagggagacaggtcagaaaacatctaatctaggcacatagcagaaatagtgaagggaattgaaacagttgttctgtattttgttcacagtgttaaagtcaaagtcagtgctttttaacctcatgggatggagcgggggagggggcacaaggagccttgtgtgaaggctctggctctgcttattgatcccccaaatacaataatacatcctcacaatcataaatttgagagcaaggggctctgatcctgtgatatacaatctaggcccttattggatcctggaactgattttcagaatcctttattcttttaagtacaattgtaaaaaaaaaaaaagagagagagagagagagagagaaagcaaggaagaaaggaaaaaaggaagggaagaaggaaggaaggaaaaaaggaagaaaggaaagaagggttccatttataaacctcagacaaaacaaaaatgaaagcaaaagagaacaaaaaatagccaatacgacccaagttacaaatttacttgtatcctttcagaggataacccaaattcctgcaagacaattagccatctttctttcgattattacagtaagcaagacgggttaagagtatatagtaaatgtgctttgctaaactccttctccctttattgactctatcacaagaagcacacttaatataatttttacaattttttaaagaacaaataggaaagaggagaaggttgtactttagctacctttgtgtatttgaaaggaatgctgttcagggcttcttccttttcaaaaagaaacaggtctttgaaaacgaagaatcattactgtgcatatctctcgagggctgctcctctagtatcagtccatttgaaataggagtttcacataattcaatttattaaacccacatttcctgccagattttgctttatgtgcctatgtccttttgtttcccggctaacatttccacatctcggaaatcattctttctagtataactgaagaatatggatattaaaatcagatcagcaaaagatttttatggacttggaaagctgcccattaatgccgtaaaataaagcgtgttatacagctgatatcatcagttctactctatgttgttttcatattcctggcggtgggtggagagttagagtggaacaattaggagtgggaaagagaatgaaaggattcgatcaattgtggaatttcaaagcggagacaatttacactaaagaattcaaagacttcgtaacctccaagacattttccagtccaggtaaccgttgaattatagctggaggtgatgttcttggagctgcctgtgaaagctgaaatcacaacatgcctgcagtgttcccttcctaaaccaactttgccattttctcaggcagacacacaaacatgcaagcgtccacagtaatgtgcgtgtgtgagggatgggggaagagtgattgttgctttgtagtagctcctttgaagtgtttaattcctcccttgtaatctcttcatcaacacacatttaaagcatatcagttttacctcagcaatttgattctcagaggcttatgtggctcagggcctctgtccagcacctgggtggcacagtttgttttatgtgcatgcagaagtgttaacagaattaatttttttccttctttctctctttcttcttcccccacctcccccaatttaggttaatgagcccaggcagcagtgtgtgtgagtgagcgggcgtgtgcacaggagggccgtgagcctgcctttttaaaatacaggaaacgcatagaagaaagaagagttcagctggagccacgacttccctctttgcttctttccctccccacccccccaccccccacctcaccccccacactccagcaccggcttttaattttcaaaagcactgcaattgcttggtgtggtttcaagagctggggtgccattctccctgatgatgactctgctgacgtcaatggcattcttatcatgcctagtgcgacatcagaaaccagtcctcagaggctcctcttattcacagtgcctgggctctcagcaaaatgtggaccggattctgaaacgcaaaggactccccgttcctaatcagcgctgcaatccaccagacagtctccttctgccggcagcttgccagttaagactttgttccttagcgttctgtcctgcaaggaccccctgaaggagaagagagggctaagtggatcacagcgtgtcctccgtgtctgagctttcagagccgtgtgtgtgtgtgtgtgtgtgtgtgtgtgtgtgtgtgtccctcaaccaaggttagagactagtcaatgctgcttctgattattcttcaggttttactaaaaggcttcagtctttgatataaggctattcccccgacacagtggctaagaccctcttgtgtaagtgctcctagctcactctctggatcagaaccagcgcccaggtccccacgtgaagcccatattcaccccagatggcagcatgcacctcctctcctttttttaataaagaaaaagaaataggaggttgggaggagaaggaaaataatcatagctgaataataatagcagaataggaaaatagtatcactaagaattaaatatttcactctaaatactcatgacttgttaagaggtctgctctcaaaagctgaattcacaagggagttaatacatactaaacccagtatgcattcctacctagcagtttgggggcaattattatggggatgatgaactttctccatttacagtggagtgtattatggtccaaatctaccctaaagcatttgggaaatgtctacagttcaaattaagatgtttagagtcaaggtcatttcgcttgatgatggaatgatacatgtctagttagatttcatctgaccaatctttgacacaaacacatcagaattgtcttggtatccaccaaccaaataatgtttgtttctcttgaagattgctgagtgacccatagtaagcttattaggagattaggagcaactgttccagagagaagctgtttaacaacatatgaaatgtgcaacataattccatctagaactatttagaatcataacatggaagaacagcagcttacacctggttcaacccttctacctttaagtgaggaaactgatgcccaaaggctgcgtcatgctttactcaaggtcatccacctattaagaggcaggactgacaaactaaagctgtctctctctaaatggtatgcttttcctactacaacacatagctcctgattattcaaaacctaatgaccaaacctcaaacccacttgccaagggagtttccatttttcttttaaatctgagcaatatttcttaattttttgattaaagtgatatttcaggaatgtttagatgaattataatgagtttctcctttgttttcagtgagtttcacaactagtgtaaaggttattaagtagaatggaacaaaataatatatgttggaatgcatgaaattcagatggttttgttctttgttattttttgtagagacagcatctccctatgttgcccaggctggtctcaaactcctgggctcaagtaatcctcctgccttgcctcccaaagtgctgagattacagatgtaagccactgagcccagcaaagacgtgtttttaaaaagtgatgatgggctctgggaagaaggagcaaagatttatctgggttccaaatgtatgagctccctgagcccagccatcattctgcttcatctactacatagctctcaccatggtttgtaacattgcttgctaatatattttatttgccacctaattcaagccattaagttaatattcgattatataaatatgatctttatagttactttttccctatccccaatagttttgccttctcttcagaggactgtaactgcttctataaatcaccttttgctactctctttttggtagacgtgcatcacattctggtcgcgaatggtgaggagatggggcagatgctggttttagagtcagacaaacctgtgttggaaacctggcttaaccacttgctactatataatttcaagacataacttctctgagcctcagtttccttatctataaaatatgaccctaccttgcagggttattgaaagggttagagatgatgtttactaaagtcctatcacaatgcctagcacataggagaaactcaatcaaggataattttattaatgatttttaaaaaataaatggggaaaatcataaaattaataaagattagtaagattgaacaaaggacatatagtatttccccccttataaccagagctgttcctcagtaccactaaaattggaaggacaatatttctttaaagaatttttctagtgaaaagctaagccaaatatatgatcattggcctgcattatgaatgcatgtttcactgagtatctgattataattggatgtcaaatagctacaaaacctaattgtggtctcaaaaattgtctcttctccctgagacaaacatccaatatttcctaggtgataactaagctttgtgtacactgagataagacgccaaatcaattccttaaacttaaaggcacaaaggtttcggaaagcctcattgtccatttgagagacaagccacggcatctcgtaaagcacattttcactgtatactatgttactacaaaattgagttaatttcattaataacaaaatttatcaaaataaaaatgctttctcctttgcaggaatccataaataacataaaataataatagcattttaactcagaagcaaattacagccatgactgtttaagttggctaacccaaatttcgtaagtgaaactggagtggtctgcgtaagtcctagattgcatatgattcagggaaacccagatgtcaaaagggtgtgtgaatcaaaagaaggtattcatcttggtgatttagccctgaaccaatcaattcttcccagagcactggagaaaaagttcttgtttctaatggaatcatcctgcccttacctacctagtaaaaattttgtacccaatcaataccttagtcaactttaaattcctgaatagcccttctgcctcattcaagtgaatggaaagaaaaggtttaatcatatttaaatactccagactattgagtaaagttaaatgcaaatttggtcatgttattcccttctttaaaaccatccattcattagtgatgatccattcacctaactatgccctcagcaggcagggctgttagcctgaggaaggggtgcccttttctatttcatccagctagaagatggccctttggaatctatctgctcaatgatattgtatttctagaatataaaaaagatgccttaaatatacaaaaggcacagggggagtcctttttaggtctcagtttaaggctgatttctgagttggttatatgctctcacagcaatttgtatgttgccttcatggtgcttaaggcagttcaatcatacattttgtttttctttcccctactagagtataaggtagaaattgtgactatatttttcactttcgtatccccaactccatcccagtgcctagtacacaagtaccaggtactttattgactgatacacaagtactagtgaattaaaaaattgttatataaagttgggttgttgtcttgtccaatagtagctgtgtttcgcactgcaagtcatttttgagagcatatgaaataactctatgtcctcatgaatgactttatcataatcattcctgaacagcacgggcgtgtggtattccaaaagggagttttactggcccttggttaaatttaaagaaataataaggccaatttaaaacacacacacacacacacacacacacacacacacacacacacacacacattaatgagagatttctaagccccccatgggagatgactgccctttttgtccttgttttgcatattaaaagtatatagaatgtggaaaataaatgtcataatatgaaatcatggttccagtatatgttagtgtgttctgttgaaaatagttttgtttggcaaaaatgaagagttggtaattgtatgttgggcctcacagttttttgttttgaaattccaaagtctgggaaccattgacttagcagggttttcccatcagaacacagatttgagggtttttaaggatacatgtcttagtttctagtcgcgtatggctccaacctacaatccttccttctttcgggtcccacctttattttttacttttctgatagttcccacaactttgcccacaaagttgccaattcctaaatattattatcaaagtgcaattttgtataccccaaagctaatatataattaattttactataagagaaatcagttaaaatgtaaaaagtttaataatatacattataataatggccctggtacactcccccaccgttctttggaataagcaaaggtataacccttgaaagtaaaattaacttttctttgcacatattagacttctcaatggtgtgccaaagagtggagatgacaggtgagccaagctattgatttcccttggctcttgtcgctagtgggtgggagactgaacacaagccacatcctttatttactgcagttttcgtagaaatatagttatcagcgtatgtcatgaaggaacaaatgtggggaagtactgacctaaataacttttacgtgattcagtatacatgtaaattgaaataaagaatattaaatctcaaaactatccagaggaccttattcaatggtataatatttcaaatttaattttttattacagtatattttcaggtacagttttaaaaatggggagcatgcaattaacgaatacataaaaataacactagtttaatcttccctttaagaaaagttcctgtttgctattcctgttacatatacaggcataggacttcatggcctttaagacatgttgataatattaacatttccacttgattgtgggaagtagcattcattttcagctttgcttagagcttattaacctgatgtcaacaagatatactagaaatgtccttgtcagtccaaacccacaagtagaaatgatcatgttgttgaatgtgttcagtctgatttgacaacggtaacaagtcaacactgttctgctaaaggaaggtcaatcatcccattgcaccagggatttctttatttcttttgctaacattagcattatgaccagtgtatgtcaaagaatacattgggataaaaaattctgcttgtccatttctgtttttccattctcttatgacttagagaattgaaaaattaatctcaatttttttctgtctgtaaatatacaatatatatatacacacactcttacacaaaatctctgaaaatgctgtcacatgcatgaaacacaaaatgaaaaaggtagagattttttcataaacatgaaacagaaaaaactttcctcctcactacaattcatagctaggattcatgattttctagtaagagtagcaaaatggatgccgattctatggcatagaagaccaatggctttagacctggattcaaattttaactctgccacttcctagcttggtgaagataagcaagttaagtcttagttttctcatttgtaaattggagtccatagagtcgtgaggatttcacaaggtaatttatttgaagcatttggcacaacacctggtacaaattaggaactcaagcaacagaagacacagcattaaaatacagtgcactacatcaggacattacaaaagcttaatttaataaatctcttgtctgattcattctaattctgctagtatactgtagaaaagtacactaggtcctgtttgtggcctccccaggtcagctctgcccaccctaccccttgggcataagccactctcccagtttcccaggcatgccacagcagccccagtaaagcagcggttatcactgcaattgcctcatgttttccacctccccatccttgcgggcttagcgtgggcaatggcctctgacttgacaggaaccatccagctacacgtgagatggacaaaggctctgtattccccagggactctgggagggccaagggtaccatggagcaaactttgaccaatgagagacaaaagacctatgcacagaaaaattgctcaccctttcttctccatgtggaatgttttacgacacagcctcacaggcaatgtcccttgtaacttagcaactagttttgttgttgttgttgttgttgttgttgttgggaagctctgacaagcttagtaatgcattaccttgtacatggtttctcttcttccctactgctgttcctttcaccccctcaactccacttttgctttcttgggattgcatgactcacctccctcataaagctagcatgtaagctgtccctagggaatttgatcaaaaactgtgagatttagaaaaaaagatgaggcaactagatacagtacaagaatgaaagagaaaaagtcataatatttgacatcaatttacttatctatgattccttggattctctcagtagtggaagctcttaagaccacattaccaccttattaacaaagaataactgataaaatcaacgggacaatgggcctttgagaacaaaccatcattaattttgttccacagagtccaatttcaattataacctaagatatgtttggaaccacttaatgctattttatgagagagagacagttttctctttgaaaagtcatgttcctttgaatttaactaaaacgtaacaggatgttaaaacgaaaccctggcatttttctttccttcagaaatatgcccacattttatagagaaagctatatattgaggttctgcaaacaacaaaatgcaattttcacattaaacatggattctaacatctggcatttctcctagtgcttgcacataattatccaaaattgcagtttttccaacaggggacccacagtggtagctctgattcattccacattatatatatgaccctttctcatagtgagggtggtcttcaacaccaatgctcctgactgctatcttccttcaacttacatggaatacttttcctcatggctccaaatgtatgagctctaggttgttattcagggttctttcatcctcattttttgtaccttttatgactactttctgaaaaggcacatttgctgagttggcgcctcacaggtggtttggtttgtggcatattttaatagctatgaaaccatgagttcagctattgggttgcaatgagttacataatgcatgtgcaattcagtgcgcaccaacaagaagattttcctaagaccccaaatgacccaggaaacggacacattgaaggggttgcacctcaccaaatgtccctgacaaggatgcacttatttggaaggatgtgcccttactctgaaggctggtggtctgaggagagtagatgtggtaatcatccaactacattaaggcacatttatttctgttgctttttggttcattttattttgatttggtttgttttctgttcttagcaatcagtccattttatgagtactttggcaagtagtagcaaaagctgttttctctaggaaatttttaacctttcaaacacagcagagatgttagggacattataaattcaattaaatgtggtccctgtttctggggttgatggtcataaccatttttctttttcttaccactccagtttaatttacttggaatgaaaaaagtaaatctgagcttctgaggattatcagttgagattctgggcctttaaacacaatcctctctggtctggacttatttgcaacccagcacttccagaaatgcccatcattagctcaggaggatgaactccaaataatccacgttctatttatctcattattctctatatttatgtattcattcaatacgtatatctcccatacgccagcactatgcagatgatagggacatcattttgaacaaaacagaaaaaccactgcctgaagatactgggccatgaaattctgttcaaagatatgttttggcattcattttgcaaatctctacatagcatgaggaggaatgaaaagaataaattatatccttcacttattcatgcattcgttgtccatttatttaaaaaacatttattgagaatctattttgtgataggtactgcaccgaatgccaggaaaaacaagcataaaagatacagggtgtccagaaaccatctgaaaggatgaatttgactactcaaatattttaaaagactaaatgataaaaaaaaaaaaccctaaacaaattaaaattttttgaaaagtttacacaaatgaggagagttcattttcttaatatactcaaaacattaacatatccataaaaaataaactcctcaagataattgattcaatgagtctttggaggtaggagggaactggcccataaatgtatgaaaggtgactaattttctttgcaattaaattagatggggaaaatatgttttttgtgaatctcagggtcagtgtgtatagaaatacaagcatttcttgtgatgatggtgggattgtaacttaatatattctttttagaagacagcttggcaatatttatgaaaattttaaattcagtttcacagctaagactttattcaatgggtaaactcacaaagatgttcaggcacaaggatgcctgcagtgttatttgtattaattgtagtaaaaactggaaatgacccacaagactatcaatagagttaaatgggtttttagacataacataatgcaatactatgtgtcaaataagaatgatcattatctctagatcatgatctgtataagtccatacaaaagggccccaagatacactattaaattacaaagagcttggtgcagaatagtatttgtaatactctcttggaggatatgcaagaaactattaacactttactcccgacagtcatgaccaagcaattagagttgccccaggtaacatctatttgctatcctgctctgtcacataacatttactgtaagtagagctctctctgagaaatgtgctggtccaagctctttgaatatttgtatacagttaaaatcacgaagaactgaagatcactgcaattttcaaaggaatgaggactttaaaaggacagcagcagcaagggaaaggtagggtgaccaacttgtcctaatttgtccaagacttccccagttttagcactgaatgccccacatcccaggaaatccctcagtgccaggcaaactggaacagctgatcaccctcacctgccttggggctgctgcagaggcctaagcatgaaccgtagacacaagagaaactgagaaactttctttctgcccccatcctggcttccctgtacctctgcccagatgccaaagagtcctcctcactttcccacagccacaactcccgacttcccttgcacctctgtcctttggtacaaagatttctacgtttgcgttagtgatgtgacctcttggattaggatttccaaaactagaaatgtttttggagtttatgtagggttttacaggagaaaagaagctattgtgaaagaactgtgagggaaggaattggatataggaacaaaagttattttgggggctagaaatcataaatctaaatgggttttcaaggcaaagaaaaacttcatggtatagataggaaaggatacagtattattcattagaaaaatggaaatggtatctatgaaattaatttagatttaaacaagaatattttaagagggaaagtttcttttttttttttttttcttgagatggagtctcgctctgtcgcccaggctggagtgcagtggcgagatctcagctcgctgcaagctccgcctcccgggttcacgccattctcctgcctcagcctccctagtagctgggactacaggcgcccgccaccacgcgtggctaattttttgtatttttagtagagacagggtttcaccgtattaaccaggatggtctggatctcctgacttcttgatctgcctgcctcggcctcccaaagtgctgggattacaggcgtaagccaccacgcccagccttaagggggaaactttcaagagagaaaaacgccaaccctgagggaatatgggattaaaaaatgtatcagtaatttatatgcttctgacactttctatgtgactcagaatactctgctgggaatagctaatggcagaaaatttcaattattcccagttgcaggtgctgtgttgtgaaaggcacaatagcccctagcaaccctaacgaggttaaaggaacagtccctgaggaatctcactgttagtatccatggcaagagaaaagctaaacactggggatacatattacttcacttttgtccctgaaattgggcaaagtttcagatttgagaatggcatcagaagtatagctgtttagtgcatgtgtttctcatcatagtattgatattcatttcacatatattcccacagtaaccatttactgaaggaaagccaaagccattttagcttgattacattttctttttttggtttgttttttttagacggaatctcgctgtgttgcccaggctggagtgcagtggcacgagctcagctcactgcaacctctgcctcctgggctcaagtgattctcctgcctcagcctcctgagtagctgggactacaggtgcatgccaccacacctggctatttttgtattttgagtagagatggggtttcaccatattagtcaggctagtctcgaactcctgaccttgtgatccacccgcctcccaagattacattgtctaagacttcctacagaaagacaacttcatttgatattattcacaagccatctagtctcttgccttcaacatttttggccatgtagtgggtgggtgtgctcctttttgcactgatagatcagcagccatgccacttttctaaaaccatatttattttgccccctgtatcatccattcagtcatttaaccaatatttgctaggaaatgagtgagccattttagcttgattacattttctggggtttcatagatgactaagatgtagcgtccactctcaggagttaaggatacattaaggaagacagataaaaccaactaatattatgacattgtaggatgaaagaggtgtgtgaaagatttatgaaagtatagaggaggaatgcttaaattcgggagaaattcaggaatagctatctcaaggggcaagtaggtaccctgcagtttctataaaaggtgaaggtagggaagacttacagggagactgaacaatatacgcaaaagttacagaggtgtgggagagcttggcttgatcaggaaactatacactgcaggctagaatcaatgagtgctttggaaggaaggggatgcacatgggagaaaggaacctagaaaggtaagtcgcagacaatgagggaaaggcaaaagacaggacatttacatttactgagcttttattttgtgccaggctttttatgtttggtatctcacacaattactccagtaacttcctgacaatgtttgttactccattatgcagatgaggaaacagaagatggggaaggttatacctgggctgacccattttttgaggccaggtgtatctaataccaaagaccctggtcattttaccgcagaacattgtttctagaaggaagtttaaactttaccctgaaggcattgcagactctgatggacatcaacaggagagaggtatgatcataattggattttattttgagacagggtctcactgtcgcctaggctggagtgcagtggagcaatcacggctcactgcagtctcaacctcccaggctctgcctcccaagtagctgggactactggaacctactgccatgccaatttttttattttttttatttttatttttggtagagatggggttttgccatgttgtccaggctggtctcaaactcctgggctcaagcaatctgcccatctcagcctcccaaaatactaggattacaggtgtgagctattgcacctggacttaactccattttagaaaaaaactaaaaaactaaaaaaactaaaaaactgtcgtgtggaggaggaggaactgagaaactgggggcttttcctaggatgacagagaaacattttcctgcaacaaacttcaatgtctaccatcacatacatacaagtctaagtttcataggccttgatgttgtcattcttgcatttatgcctagaaacatgtaagtctgagatgtaaattgcagaactaaagatgatggattccagaaactctgatccacctaagagaggagtaggattgtggaaggcacataagggtaaaatagtatcacatttctaaacttgaaaaactcaattcaaatatgtgcagattcagtcccatatgaacagccatgttggctagaggacatcatacttctcaagggcaacagagatgctgggagcagattaagtagttataacttgcacctgtgtaattactatagcgagtcacacttctgtcaaatgatcctattgctttaaaagtttgagatgatgcctggtctaagagctttctttagctgcatgtctcaatgtggctataaatttcagtcaagtcatgtcctgcacattgggtctaattaaagaacacaagagtgagaagggcagggtatacactcagggatggtggagttagtttatttcttggatggaaaatttaacggtcattataatgcctctttgggttggaaatacagattcttatgtacacattcattttgcacaaatgaaaatggtaaaccaaaatcagagagtgttgaagttcttaaactaaagactaccttatagtgagctctagtaaagaaggttagaaacaatttttaagaaaatttaataacaatatttcagagaaaaatttgttactgaatattttccagaaatagtaacaagacatctgtattcaagtagatacaagtgattgtaccagagggtcaatattttgagatggcaagcacacattcttatcataaagatatggtacaggaactagaagagatgtaatattccttgacgtgattctgtcataaaaggttaacaatgttacatcttagggccaaggagacaatcctttgaaggttgcaaaggactggctagagtcaggaatcatcagcgtattcctttaaagataaaaattatatatatgcatacaagtgctacttttaaaatcaggaatgatcttctatttttaggggccaaagagaagagttaaaaactataaatggatatttgacttatgtggcagaagaaaagttcagaggtttcaggatctgcaggtgagaagaaaatgtaaactaaatggcaatctgttcagtgattttaaaattcctaacaaaatgcatttcctacaaatgttgctacctgaaaagtaacaattagacatccatttatttgtacttacataataaaaatatttcagagtaatgtataccactgtctaagtctttctgttctttatctgtagccaaacctacttgcccaaattagttgtactaagagttttcaggctgtttacaactgaaaccatcttacaaagtattttaggccacatttgttttgttgatgaggccaagagaagtgaaatagtttttccaggggcatgcagtctgttattaacaaagttaagactatggacaatttcaggatcttgttccttggtgttttggaggttctgaggaagttggtgaaaggcttctcctggaaagtaaatgtggttaagagccaaccaggtgaggctccaggcctactgcctcacttcacctaaagcagatgggctgtgttacagagacttatagaccgggctttttttgaagactatttatttgaaacatctcttctgtcaaatgaatttttaaatgctaaatgaaattttttaaattttaaatgagtggcccacgctaatgtattaggcatgtgaaagggacgatgttgtggacatcggcaggcagcctacatgttcctgaaggtcagacccgtaacccattcatcttggaattttcctcacttggtgccttttaaaaggggatttaaaggcaatagggtctggaggttcttgcagttatagcttcaggggctcccttctgatcttgcacagttttctaattattcccttgttttcttccactgacccatgggatgtggttaacttgtgtcttctaaggccagctgtgactttttccttacccacgttacttccaagttgggaacacaatcttgcaacctggccccaccctgttgtctctgcacaagcctgaaaactcaggtaaatgaatgaatgaatgaatattaggctgataataactacagggaaaaagataagaggtaagaaaaataacagtgatgaaattagcaggcaatagagcccctaaatatcaaaggaaggtaaatgagttcattctagcattccactagccctcttaggctttgtcatgattgctttctcttttttctgtttacgttaatattttgtttctgaaatgcatctcatcctttcctccctatagagtctcctaaattgctttcttttctccccaaccttcattttttcctccttcactttcccactttcaattctaatttccaattagatcacttaggtttacaataatccccaacactacgtattattcccatctcaaagcaaactttagattgtaaccttcaaattcaaagtcccttatacagttttattctggaaaagttgacttcaagcaattattgattggcttgacttcttgctaaattttgcctaaaggcgagcctttttgaaatcacacaaagggtggaaaccacacaaaagtagtggttctcaaactaggtgggaattcataatggttataaagaatgaaatgggctggtcacagtggctcatgcctgtaatcccagcactttgggaggcccaggcgggcggatcatgaggttaggagatcgagtgaaaccccatctctactaaaaatacaacaaattagccaggcgtggtggcacacgcctgtagtcccagctactcgggaggctgaggcaggagaatcgcttgaaagcaggaggcagaggtttcagtgagccgagatcgtgccactgcactccagcctgggtgacagagcgagactccatctcaaaaaaagaaatgtaagtaatggattatttgggagttaggtaaggagcactgaaaaatatgttctaaaatttatattcatgaaaaataactgtatttttatttttaaaaaataacatttattaatagagattctatagaggaatgaagttactttttatttcctttcttttcctttactgtttccttctttccttccttccttccttcccttacttcctgcctccatcccttcctccttcccttcctccctccttccctccctcccttcctccttccctccctcttttccttctttcttccttccctccctcccttctcatcttggaatgagaatacacaaatcctcagttaactctacacttttattcaaacacaaacttcagttgccttgactagttttacagtaagaatttaattttgaagaaaacaaaaattaaatgtcactatcaataaatcaacctaaagatcaagtagatgtatagcatgggcagatatatcaatttaatatagggattaagaggttgtggagtcagcctgacccagtctggacttcagctgcaccgcttactgtgcatgtccttgagcgagttaactaaaatataccacacatccatctgcaagcatagcagtgaaggttaaataataatatgtacatgaaaaacttggactgtgcatgggacatagtaagtactcaataaatattataattaatacagttttgcaaaacatagtatctcatactgctcacatcactgcaaagtgataaagcaaaggacatcccaatatcctacctaagaaaattagtgttcaggcaatatttaattcatgtgcttctagtgctatttataattatctcattcaaatgtcattttgtaacaagtatttgatgtcccagctgacttgattctagacctagaacttggaaccaataataaattggtgggctttgaacttggaaaagcttgtgatagagtctaaagttttaattccacagggttgatgttggttcactgcttgtcacgatgtgcaattgaagctggctatcaaagcagaataaggcaaaggtactttaactccttcacaatcacatgttttcactttaatccaattatagctgctagtcacatgctttaaagatcacagatccaaataaagaaaccatcgggggtttctctatggcttataaaggagcaacatcttttatgactttaattagtctaattttctattgttaaagagaaaagaattatctgtccttaactaaggcagtcagttgtgcacaaagccaaacgtgctgtgggtcaggagatgtgagttctgacctctgaccaaccatgacctctctgagtactgagactagtcactggctgtctctggtttcactttccttgtttctaaaatcaatccttgcactgatgatcagtgagatcctttctagccatcatagcctattatttcatacaaagtgatttttccagaataactaaaaagctgtaaatggtatgttcagagatgacaaaatgagacagtaaataaagggtaaacgtatgtctccagaaagcaaaaataaataaataatactcaatgagaaaaaagatgagtggtgttttgaatattaacctctatgatatttcagttattaaaattagcttcatagttaattggctgatataacaggactttgtgtttcttaagcaagtatttgttaaacactgatgaagtctgtagtttatatctaagccccatgaagtttacaacatttgagttcaacaaagtttatcttgcaggagcttgcaatcaagtagatgagtaaaaagtacggatttaatatacattgcttaaaaggttacatataaatcacatcaagccaaaatatcagcctagttaagttgcttgacccagggttataactcgaatacacaggtctctggatttcccttttagagaccgtattccctttaatagggtttaatgggggggggggggggaaccatccagaagctgattgttgttattgttttataaatgtctttgttcttttaaaggtatgtttaatatgctgtttttattacagactatgtatccatgaaaagtaagtttgaaaatgcagaacatagattttttttctcaaagaaaataaagggtgaatttaatggaatgatcattttcaactggaaaggtgtatttgttgaatgctttttgtgagcactcaataatttagcttttggagcattctccatacagtctaatttaatatttgtaatgatccatagtgttatcactatcccacatgacagtaatggaaatgaggttcctggaggtccagtgatttttctgaatttaccaagtaaatatttgggaaagtgaaattaaacccaggctggcaggctggaaaatgtgtgctcttccgaatctttcatcttcttctggttcttggtgcttctctggaattttgcatacagagagaaggggacaggttcttttcacttttgatgtacagaggttatgagaaaataatcttaagaaatttactgaacagctcggttactaaaaatgtacatctatctttccgcatgatttttaagaagtgagattcccaatgaatggatttaaaatgcaattttacattcacctagaatgaatgtgcagatctttcctaaagatataagaaatcgactgaagtaagcaagaaaaacactattccggaattgcaaagggtatccctgaagagtatgtgtgaatgccataaaagttatactatatctaatattatcgagccctaattgaaagccgctgatttcacctacataattccatgtctgcgaaatcatgtggtgtttctagtgaacataaacacatttacagttaaggaaaacttaaaatatgtatccaaagataagttcaataggtttaaaaacccaaaatctggctgggcgcagtggctcatgcctgtaatcccagcactttgtgaggctgaggtgggtggatcacccgagttcaggagtttgaaaccagcctggccaacatggtgaaaccctgtccctactaaaaatacaaaaattagctgggcgtgatgacatacgcctgtagtcccagctactcgggaggctaaggcaggagaatcgcttgaacctgggaggtggaggttgcagtgagctgagatcctgccactgcactccagcctgggtgacagagcaagattccgtctccaataaataaatagatacatatatacatacacacccaatatcttgttcttattctttttaaactaaaaaaaaatatacacataactgtaggaagctttccttttcctttctgatagacacctttgaaatattaacttggtcagattcaacccttcctatgtttttaagagtgctagccaatatgtattttgcttgtatatgcataagatttgtttacataatacacaagaagctgttaataatcgatcctttctagggcacgttttgaattttgaagcatacgaatcaattatcttttaaaatattttcaattaaaaaaagttctagggtggtactacaggcaaggtatgatggaagtgccacattctcaaagccactgaagagagccagttgaaagttagcaaatgagttagttgtttcatcaagaaatggaagtggtctgatttttttttttttccaaatcaaataatgcagtacagtgcaaattcttgaaagatacttttattttcaaattgtacttggaagttcttcttattctgattctgttgagcagtgcaataggattacattggtagtataattgaataaggctctgtacagaaaaactataaaaaacaattgcctattgctttatttcctgagaaaaaaaattaccttttgataaaataagtagaaatgctgaaaagaatgtattcaagttagaagtatactccccactgaacacctctttcacatttctggcccatatagcagggatccccaacctccaagccacagactgcttccggtccatggcctgttaggaacctggtggcacagcaggaagtgagcagcaggcaagcgagcattaccacctgagctttatctcctgtcagatcagtgggactgtgaatcctattgtgaactgtgcatgcgaggcatctaggttgtgcactccttatgagaatctaatgcctgatgatctgaggtggtttcatcccaaaaccaacccctctccccaccatccatggaaaaattgtcttccatgaagccagtccctggtgccaaaaaggttggggaccactgctgtatagctacaacactcaagaatacatggcagttccatttaaattttaaaaattgaatgtctttggtttaaaatattgaatggttttaaatattccttataatgcaagaccacatcttaagctacaatggagggtaaaggacaaaggctatatttgaaaagtagaaaggaaatacaagagttttcagttaaattggaagattttttttaaaaaaaacctcaaacattttctaaaccctcaaattattcctaagatgcattcaactttgaatacattgataaaattcattgcttgacaaagttgcctatatttttcattgaattgggcagtggtgtgattgaattggccaaatcagaacctagagtgagcattctataaactcacctttactttgatccttgaagatcacaagttttgatactgttgaaatctctactctttcaacactttaattaaatggcatttagaatttcatatacttctgttgttgtttccacaatcttaaactggatttagaaatacttataatgtaaatgcaagagctttaacttagtaactgtatttcctattttttgttgtttttcttttgccagaatttctgtttgtctacaataaagtccagcgaaatacagtatttggttaggttacttgttaacataaaattttatcatttgtagagtttttacttaaccttcctattctctagtctctataatctttcaatgaagataaccagttacgaatatctcctataccatattaggcctgccagaatgtgatttcttggtataaagtgattttcaaatgttttcctaactcagtagccacttccatcatttatatctgagttatttcctctttttcttaatagagaaatgaattgatattcaagccaataattgatattcaagtgacatagttatgtcactaatgaaggtaacccatcctcagctaggaaaaaaaaaatatgtattttccaaaactgctgacttttactttgttgtcagtgaccttggagtcctggttctatactgtataggctgtgtgaccttatttcagttgagggtagaagagaaaaattatattgcaaaagtgggaaagaaacacacttataagattttcagtggaacttgagaggacttttcatttttctttttactataactcctcaaacagtatctaaaccttcaagttgttgtttctctccttctctaagcttcagtgctctcatttgtttcatggagataataaaaaacatctgtgcctcatctcatttatagcatggagacaatgacaatagatccacacctcaaacagtgtggagagggtgaaatgatgatgtagagagaaagcgtatcccagcacctgcatggtaaccactcagcacaagttatttgttattgttttaattggttacgaattgtattttacatataacctgtcctgtctggaataaatccattaccaatgaaaacttttaaataggaactccgtagatgataggttattcaataaagatctactggaaataaaactgttttccaaaataaaatatatagcggtgtgtgtgtgtgtgtgtgtgtgtgtgtgtgtgtgtgtatctgtgtgtgtacatacacattttaaaaaattgattctgttctcaatagcagaaaaaagtctttccactaccttaaacccacatttgactcaaatacactaacgatatgtaaccactgttcaaaggaaaagctgacggacattaggctgcggaatcctgcaatgcttgtgctcagcttgggcctgggtgtcaggataggaataggagatgccagacctgtttggtagtagtggtagtagtcattgcctaacctaggcaatcatcagctcatgggatttggtgctttaagcaaaggtgttaattattcccctcctcccttttagtaccattttctcttaaactaacacccatctttgggcttaactaagcagaaaagcaaacagggaagaaccaggtggttaaggaccagtgtcttaaagtaaatactctgtatttgagtccaaaatgaatttcaaactcaggttagatgtttcttcttaatcacttaggagccagtaagactctctaagccttccttcctacgctctttcactaaaggaccaggttctttcaggtgctatcctatttggaatttaatttgccctaacatttctccaagagccattacagcacaccacattgctgtatcccatttaactcccaaaccgcagagaagctggctgcagcatcaaacactattaaaaataccacaagggaaccttagagtgggatttcaggcacaagttacagcctaaggacaaacagcggttgtaaagagcttgaatgatactggaatggagatttaggagaattttcagagtctgaaaaaacagtccttaagattttagtgttggttcctagggctggttctccgtggttatatgggttagttaaaacattagagtaactttgcctttctccctctctcctcgagttttttttttttttttttttttttcggtcaacagatttggtaccaagagtgactacaagtgagaatggcttaacaaatatttccaagaagaggttcctatcactaggccttgcaaaggaacaacagactcattagatttttttttaacctgaatatctttattgtgccatctaagcacttatttgaaagtcttcaggtgtaatcctgattcagggtgtttaaaatgcaaatgcagaaattagcccagccatggctacacaagaggccccaggcatttcaaatttgaatgaatattttggaaatggagcagaaacttaatggattagtcattatttagagtcctgtcatgtgggaggtccaaattcagagccttagagcggggaggaatatgttatagtgtggtggtggcagcctcaaaataggtagtagtggtggtgaaggtggaggaggaatatgaggataaggatggtttttctgggtggaagaacaagaggaagagaagccagtacttgcctttcaagctctgcagtagtatcactgcaaactgagcacaacaatggaagaaatggcttctggcatccacttgctcattttctcttattggccaacatacttctggaatcttctcaaaagatccattctgacagactttttattttcccataaaattccaggagcatgtgtagactggacttctgggcttccattcttatagaatgtttccttcatataaaatgcttcagtttggaattttacattcagtacagattatttcattaatacagtgcatatctcccctgtcctggaccctagattataaggagtaagaatggggataatgcttctttttggtcatcaatgtatctcaagagctttgattagggcctggcacatggaagactctcaaaaaagtattgtttaaaaaaatgtctgaattgttaaatggacctggtctgaatatctaatccaaaggcaggcaattcatgggtttaccagcagccaataatctataatatttaaccacagtggaaagttacctcattgtatttgtaaatttgtaggctcaagttgcaattataaatgggaaattgcaactaaggtaattggtgtcaagagaaaaaaaaatttttaaatctactgatggcctaaaattgggcctagagaagctatggcaagccatgtacaaactcaggcaatgagaaagcagacactatggagagtagagaactatctctagaaaacaaaaaccagaccagatatataaataaacaaagggcagagtcctgagaaagacaccatatttactacaagcaaaagaagaagtttcaggtgcctagaactgtgatggttcccaaaacttctaaaccctagtccacctgtgtccatgtgagaatgacatttattttgatctagttatttctggtaaccgagctgatccagtgaggatattgtcatatggtgatgagggacgtttgtgaattactatgtaaagaaaagatgcttactctgtgccagtagcttgggaatctggaatcccttcctgtaagcctcagagtgtttccaggaaaagtcaccaaatagctttgattcaaggaaatgaatctcttctgtcctgtactggctgcttgaaaacatagtcacctgagtaatatgagtccaaagtactacattacatctcagtgtttcttgcaattgactaacatgtagaaattgtgcttggctgggatctcacagttatctggttggtttctgtctgctgcatggagctcacttcctggtagtgaccatagaaggaggcattatctttttccagtcactaaaaactatatgaacatcaacaataacctaatttgtgagctctctggcaggaatgaaattcctctttataatcactgatggtactccctgtgtatggcagcagagtgacacacgctgtcctagtggaacataccctcactttgccttgtgtttaaagctgggcaccacttctaccttagggagagagatggtgcgaaagcagaagtgaggaatcacagatgggacagagttggactgggtgatgctgcagtgaggaatgagggagcatgatgaaggaagaatgatataattttagggagctgggaatgaatagggtgaagagggagagaaaagaggagatttagacaaagaatgggaaacaagacaaataagggaaggagtgagggaagagactggaaaaagaagaggcagatataaggaaaggaaaaaggcaagagaatagagtagagaacatgtgaaaaggagaagatcggagaaaacaaatgaactgagataaaatttgagggaggcagcagagtgttgactgcagggtgtggaatctgaaatataactgccaagttttgaagcctggctccacagctttccagaataatgaccatgggacatatccctaaattctctgagcctcagtttcttcttctgtaaaatgggaataataattttacctaccttatgtgatcatgcatgcccagtcttagcacagtgtttggcacacagaattgttattattgaggttaaaagagagaaacaaagcaaagaaaataataaaatggaggaagtaggaaagagagatgttcagacagtggaaggatggaaaagaaatgtatttctgctaataattttaaccttagtttttccacattataatcaagatttctatgcctactatattgtttctacctgctttaataacagctggaaaaacatgttgagtatgaacataccttttttaaaggtatttttgtattaaaccagcctgtaatagtttgcaaaacagatgttcacatttccttgagttgaaattattccctagaaatgagtaagacgaaggatacatgaagctaaaccggtcatccaaaaaacggtttgtttatttgccctacctctttactgtattgactaggtcgtttgatgggattaactaaattgaccggttattttgaaatgtgttaacccaactgtaggctttagggaaaataaagcccctagtgttcttggtggtgtttctttccaagtttctctccacaacacaaaccacttccttttacttgaagtcattttgcttttctcattagtctcacagtccaggggctggtgttgagtgctgaggcagctctcagttcaagaccataaaacaacacaacaaaattagcccaaaacataaaaggaaagcactgtggagttgttcttctcctctcaagaaaaggaaagtggaagttagggcagataaagtatgagaaagagatcagagatctattcttgcataggggtggggaggtagaatgaatgaaaccacagcccaagtcagagggaaagaaaatggaaggagcaaaaacaacaaaaatcccccaccacctctctcgacattcatcacaacaactctctgtgcacctggcatggtgctgcacagttgtcagatcccaggcatgactccctagtgtttccatgaggctgaataaatagtgttctcacagactctccagtagcagcgggtgaaaggccaaccttcattgaccactataaggcttttcttaaatgctactcggacacaccaaaagaaatgttgtccttttcacaaaaacatgtccttgttcaggaccatgtaagttatttaaaataatggtcaatgaaacaaatatagcaatggtatcgcttctcacattttcctcattctgctcagagggctgacagagtggagaagatcatccatcatccacttctttcaagttactcccttctgccaaagggattaagagacacattttcatcccactttctcaaataggagaaaaagttttccatgctggtttctactgttccatgttttgctcttatattgcacccaagaatcatttcaagatgttctgagaagagatgtaaaagagtcagctgatcttccctacttcaggtctattgaacacaggtaagttggcatgacagtgccccagaaccacacactagtactatgtgtggttataacaaaagaattgctatactggtgggcagggtttttttttttgttgttgttgtttttttttaataaagaggcatagaccataatttttagagcaatttcattaggttatgctagaggtaggtttgggagaagagcctgactcggcctgaggaaggggactgggcttgaattttaggtgtcctctaaaatgagataaagtgaaccaggcaattatgagagagaagcgagttttagatggtgagaagagtacaagtaaatgaagacagttgtgaaacatggtgcacgtgggtggaaaaagtttgctgctgaaagagtcagccaggggctgggctggagaggaggtacaatacatatctggataggggctttgggtaccacacgaaagagatctgattttatcatggatgatgggaaggcttgaaaaggttttaagaagagtgacatttgcagattaatttttcaactacataaatttgctggcatcatggaaggccagagctaagaagaggtgcaacagagatcgaccatttaagaaagtagttctctaattttaaaaattatagtaagaaatacattttcatggcaaaatgtctgtgtgtgtttgcatgtctgtgggtgtatcaataattttataaaaccatatttatctttgatattatagatgtggttttatactcttattttttacgcaattctgtatcatatttttaaaataaaatgctaaatgcaactgacagtttcaaaaacactatttcaggtactagtactataattcaggggagagttggtgagtgcttgaactagggaaatattagcaggttagagaagagagcatggatttgatcaatagttataaaataaaataaaaattgtattcatttggggccgagcatggtggctcacacctgtaacctcagcactttggaggccaaggcaggaggatcacttgaggccaagaattcgagaccagcctggccaacatagtgaaacgctgtctctactaaaaatacaaaaattagctgggtgtgatggtgtacacctgtaataccagctacttgggaggctgaggcacaagaattgcttgaacccaggaggtggaggttacagtgagcttaaatcttgccactgcactccatcctgggcaacagagtgagacaactctgtttcaaaaatatatatagacagacagatagatttggtagaaggattcatgatttataagtttcgatcttggctaaaagtgtttcactaactgagataggaagaacagatttgcaaagaaatatgtgagtccagctctggacatattggatttgaagagttggatatcaatggacattgggcttttgtgtgaataaatttggaaattggggaagtgcctactctgagtagagacagagttttgggacccactttcataagatggaaaatacaactatgaggtacatgaaaacatctacagagtacacagagtgagaaaaccaattaatcaaaaagaacattctagaatactcacatttaagaggtaaagtggggaggaagagagaccatgaagaatagtgaaaagaagtattcagagcagcaagaagagtgtggaaacatctggaacaaaatggctcccaacaaaaacatgttgaataaatatttactcagtaaatgaacaaagaaagagtttaagaagaagaagcctctaagaactaagaagacaattaggagttcattggcaaccaagggagggcagctggaacagaggtgttgtgagaaagtcgtactacagtggactgcagactgaatagggatgaggaggtagagcaacttgactgaaaagagaagatcaagaactagctaaaggatcaataaagagttggctgaactttgctgtggtttgctgtgtattgtttttaagattgtgagagacatgaatggggaaagagccagaataaaagtaaagattgaagatgtgagagatagaaaggaaaacagacgaagcaaggacttgtgggagctgggaggagagaggatcaagggcccagatgcaggggttgacttagagcaggagggagaagggaaacgtcatccgctgagaccagaagggaggaagggattatggatgtcagtaagagacctatggataacatctatggcaagaggatgtaggagctgaggaagttcatgccttgacacagactttcttcaaaaagcaacaagttatttgctgaaaggagatgaagagctgctggtttgggaggcttaagagagaggacaggtttggaattagcatgaagaggactgagagaggggcacagcaggaactaactgtcaagtgctctgagagtccgatgaggtgacaggtcttgactttgttggaattccagcttgaagtgatgtgggattatttttcccaggaattcaggtaaggaagtggaaaaggcagactgtaaaactgacagagctggattttcccaaagtgagtaaggaggacaggatggcaagagattcgagagagactgggcaggccagagggagaggttaggagaagactcatttgcttaaaggagattgaaatccctgaactagagacttgccagaaaaaaaaaaaatatatatatatgtgtgtgtgtgtgtgtgtgtgtgtgtgtgtgtgtgtgtgtgtgtcttattctcttttgtggcagacactaaatttgagccaaggagatgtaagtagaagcattatgtgggatttctcagaagccttttctaaaaggagtgggtgtactattccttcttttttcctccttcttgctgctggccacttagttgtgatggctagggctcttgtagtcatctcagaccatgaagacaaagcctataatctagaaatgttaaaaaaattatctgaaagaagctctgggcccttggtgattttagagcagccacagcagccctggactgctcactctgaatttctggaaaaagaaatcaacttctgtcttgattgaagcacaattttaaaaaattgaaataaaaatattttatatatttatggtatacaacatgttttggtatatacagcgaaattttcaggactcatttactaaccatattctagctaaaagagaatatatacacagcaactagagaacgaatagagatttcttggaacagaatgctatctttctaccatgtaatgcctaagcagggcacatactttatagtaagcaaaaagctttgatctttgcaggagattatagactgcttttgatttgggtagagaagaaacaaaagtcaaatcttggatttcttcattaattaaaaaaaaaaaaaggcaaaataaagccacatgtatgttgttttttcccgtaaggtcaagcaaagacttctttatactttttgtgagaaaatgtattgaaaattaatgacattaatacccaggatggtacatttccattgcttcacaatttttttttctttctgaagggttagaatttccaccagtcagcataaaatggttaaaactgaagcctagtaaatcacttgtattgcattgttttcaaagtgactaaacagctgtagttttcaaggtcagccaaatcatctgccagggtcacacgtgtttcacatgtcaagtaacgtatatgggttcaattccatccaggatcctaaggaaaaagacatttgcaaacaagtgatccgaagacatttttctaaacaggtgctgtggttactgggataagagttactattgtaaaccacttgaatttacgactaagtttccaatcatttaaaaagaatattcatttcaaattataatgtccaaaccaagaggaccagctcctgatcataatgacattcaatgaggacagaaagtaatattgtataattgttattattaccataatgacattgttcatgtacaaatgagaagaatgtatattgggtatcaaaataaaaccaaccaaacacataattaggatggaacctagttaaacagttgaagagaggagacttaaagcaacaagacttggctaatacttctccctccaattcttgctccaggaaacattgcatagaaacaaaagacatgactaccatatgccaataactgctttaacaagctggagtaattggtatcatggagccagactgatggaacaaagaaaggatgacctcaggatttaaagagtttagggacagaaaaacattttaaaaatccagtttaattcagaggatagttagagatgtctggctccaactgagagaaggaaagggtattgatttgcgtgagtggctctccattgggctcttctaactcaaaagagataattggccttgaatagtagcttttatattgaatttatattgagttctcttgatgttcttggtatgtgctcttcaaagcccaagaccactccctgatcttgtttatatttgctagtcctaatgatctttcatgtgtcagacgtgctgaatgaagacgattgccttctgatcatttaactcttctctgccagtttcaaggttggcttccatattttagcaagcaaaataataggcatctccaagtcacagtatgcagacaggaatagacaaatacccactttagctaagtatgggctgcagtcaagctggaaaaggtctctcagctctgagtcacttatacaatcgagtccctgaacatgtttctgtccctaatattttgttgctctgggcaaccatcaagtccacatgaagacttctgccaactggagaggatgactagataggagtgccagaattttcttttaactctttgttgaaaactcaaaatagcaaatggtgtcaaggatatcccctaaacatccagattggaaaaagtggaattcacacattgccttggtatcttttattcacttcttagggaaatatgactaaagaagataaaggcaattcatcagaggcatgcatttttttataataataaaatattaggaaaaagttagatgattaggtactatttaatccaatatcatcattttacagaacacaacccaggttaaattactgaccaaaaattacacagagagctaggcagagctgggattatacccctggtcttaaaaccctgaggtcattgctctttcctggactttcagaagcccagtgccagaggcaaagtgaagaaatgttaagaaatcacaagtgatcacctctcttttgtaatagcaaacggttctagttgaaaagggctgctttgctgggatactggaagcaatcctaaagctctggagtagttatcacccattaacactcccaatacagaaagtgtgactatggcacattaaactaaagcatctaaagagtgttcaaggcccaacaaaaataccatgtttgctggaagccttcattgcttattattctaatttggtctttgcctcctctgaattcttacgatactctgtggtacagtcctgagactacttaagattttttgcccaggctggagtgctgtgatcatagctcattgcagcctagacctcttgggctcaagcaaccctcctatctcaactcccccagtagctaggactacaggcatgtgccaccatgcctggctaatttttgtattttttttttgtagagaaaaggtttcatcatgttgcccaggctggtctgaaattcctaggctcaagtgatcctcctgcctcagcctcccaaagtgctgcgattagaggtgtgagccaccacacctagacagtttcttttgcacatgtacaattatattgtgtcaagtccttgggggtaggactatatcttattcatttttgttttcttgaaacccagagcacagaattaaacatattttggttgattttattttctctagaggtacagtgacgacttacttatccagattaattatccaggaatttatactattcaaaatcagtaagtaggtgaaaagaacccagaaaagtcaagtaaacacttgtaggatcttgttcactttatgcatctcatatcctaaaggtctacctcagaaatgaattgccctcaaccttcacttttattttgaattaatttacctttattttatgctcaatgcaatagcttggtaatcaggtttgccaaggaaaaagcagcagcagctcacaaaagatgccaataaagccaagcttagtaacatcatgaactgaccaccagacaatatgggacagcagatgagaaattaaagtgcagccagatttgctgctcgttactgtaggggaaaaaaaagtcctcatagatcattagctcctaagtgcatttgtgaatgacagggaagtacaaaagcagatgttcatgaggaaccagagccagcaaaaatgatttaattacattcagtgtacacctttaagaggttaagaataagcataacacctttcagagattttcatgaatattcaatatacaggacattttctcttaaatgaaatgtaggaaatctaaggatggagataaactagccttaaattcagccttagaatccaggtcttaacctatgtttatcctacatataatacgaaggattataaattttcacacattatcagaagcattttacacctactcagtaaaatcatatgattagcagttatgaaatcctatacatttatcctccttatattttttgtaactatctcttcctttttattctggctatctagctatctagtgtacaacctttattacatcttatgcttgaatatcgctgttgtctttgagttggtttcaaaacctcggatttttttttccttcattagctgcattaaaaaaaagaaatttccaggtgattattattatcttctgtagaaacaggatctcactgcgctgcccaggctagtctggaactcttggcctcaagtgatcctctggccttgacctgctaaagtgctgggattacaggtgtgaggcaccacgcctgccccccaaggtgattttaaggaacagacaaatttgtgaaccactatccctaagtgcttagcacaccattcatttcactcttaattatatccttcaatggaactaactcccttagtggcaggcgtaatatgcctgtgatttctgagcttagatgctctttaaaaatagttgtttttggccgggtgtggtggctcacgcctgtaatcccagcactttgggaggccgagatgggtggatcatgaggtcaggagttcaagaccagcctgaccaacatggtgaaaccctgtctctactaaaaatgcaaaaattagccaggcatggtgacgtgtgcctgtaatcccagctactcaggaggctgaggcaggagaatcacttgaatccaggaggtggaggttgcagtgagccgaattgcgccattgcactccagcctgggcaacagagagagactccgtcccacctcccacccccgccaacaaaaaagttttttcatattcattgtgttagcccaaaatatctgagacaggtctcaatcagtttagaaagtgtattttgccaaagttaaggatgcacgtgtgacactgcctcaggtggtcctgaagacatgtgcccaaggtggtcaggctacagcttgtttttgtacattttaggaagaaataatacatcaatcaatacatgtaagatttacactggttctatctggaaagctggaaagcgggaaaactcaaagttgggggagggcttcgaggtcacaggtagatttcaacatattctgattagcaattggttgaaagagttattatcagtagaaaggaatgtctgggttaagataaaagttgtggagaccaaaggtttattaggcagatgaagcctccaggtagcaggcttccaagaaaagagatcctaaatgtttcttatcagacttaaggtctgtggtgatgttaatactggaggggtaaaataaggcatgtctgacttcctttgcggcctaaatcagtctttcaggttaaattttaaagtgccctggccaaggaggaagtccattcaggtgagggtgcaggcgtgcttcaaattttatttttagtttacaactgttagcgaaaagtacgtcctctcaatttccgttttccccctgtatttacttaagaactattttccagttccttctatatcttgctttgcatctccagcaaagagatactaaagttttctcttggtcttcttttcagaggtgcggtttgatgattacgcacaaagagacaaagataatgagtgggggtagacctgctagcttaactttttcttttagagaagcacctaaggggatctgtcacatggatgaatctacccttctttgaaggtctgatttgaaagcagattggactacattctgcacaaaggcattttaaacatgcaggtgtgaatgccccaaataacaatactttgaacttttacagaacctttcatccagtgataccaaaacaattcagtttattaaaggcctaggaagctggggacaaaacatccaattgatctatatatggaaatttattgcattaacttggttggtgattcctttcaagtctcccaacgctggggcatataagcagagaaaactgtacggtttctgcaagctacctctccaaattgtaatattttccatttccaactcctcaagaagagctaatcctcttcttttcacatttatgcttaattagagagttaccagttcacagacagttatttatgttcagaacctaataaattcttgtttctgccttaatttgaccaaggattgccttctatgtcatgttctaaagaagcccattgaacaaataaataaaaacagacttcacctgtagtgagggagaactattatctaatcaatttttcattttaaaaattaaatacttcaaaattggctgggtgtgatggcccacacctgtaatcccagcactttgggaggccaaggcaggagaatcacttgagcccaggagtgcaagactagcctgggcaacatcgtgagatcctgtctctaaaaaaaaaaaaaaaaattaaaaattagccaggtatggtggtgcagtgctatgtgcctgtagtcccaggtagacaggaggatgaggtgggaggattgcttgagcccaggaggtcgaggctgcagtgagctgtgattgtgccaccgcaatctagcctgagcaaaaagtgagaccctgcatcaaaaaaaaaaaaaattgtaattaaatcttatttttaatctgagagcatagatttaagttgccctgaatatacactctcacttatctaattgattttttttttttcttcgaggcagagtcttgctctgtcacccaggttggagtacagtggcatgatctcacctctgcctcccgggttcaagccattttcgtgcctcagcttcccaagtagctgggattacaggcatgtgccaccatgcctccatgcctggctacttttttttttttttttcagtagagacgggggtttcaccatgttgcccaggctgatcttgaactcctggcctcaatcgatccgcctgcctcggccacccaaagtgctgtgggattacaggtgtgagccaccgtgcctggccaatcgaattgatttttaaatgaacaatctttttttttttttttttgagacagtttcactttttgcctaggctgaagtgcaatggcgcgatctcagctcaccacaacctctgcctcccaggttcaagcgattctcctgcctcagtctcccgagtagccgggattacaggcatgtgccaccacgcctggctaattttgtatttttaatagagacggggtttctccatgttggccaggctggtctcgaactcctgacctcaggtgatccgcccctccttggcctcccaaaatgctggataacaggcgtgagccaccgctcctggtccttaaatgaacaatctatcgtacaaatctgttggatacctctactttttaccatatatctttcaaaaaacttacaaatttaatcttttcctcttttccaccttctgacttccttattatatacattgcagtgaactcaggacagctaagattcagagtggcaactggggtatattcctattttcccatattttaaatctgctgtaaaggaaatagttgttatgagcaaaatgtgtctgaggaatgtttatcagactatcgtttttatttggcattgtcccagcatattagtttttaatttttttgccccatttcaatggtgactttgatgttttgttttgaccagctgctgagctttttgtggctgtccatttacatcactttaaaaaatggtacataaatgaaatttgaacaaaatgaacagtactttaacattgtttcaaaatcaaatatcttcctaaggaatctgatttgtggcagatggagaacaaaaccttccagagggagggctgttaaatgagtcttaattgcttgcacatgaaaatattgtgactaagattgtgtgcacaattaggaatttaaacatgtagaaaagaactggccatagaaacaggcagacatttttgcagtcagagctagtttcttgtgaacacagacaataaagacaagtcagtaaaggaaaataatttcaagagaaattcagttgttttctttacttcattgttgcttacattgagcttccaattctaaagatgattcatttgccttggaaactcactgatggaagtatcacagtacagtcaagaaaaaaatgtttattcaagaactagtatttcttttttagttcctactatgcgtcagatgctaggtttcgtgcttaattcacttcatttaattcttacttaatgctctgagataggtttgctattattcccgtcttctaatgagaaatcaaggctcagagaataactttcccaaagtcaaatagctaacaaatagtgcagccaggattctctgtattgatttaatgaatccaccctctgacaatgcctcactgctcccctgggaaaaagcacatatcttttttttaaaaaaatgatttaataaacttattctaagagcgcctatactttgttctgagtcaataatgccttccttctgttggatggcatgatgtaggttgctaggctggacttgttaaacgttgggtaaggaaggcatgattgcacccaggcgaagtgaatggctacgcagagggcacagataatctgaataggggttgggctgagatgacagatttagagacagaggccaggacttcctacaggggccacacgtcacggcgtcttgtatagaaccaagcataaaagaggcatcaataaatgtgtgtggatcaaatgatgagatggtcaaattatttttgtgccttcagaggaactgagttctcaggatacattaatgacaggtaccatctggatctctaaaaaaaatgagtatcataaaaagaaattcagtgagaaataaattaataaaataaatagtgcattgaaaccaatcctactagcatttatttcccctatctaagagcaccctaatttctttcaggaatatactttgtatccctattagataatcttaataatagttaaccagcaatgatcaagtgcttactgtgagccatgcattttgcttcatttttcataaatatctttttttttcctaagacagagtcttcctctgttatccaggctggagtgcagtggcacgatctcagcttactgcaacctctgcctcccaggttcaagtgattctcctacctcagcctcccaaggagctgggattacaggtgtgcaacaccatgtctggctaatttttttgtgtttttagtagagacagggtttcaccatgttggccaggctggtctcaaactcctgacctcaggtgatctgcccgcctcagcctcccaaaatgctggaattacaggcgtgagcaaccatgcccagcctttcataaatatctcctcaaataattttcatgaactccctatgagataaatattattattgtgcttacttcaaaagtgaggaatttcaggctctggaaggttaaatgaattgtttgagcacaagcatctgtaagtcgtagtgctagaatatgaacccacaaaatctggtcccatcattcagctcttactaccacattttataacatagtttggtagaactgaagccacctgcctgttctcttttagccaaggcccaggacgcaaacaagacaaattagatcccttcactgctgtttgactcttgaaataatgacaaagaaactaagaacagttgtggggatctcactcgactactcctgccatgagactttccccttgatttgtagccttctagcactgtaaagatgcactgattccttcaaacctcgtcctccagcacccccaccaccacctgtcgccccactaattctcagggaattcagaattcttcctatattcttccactaagaattttgcattaatgagcagagttggtttttttgtattgcaagcaaaggatcattgctgagacaccattttctaaggggaggtgataagccagccaaggggagaattgtatggaatccccaaagaacaagatgcagacaacactgtttagtgtgccacaataatttaatagactcactgagaaataatagcatgacaaaaggccaggttaatttcctctgctgccctttctgtggaaatgatgaaggttcttgggctcctctctgatccactggtcttagatacattggccttctcctttatttccagtaccctcaacagtttccagtaaagagaaacagcaagggagggtctgtagaaagacagactgtcttgaggttggctgaggggtaaaagaaatttcccagaaattgctccttttccttcacaaactgcctagaattcagattttgtctccttcaaagttgcatctgggaaaatgtgtttatatgcttattccacacattgccatcattgtaatgattttagggctccctgtcttggaattgccttaaaagtccatgtgatacttcttaaaaaactctttaaaatcccttgagaatggtttcatttctggagttagccccatctaagctaatttgacattctgtctggtgaatagggttggtaatcatattggaaataatatttttggtcataagtgaagtgttactataaaccagtgagattgcttattgctttttggtatgtgtgtgtcttatatggtctgtaaatggtctctaaagccacttccaaaatgctttcagcaatggcatcagggctcaaataattgcacagtttccagagatggctgttttgaggatcaacagtaattgaataatataataatatttattggtagtttataatacttttcaacatattaagcactttccacatgcttttaaataagacctgacatttactatgtcccagacaccgtgctaatttttttacacagattatctcatgtaattcctcaaaattaggaaggtataattattacccaccacattttaacagaaaagatctaacacatcggcgtgacttttctaaggtcacacgtaaagtgggtgagcaggacagccagccacgaaaccccaattttctgacccctgagtcttgttcctcctccttcacatagattttgacttgtatgtcaaaacacaaaaacaaaacctaccaatgtttgagatttttttctatgggaggataaaacctaggtctgtctctgtagaagcaatattagtcaaataacagtcagtccactgtcagtgacttcagaggtatcttacttgtcattcaactctgaggtctcggtttcacgaccagttcttttctattttccttttggctattttgaaacatgtcttcttttaccaatctcagccctccactttctcatgctgtgaagtattccctaaatttctgaattattttcccaaaccattttcagtctctaagctaacactgtaggcagcttcttagctctttagaaaaacaatctcacctgcatctgctccattcttcctctctcccttcctttctctcttctttattttacttattcatttatccattcacttataagccctctgttttctattaacttaatgctttttgtcattcaacagaacacattttagctttttaagttccacaaacctctagagtaatggtcctgaagcttactggaggtattttattcatccttgggtccttggagcctaagcatagcctttcacatactagggactaaatgagtaaaagcaaagccaggaagaggcagaaatcaagttctctatgtggacagttctgtgttcaatatgcaaacatcagaaacatatccagaaaagaatgtcataaacacccatctgttttgtgtggcatatagaatacagtcaattagaaatacttccacaggaccaacagtgctgaaaaggaaccacaaaaaaacaaaacaaaacaaaacaaaaatacagaaggaagacggcacactagaaagcactggatatttaagcatcagaaatatctcaaggaagtgcattcaggacatggtgagctaggaaacttttgcctagcaatggtagctaagagatgataatggcatgaagagacttcacccaaagagaagattaatattcccagtagttggggcctgccctttcaggccttcgtggtaagtggtcccagaagcaaggtgagtgctaacgctgaagcactgcgttaccctggttcctccgaaacaccccatctgcctgacttctcacacacacctgggcctttccttgtcaatgctctgcccctgggcactctggtgacaacgggcacttcagaagagtcaggaagagaagtgtgggaattgaagaatcctataccccctggcaggaatcctttccttagcttatataactatagagagtttttagggtttcccaaagagtttctgtgcatccacagatcttatccctcctcttgtcctaccctccactcatatacattcaggaatagatggtatagatttgttttctgttctcaaaagaaaaaagaaaaagaaagagagagagagagggagggaaggagagagaaaaaaaagaagagagatgtccctagggaataacttttgaggaccagcacatccagcagcttgtgtatgtgtgtacatgccagtacattttaggagaggacttgacattctccctctgagtcaatccgtactttgtaattttctacctatgtatcttaatcaaattattcaacttgtctagcccagttttgcatctatgaagcaggaatagcaacggtgtctacctctttggatatcataaggtttaaaaagattactcatctagagtgtttggtacatttcaaatgtcagtaaatgttaacttttattaatattagtattaataatatatccaactgatttttaaagcattttttgagagaggctttttgatataacaaaagaaacgacgctgtgagtgcactccctatttatttagagttaaataattcagtgtaacatccaactagtaaaatttgggaaatgagcctcaaaggaattttcaacattttgccccaccacagtcactgtatttctgagtatgcctagaatattttttaaggctgaaatgggtgggaagcactttgtggagaaagggagtgactgaagaatgcagtttgtgtggttcttttattttttttttttcttttattagtttaaggagacttggtactgtgtccaagaagacaaaaagaatgcaattactaaacatttcccaaattccctccctcccacatccacaaaggtagatgtgatacttgattttcttctcagagacgagcaagctgctctacttaaaatcttgtatgtattttgagagataacagatgatgaccctgacgctgatgcccaggatgacgaagtcagcacagataataatatcaccttgtatcttctttcactaatcgtggagcactttgcacatatgatcgtgcttatcctgggctgcactgtttgttagatgagggtgtgggtgtcactatatatactttccagaaagacaggtattttccaacaagctatcatcaactcaatgacaacactgtacacaggcagccctctcacctgctttcttcagtattccattattctcccaaatttggccaatcaagcccattcacctgggagtatttgttaataatttagatcctgagccttatcctagacattcagttctggaaagtctgggaatcagtcattttgtggttgttctcaggaagcccttggggattcctttgatcagagacaggtttgggaagtattgctctttttaaactcagggcagcggggaagggatgctggcaggagtggactttggtgacactgagatcttttattcatgtggtagcttttcttactctgagacagagttttgctctgtagcccaggctagagtgcagtggcatgatcatggttcactgcagcatcaacttcctgggcataaatgatcctcctgaatagctgggattacaggtgtgcaccaccatgtctagctaatttttaaaattttttgtagagatggaggtctcactgtgtttcaggcttgcctcaaactcctggcctcaagccatcttcctcccttgcctcccaaagtgctggaattacaggtgtgagccactgcacccagccctaagggtagtttttctgatcatctgaaggataatacaacatttttgtcataggctcaataatccataaaatgctgccctatgtgagagatattattattttaaaatacagttaatgctggactgtggaaccataatattgaaatattgttagggcgggtctcaccagtgccctttctaggcaaggagaggcaaactaacaactgggacctgagaaataacatgtttgtcactagattcaatgtaaaatggtaaacctatctacctttgctaactactggtcaacaactaaaagtaacttaagttcaattcaatatacataattaaagtgcattaaatgtgtgcctattgcccacatggcactttattatgtattccttaaaatacaaacatttttccatattattaaaattttctcaaaaataaattatttaaaatcattttattatgggaattttttaacccctacctaaatagaattcacacattatttagaatttggattgtttttaaccctttatgcacattcacagtgctgtaatgaacatgtgtatatatactttcactttttttttttttttttgagatgaagtttctctcttgttgcccaggctagagtgcaatggtgccatctcggctcactgtaacctctgcctcctgggttcaagcaattctcctgcctcagcctccagagtagctgggattacaagcacgtgccaccacgcctggctaatttttgtatttttagtagagatggggtttcaccatgttggccaggctggtcttgaactcctgacctcaggtgatccacccgcctcagcctcccaaactgctgggattacaggcgtgagccaccacacctggctcatactttcactttaaaattgttcatcctcagtctctgctctaatcaacccccaagtcccttcaatcctatctctgaagagttgtgaacccattccctcatctccacagccccacttccaccccagttcagagctgcattatcttgatcctgtacaaggcctgtgacagccccctgaagagtatggggctgcccctagtctttcttcttttcaatctctttctacactgcttccaattactgtcattctgaaatgtgtatttgttcctacgattggaaatgctcaatgattttccactgtccataaaataaagtccactgttatttatgtaggcctcaaatattatttccttaatctacctctggagcatcctgttcagttgctcctatacacctttaactcaatttgtcctttactgttcccagtcccctgatatggacaggcattccatgcttccataccttattcttgctggtcttttgttgtgaggtaatcctcaatcctcccctaaccacatggaaagcattatgttcttcaaatttatcagggagcatttcctaggtagagccactggctctctctctctctatatatgaatacatattcatatatattatatattaaatatataatataattatttaatatatattttatatatttattttataataaacatatatatttatatgagaaatatatttattatataataagcatatatatgagaaatacattatataataaatattatatttatttatatgagaattatatttatatattatatatttatataataaatatatattatatatataataaatatatattatatatataataaatatatattatatatataatatatatatattatatatataataaatatatattatatatataataaatatatattatatatataataaatatatattatatatataataaatatataatattatatatatttatataatatatgtatataatatataatacatatataataaatatgtatataatatataataaatatataataaatatgtatataatatataataaatatatatttatacaatttataagaaatatatatttatataagaaatatatataattttataaaatatataatatataatatattatatattatatattttgtatatattatatataatatatatttatataaatatatatatttaaagaggtttcagtccaggctctgtggctcatgcctataatcccagcactttgggaggccaaggtgggcagattgcttgagcctaggagttccagatcagcctgggcaacacggcaaaacgccgcctctacaaaaaatacaaaaaataaaataaaaaattatgcacacgtggtggtgcatgcctgtagtcccagctactcaggaggctgaggtgggaggattgctggagactgggaggcggaggttgcaatgagacaagatcgtaccacttcactccagcctgggcaacagagtgaggccctatttctaaaaattaattaattaattaaaataaaaaatataaaggcttcaatcatggcatttagctagtacttaactatttataattccttctcccttactttgtaaatttcttgaaccagtagtcacattttacctccagagcgtatgcatgccatatataaggtgcatggaaaatactgttgaccaagcagataataataataataatattatagcaataatgataagtaacatttgttgaatacattctgagtaccaagtactatgttaagcactgaattagaatttactgataaagaatacccccaaaacttggagaatttaagtacattgaccaaaattagacaactactaagaggaaagctgggtttttaacatatatgctagctcatcacctttttgctaggctaaatgaacatgagccccatttaattatttcaattaaagttataacaaagcatccaaatcagatattcagacaagagagacacaattaaattatttcccctcataattaggacatagcccttgttttcactattcttaaaacaagtctaacttcaatcaattcctggtcaaaaagccacggtgtcagatctgatctttttatatattaataggtatggctctactcattaaataaaagcataaaaggccaaaacaaattcatttgtaagaaagagaactgacttttactgctctaaaagatcataagtttaactaataaatagtaatactccatgcatttatgcaaatctttcagttcaatgtttttaccggaagattctttttcaatgaggatttttgtaaaagtaaactccttcagcttaaaagatttaggaaatccgacagtcattagatgtattagatgctttatcagttttttattaaagctattaaacacaatgtatcatcagcatttttcgatcacatttcttaaaaagcttaatgaacacatatttctggcaattattaaagtgtggccacaatctttattctattaaaggaaaaaaagaactacagcatgaagctgctgcctgctggtggttgatgaggaagtagggcttctctggcaatggctgggtctcttgtcttccctatacactgacacaacacatgttttacttcagtatctcctgaggacttacatatttctctcatgtagatcccttttgccttctttatatggttcttgctcccatctattagatctctctatatttctttttaaaaaactatatatactacttgcttttatcacacacacacagatttaaaaggcagatctaagtaagtagccagcatccttattgtcaccatgaaatagttgcttagtttctttcattcgataagctcaaagcattaagtgattagcccagataacaaaaaaataattgtcccaattaaatatcattattgtttttcccccttattaattcttagaaactgcttgtgctttagaacaacaaacatataagattaaatttcttctcattgtgttttgacagactagcattatttggatagtttactttttaattttctacgtgccaattgactaaattctatttagaatgcacttactgtttttaatgaagccatgaatcttcagggtaaaaaaatacaaaaaggaatgaagacttagaccaatttacttatttatttattttctggactaaaaccacttctgtgctgttctatgcttgtcactgcatcatgtgtctccccctacaggtaaagagcaggcagctgtactagtttcaccgctcctgtagaagaatttgtattttccaaagtcaaaatccagaagtcttttgctttagggtgctggtctctatgcctctggggtataagcagtagatataatcaaaatagctataactacagagatatgtccagtgagaggttgggatgagaaattttcaagctcatatacaaataatacaatgccacatctattactcaggagttagtattaatacttcatttactttctctaaagcatatacttccacggtgggtataaaggccacccgaatctaatggtttattttactttataaaggtgtaagaaggaccatggactcgaaaaaggaaccacatgtttattcctggcattgtcactaagcagcaccctctctcactaggtctcagttttttcatctttaaaataaagatatttaaatacgttttctttagagttgtgtccttgcatgaaaatcctctaattgaggatgattaaataaacatattggaaatatggaaattcagaagcattgaaaatggtattgtgaagatgtaacatttaatgagatggctgcagaatgcttgccttgagctaaggttgttcgaaaatgaaatgcttacaaggaaggactgtgctccaagctacatggctgtacttcaaaaatgggatcactgtcccagtgcaggtatggcttgggcatctctgactctttgccaccctctcatgttccaatgcactctttacttctggtgtgcaccacacattaaggacgtatgtaggtgagccttactctaaatgataaaaggattactaaaaatgtcatgccatgactgtgtgaaaacaaaatcataaatgaaatgtaccaaagaagctgacataccaatattctctgttacctctattctaccagtttttaaattagctttaggaacaaaaaaatgtcaggcattgggacagggttataggaagaaacacttggtgagttcctcatcacattcggaactctatccatttttctttcttttttttttttttttttttttttttttgagacggtgtctcactctgtcacccaggccgaagagcagtggcctgatctcggctcactgcaacctccgccctcagagttcaagcgatttcctgtctcagcctcccgagtagctgggattacaggcacctgccaccacgcctggctaatttttgtattttaatagagacggggtttcaccatcttggccaggctggtcttgaactcctgacctggtgatccacccgccttggcctcccaaagtgctgggattacaggcatgagccaccatgcccggcctccatttttttttttttttttttttttttactttaggagacagggtctcattacattgcccaggctggtcttgaattcctgagctcaagcagtcctcccaccttggtctcctgagtagccgggattataggggtgtgccaccatgcccaacttgaactctatccttttatataacttatctccttgaattcttgcaacagtcctaagtgttaggtactcaaatctccaaaatgaggaaatgaagcaaaaaggagagactgggttcacattcaggctccaaatgccacacatcatctttgtcatatcacactaaagagcaaaagagctatttaagtctcttttataaatgcaaacttcaaagccttacttttaaggaattgttagatcattttagacctgtatgtttacctactatatattgaaataaaaactggccagtgacctacctttaaaacctagctttaaaaccctaatgctataaaatcaaactctcggccaggtgtggtggctcatgcctgtaatcccagcattttgggaggccaaggtgggtggatcacctgaggtcaggagttcaagaccatcctggctaacacagtgaaaccctgtctctactaaaaacacaaaaagttagccgggcgtggtggtgggcatctgtaatcccagctacttgggaggctgaggcaggagaattgcttgaacccaggaggcggaggttgcagtgagcctcagatcgcgccactgcactccagcctgggcgataagagcaaaactctatctcaagaaaaaaaaaaaaaaatcaaattctcctggctttaatacatgtcaaatgcaataaccttgaaaagaggaagagggtattgtaaattctatgtgacaactccttagaaagcatggtatgtgatatgtagactgctgaagttcttaactcttcttttttaaaaattagagttggtttacagaaaagtgatagagaattaatatttctccttcaaacaactatgactcaaaagtgagttcttagacttagaaattcatcctgaacaacagtgtatcatctctatcacaaagctaccagcgtctgtgaattgtgatgagaataaaggagacagtgctgggagcaggaggagaccccattttgatgggcacaaagcaagcgcatccattttggccaatttaaggacccacaagttttcctctcatgatcttgcaagcttgcctttctctcactgttccctttccttcgtttgtgtctttgtcctattctttccattacccccttgttacggaatgagtgcttgtgtgcccctaaaattcatttcaatatcctaacccaatatgtgttggtatttggaggccgggcctgtgggaggtgattaggtcgtgagggtggagcactcaacactcacaaatgagactagtgcctttacaaagggcactgatgcaacctagaagaagactctcaccagaccccaaccatgctggcatcctgatctcagacttccagcctccagaattgtgagaaataaatttgtgttgtctataagccacccagtctatggtactttgttatggcagcctgaattgatgaagaaacccctagttctatgtatacagtgggccctagaaacaaaaccaagtaataacaacaaaatggaatttaaaaagatgtattaagtgctggttctgtgaggcactatgctaagggcatcatgcgtgttcactcattcaagccagcaacaactgcaggaagcagtgtcactattttataggtagggaaactgagcagagaaagggtatgcaacctgcccagggccacaaagctctcatgatagagcatgatttgagtgctgggtaggcagagcaaccacgtggtataattctaggggcaccatgttgtgatgttctgtggagttgccctccggaggcacttggagctgtgtgctctagcagccttttggatcagccatgaacttaactgttaggctacactgttactctagaccttattcctatgttgagggatagacaggcatacatttgcgaacctgtacctggggcctctagtgagagaagccacatggaagctggtcctcatgctgctccaggcactaggtctgacccctatcaacagggacccattcatcttaagggtgcctcactgactctttttaatacttctttgcccttcccaggactactgccacagtacagccaggttccaacttcagggggagtgagcctagagggtggggcctgagtggtcagctgcagagggaggaaaggcacaagcactgccttttctgagtgtctcaaatcttactaatgtcaaaatctcaaccatcattattattactagcactgaggttttaagggcccactttttcaaaatgggctcagaaaggggaaccttcccctgctactgccctcatccctccatccctatgccatgttcccaccttggtttgctatgcttgggcaagaaaaacgacttcccagttttagtcagttcatttcctgttgtgctttgtgaggagcccagcagcactaagtggtaacaacagttaattagtttccctttctagataaggtatttctgtgtcccccttgtccctaggcctcaggtcaggagcttgtgggtacgaatgaggccatattcaccttaatttcttaatttctgtggctcataattccctctggtattgctccaggacccccttactatgtatacatttctaggagcttctatgaggtctgtcacatatgcttaagatcaagtgtgtgccctttgagtgtagctactctctcctgttaatctgtgcctggcatctgctgggatggctgggcagctgccctgaccactgagcacccaaccatctgttgtcagccacaacaatttccactggtacctgatgctgctcttctgggagaatgctgctccacctgtgaggccagctcatatgtgacctcaagctaaaaaagcttccagggaccaaaatagcactgcattctgcccaaatagcaatgtcagttcttgcttattgcaaaattgggggttgagggtagttcctcttgataggggtcagatttagtgcctggagcagcgtgaagaccagcttccatgtggcttctctcactagaggcctcaggtacaggttcataaatgtaggcctgtccattcctcaacttaggaaagtgcatagaaacagagggatccggttccacacctccaactcagtttagactcatttatgttgaatttgaattttggcagaagaaatcagttactcaaagtatttattttagcatataggaattgttattgttcatctctctttctctttattttttggagacagtcttactctgttgcccaggctggagtgcagtggcgcgatctcggctcactgcaacctctgcctcctgggttcaagcgattctcctgcctcagattcccgagtagcttggattacaggtgctcgccaccatgctaagttttgtatttttagtagagatggggtttcgccatgttggccaggctggtcttgaactcctggcctcaagtgatccacccaccttggcctcccaaagtgctgagattacaagcgtgagccaccactcctggccctattgttcatctcttgatcaatatcaagaacaaaactggttaaccatatatgtactataaaatgataattggaagtcatcaccaataatatgttgaaagagaaacatgaagaagagatcaataatttaacattcattgaaatacaagtttcacttgatgacattcagaaaagatgacattaacaatgattccagaatcaactctaatgtggtgaccacaaacacagacagacgtctggacatgataaagttaaatttcaagcaaagtgtactcactaataacttaataagagctcctcagcacattatgggttggagctcaaggaagacacttgaatccaatgacgaattgttttagtttggagaatatgctaattttcttctggtaataattttagaaaacataggttttcttttccaggcaattattttaatgaatcaattggggtttcaagaaatagtcaaaagagttcaatttggtttcaggttcagcaaaatgagatcatgcattctgtttttggttcagctggggtcaagtcctgtgcctaaaacagactaataggaattgagataattttatttttatgcacttggctcctctcatctttcctcctatttttctttcccaaacatctatagatcccaacgttttgatctcattgaactttttctgcattgtatattaacttctctcccctcccaaactgagtttattctcagctctctcagtcctttattggactactggtacaatgttgcttcctacacacaagtgggatattgatgaaccaacacgttactccttttatttatgccttcactcttattaaactaaatgatgacatattatatcatgctaataacacatgtgtggaaccagaatgggaagtgacttgaaagtaacatcatctctcaaaatacaaatgcccagagcaatgctcaaatgagtataagcacatagttaaatggttaaaaataatgtacatcagtaaaaaacgtaaatcggtaaaaatgttccaaataacagcttagacaatttgtgagatcaatgatagaaatgataatgtagagaagaaagaatttctttaacattttcaaattgcagcatgaaattggtgttggtgttatattgactcttggcagaaatggtttcttcctagacacatgaagaataagctccagatctttcttacctgttatggtggctttgttgatggatggttggttgcacatgggtgatcttctgacaaagacagaaaaacacaaagcagtaaatatgtggggcttattgatttgatcactctctgagtcatttcagatatagcattttactttaaagaattatttttaagtttggacacgcaaatgatttctttcagactagccagacaagtccctaggcgttctttgtattatggctcagatcacacatgtccaaaaagaaaactggtaaatctcacagtgattgatttggggtaaataaagctgatgtaagtgtcactgggacatgagagaagaggaaattcttacagactttattcgctgaagccagagcttatagactctgaatttgaaaaagcagtcaatttataattgtcttccctaatacagggttaagaaatttttattgttggcctaaattctcgtgattgcctgtacattatcagaagtgaatgatttgttgtaaactatcttataattagagaagctatttgaactttttcctttcttttcttatattgaaaaacacctctgatatatttgttagagaggtatattaatgacttgtccaaatagatactatagaagctttagaaatactctaagccaaaggtacttaaataaattatatcttgtgttctctaagttttcagatgtttgccaagttccacaaaatgactataaaccccttgaagtaaaaaaaaaaagcatgctgtctgattaacttatattccctacagagcctagcacaatgcatccagtattccgtcagtgcttaataaattatgttgaaaagaatatcatttataaagtatccatcaacatttttgaaatataactttataaagttattacttgtaactgacagcttttaaaatataatgattaaaaaacacttttagatacattcaaagatgtctgatatatatatatatatatatatatatattaggtatataataattatatatatattgcctctaccaagggtgaacacttaataaacacttcttgtggatcagacattgctaaataagtactttaaatgaattatctcattgaatccttacaataagccttaaggaagtaagtttcattgttctcattttaccaatgagaaaaacaaaactttgagaatttgaagaacttgttttaagtaacgaagctgagatttgaactaaacgaatgtgatcctagggtctatgctctgctttgctgccttagtttgagatgtttttgtggaacctgcatgcacagcctcacatatgtgccaatggcatcaatctcttcaaatatgccttgctgagatgatgaatttcttagcagggtgggggaaagttggggaaagcagcctgggattttgtaaattctcactggttccactcagcctctggctccctttcattgctcctaaggttattggtatcgatttgggattaaaattttgtgtttgattgaaaatgcaccaaattttacttctgaattattttagttttttttagttataaaataaaatggttgggggaaaaatggggagaatttaaactcgataaaccaaaatattaatattttaagcagctgctctgaaatagctctggtctatataccagtaattatcttcttcttcttaaatttttttttttttaaagttttgagatagggtctcactctgttgctcaggctggagtgcagtggtgtgatcatagctcactacagcctagaactcctgagctctagtgattccccccaccacctcagcctctcaagtagctgggactacaggtgcatgccaccatgcttggctaattaatttttttttttttagagatggggtcttgctgtgtgtaacagggtgttatctgttaccttctggctaagagtttatcattcaaataattgatatcctgattactcctttttagtccttgctctgtgaaaatttagaaaccattgattttgtctgggaatggtattaaataaatattttcacactcttctacagttttggaaaaccaaatggttgactcaattctaattatctccttttactatcaatcctacaattaactggtactcaggaacttgatatctgaacaagtaatggcaagcagaaaatattaatactttgatccatggttgcctcgatacctcctctaatgacagatgagccagaactcacttctggaataaaaaatctcaagggcaaaacaaaaacaaaaaacccaaggtgacaagaagcagtaatgtgttaacaagtcagcaatgtgcatctgaatacccacccaggggctgggtttggaatgcattcttcctagactccttttctgcagcaaataaaaagggtggcttgtgcaaaggagcacatgccttccataaaatccaaggatgagcttggaaatgttctagtggctctgtgagtgcccagcaggaaaggttctgattctcccagggtcatcatgtgatgaggcagagttacagcactttgttctcactgaacagaatcgagtttagccgtgaatagattgaatcctactattctgatacccaaagaagccgatttggtttgaatcagtaatggaggcacaaatttgcattgaccaaaaggaagaccacagtggcctttacttagagtctgccagataatactgtttggttagatgtcaccctgggcattgacaaggcagagaggaagttcaggctcaagctatgattttctgttttcttctagctcctcctttccatttcaatctgttccatccctgtatgtcagctgaaaacttctgtcttgcatagaaacaggcctcagatcgtctctggagcctgactgatcaactatttacctgccacagatttaaatgctggtacccaggtgaccacatgtaaaggaagcataaagggagtttcttgttcactttttaaagacaaaaatctcagtttcctgggtaaaattcgagactaaaaagtttgggagtgacaaccagttaacttcatttcttctgcagagctgagactttctaagggggaggtgattgaccttacaagctaccaaatccccaaagcccaagggggccgctgaggtcagtatgacattgcacggccacgttacatagaaaacgtgattggtaatgaacaggtacctcaaagcatgccctcagattttacatgctgagttactactttgccctttcagcgaacaggcctttgcagactgatagactctgcattatgctaggcacagggaatacaaatgtgaaccgactacattcctactcactgggaactgacagtgttcaggagcatcccaacagacaaacaggcaacaggagcacagagagctacgtgctaacataggaatcaagtacaaggtacaatcagacagagatggaaaggcacatcactttgattagggcttgtgggtgtgtgtctatgttgggtatcatcagggacaatgctccaagagaaattttatttaagctgcaaccaaaagaatgaatgacaattatcccagtagatgaggagaggaagaagaagatgagaagtattcaggctgagagaataggactgcaaaaattcattacctggaaaaacagaacctaatgggttccattccaatagcttgcattgttacatttatattgatttttaaaaacttttttctatcacaagaagtacttgaataacggccagagctatttttgataatgaaaaacgtgaatctgggaggtcaattttattactatgaaatgtaaagttcagatttctcattgtttttaagaagtagtaactactatgaaatgttatgcacttaggtaagttatagttcctaatacacttatatttactatcctcttaatatgatttaaatgttttttttccttctggaaaattatttgaagttggcattttaatattttatttcatattaatagcagattttttttaaaaaaatggacattgaaataacagcaaaccagttttccatttaatattgaaaaattacttttatctttttagatttttttgcctttatcaagaacctgaaatgataatcctttcccatctttcaaatgctttccctgttgtcatataaaccacaattctattaattgctccatgaatgctgctgatctgaaagtcagtaacagcaggagaatcaaagatctttgctatgatatggcgcttctccaaatcatcgttgtcttgagaggatgactttcagctgatcttaaggtgtgatgagattattcacccacggttaatttatgaagtaagccgaaactataaagttaccctgagtgtaaataactgggcggaggactgatcatgccaggtgatttctgacagatggaatcaccatatttatttgtcatactgcttcatttctgatattagaaccatcaccacgaagtatttatagaaaattaacaggacatcatatgacttagtatacacagacaacatggcaacaacacagagaagtctaacatattgccttgggctcaatcaagttgagaaaacttatttaaaagttcagcaaaaaagaggggggaaaaaaggatatcttacttgctaggtgctcgatcttgcaaattagttaatgcagcaaagttgtttcgtacagttcgcagactggccaagacctacaacaagaaaggattcttgaaacttcttgagctaaggccattttaaatacacttgaaaatggtttgttaagagaaaacttgatattgcttgcaacttagtttcatataccactaaagaatctcccaacacttagtgcagtttgtaggtatccacacgaaatccagagaggccagactgcagaaattttccagaaatccctccacattgtctatgcacatggtgacagtagcagcagtttccacagtatttctgggttccttagtcaccaagacaatattccaggcaatacacagataacatgattgcatttttgcacatttcaaatagtataatataaaatgctaataaagctcactttagggataaaaaattccctactcccaaatctcttcaaaaattgatgaagaatctcataataataagttggcaagtgaagtgaattttaaactgtttttctacctttgccacatggctactctagctagtaagcagacattgttttcttttgttaaggttatctgaattgtgcattgtaagaagctctcagggatgcgtttcttatgtaaaatgctacgccctgtacatgcacaatgcttggcacacagaagatactcaataaaaatttgttgactaaatgaatacatagacacaacatgcccacacacataacaaggcaggaccaataggtgtcactatctctaacagtcgctttttctaattccagttggaactagaaagtagccaacggactggaagtgagcctaggagaaggttcctagagccttatctccttcttccctcctctctttctcctgaaatgggcaagtttccccagggtcaaacccatattagatgggattataggtgatttgggtgacagctagagtgctaagtttatgtaaaacacagattccaaatgtctgagtaggtattacctaacaacccagactgtctggctctgttatgtagtaaatgtgtgaacttggactagatatgcaacctctttgtacctcagcttcctaacctggaaaactgggatagtgatacctacctcgtagaattgttgtgaggagtatatggaatgacaggtttggtgccaagaacagtgcctggcaaatagaaagcattcagccaatattagcccatgatggcagcgttacctttgacttaatgacttggcatgcacttgggaaatttacttaatgcctagcattggtaattcaagagtctccaaagttttaattgcttcaaagtttccagagttgttttcagaaatgtttcatctggcacagacctagactaaaatcagtctaattttttttctaagacaaaaatgtcccagactctgttttgttgttgctgtttatgaaattgacattcatttgtgtaagtcaatggagagctgtgtacgccttgggacagtgacttagagaattttcccctaaaggagttaatgctgcttcctaagaagccaaccgtgattaactcagtcactggaaaaacctggctcattatctcatataaacaacccacggctctgaaaggtcacgctgcctatgatggagtattcaaatggccgactgctgacatcagaccacgatgtctttcattaggcatgaaatcttgaatgatgcagaagtaaatcggataaatgatccactgtcgttaaatcatgcaggcttaatttatgttttaagaagtgaatatcaaacatactaatggaaactttaagataaaatcattgcaccagctaattgatccccttcctaggcaaaatttttaaccctagaattctgagatttttattccaatacataatagttaagttcattgcagttgacagctgggtaaatagacatagaaatgcaggcaacttattttctatgatcatttgaagggaaacatcagtcatgaaaagaaaaattagttcatcaaagaaaaaatttctgtagaggagtttttgcctctattataataaacttctaatttaataagtaatctaatttaatattattttgtctttgtttttagtttaaaatttatgtatttttgtataatttatatcttcacatgcttcagaatttaaacaaaagagtataaagcaaaaagtctccccttcaatgattaagataaaaatcaaaattattattacttctgaaaagacgcaatagaaacagattaacctggggagggacactcaggggacattaaaatactgataactgttctatttcttaaactgttcattttagtattattctttatattttacataattacaagctatattcccttatatatatgaaatacttcaaaataaaaagtgaaaaaaggaatctgtcttccggtctctccttcagacaatcagctgcctggccactagcaatcaacttttaggttttctatcttaaagttgtttttgtacaaacactgttgcaataaataatcttgtagagaaattatttcctaggcatgccagtattagattatttattgtgtgtgtgtgggtttttttttcttttgcagcaggacaaactattttataaattttatgtttggtgttaactattatcttctacagtatgacatgtatgctattggcagaagtgtaaataacatttctagacaaatcttataagggggtgttgtcttgggcctcgctgactgactcttggtgtcgtcatcactgttatcactgtgttagtcttttaagctttcactttgcattgcagggcacaaagagggagcatctgttactgcaggctgtggggagaactataaacagttttactgaagcccctaagttaaagttccattgttctttgcttttgttcagggcagccctcacttcccctgaattcgactctttaagaactgtagtcaaagctttaaggctccttttacagttgtccttactccttaatgcttgctaaccaaaaagatccctgacgtttcttccacagagctcaatggttagaaaattaaggtcatttctttctcttctgccccaccaagcagaagtatagccagtcaatgtcaaaattacattgggaatgatgagaaatatatattccttaggaaggaaatactggtagttttacagaaaaattttagacaaagatggttcatgtattagcccatggggaaggattcaatgttatttacgtacactactctcggatcttcttaggtgcttctaaacatttattaaacaataagaatcactgaaaatagcaggaaaatacggttatcatttaacacttaaacagctgaacatcatagcctaaaaaaaaagaggaaaataaatggtttcgaggattgtttttcataaccatatacacttgttaccactagatggcggtaaaacacagaccatgaggttgaggtgccactggcggcggaggaagcggcgacccgcactgggagagattcattacttcggttttacctccggaaaaagctggagtcaagttatgcttatttacaaaatagaaaggtcatttttatgaaaagaaaacctctttccaggttatgttttgtttaaaccctatgaaattgctggtttgtacaccagaaaaggttgatagacaattttatatggttcgctcttaaaaagaacttagatgtccagaagatagtagttgtaatttaaattaattaaggctaaagaaaagctaaaaatttagcaccgactgaaacgaggtgactatcttctttcatagcctggcagggagggcctagcacagtctgcaagcttgaggatggtgatgaggccacaagatcgttgctgctgggtgaagtggctgagggacaggcaggaatatgagaatattggttatattttattaccaactaaatggtaatattctatagtattaataactactgcatttttatcctagaagtatcccaggtgctgtattttggttagagtaaaggtaaagagatgtagttgttcctaccccgtttttttttttgttttttttgtttttttttttttgagacggagttttgctcttgttgcccaggatggagtgcaatggcgcgatctcggctcactgcaacctctgcctcctgggttcaagttattctcccgcctctgtattttcaaatcagggatatctccttagtctgaatgaagtgagggtttctccagggatccagcataatgcttgggttttcctgttttctctttctttcatcagagtctacttcatttaacattacacacttccacatgaaaattctagtcaacttagagttttactacagggtagttgtgtcacaaatcctgggatcactgagcccggaggcagctgacagcagagaagagtttcctacagtttatcagcattgtgcctccttagtgctccttggcccccaagaactctggccaagaaaaaaaggtcagttgccgcgtgcactccagtgggattcctctctagccttcgtgctaaggaaacacccacaccaaaagatttcaacacaaacacaagagaatactttaacaattgaaataagaaaaatatttaaagctgtcactttttctgaggaccaaagggattctgagcttacaggggaaagcataagaaatcagaggtggaaaagagtttaggttaaacaccagcaagaatttctagccctgacagtgttttagacaatgggataaactatggagagatactataggatcctttctgaaaattactatccaagatgtttcaggctttagcctggccaaaaaagtgcaatctatctttgcacggcttcctaaattctcctctaatttaggattttgctcttttcacgtcaaaggaaaccatgatttggaaaccatgattcgtgttttggagatggactcaggcataaagaaatgagttctcaagaagaggcagaagatgagatggatttgggaggggatctttgaacaccttagacaggggaaggccatttttaggagccatgggacagaaaatatgcacagaaaaataaatctgaagggatataaaataaaatgtcagtagcagttattttggggtttggaattttagaaaattttccttttctttttcttattatttttctaaacttttatgcaaaaagtttttgttttgttttgtctttttgagaagcatagctttttcactggaatttagtgtgaaattccaattttcaaagcatgctgagaaaagagggtaattctttggcctacttggctaaatatttttctgagtgacttttctaaaatccattgttttctgtcctttggtgaaagcaattatggtatatcaggacaaattagattggtatcacttcaagtgacataagtatcttatatttttagttttaaatagttaatgctaaaatagcacttaccattaagtggtaagtgctttactttgtattaaagaaaatttgagaagttagtgattgggtcagcaaaacatgccaatcatgtccaacagggtttaagagaaggccactcaaacatactcactgggacttctctcttaacccctccccacagatgctctatgaagagtggtgaaactcttcagggcttaacagttttttgttttgttttgtttttaattctagtggggctttccaggtcttatactccagtaaaaggccatttgtgaaaaccatgatgaagccccttaaaaaaaatcggcagcctctcaagtaatgaccactctctacaaggtgttatgagtcacttagctaatcataagcaaagacttaatatactatgggattatttttaggcatcagatatgcctataaattatacagctgatttatattccaagttctaatttcaagtatattaagtacacatcttttttatttaaatagcttactaacatggactaaattacatatatgtgtgtatttcccaatatcttgaaattccattagttttttttccttggagattataggtacactacagaaaatatctaatcaggtaaaagactagatttccttggaatttaagagcactgatggcagggttcaagtccaatttactaatctatttgttgcagcttaataaatattacttgatgtaaaagaccatatatcatacacagaccttttttcatttgttattaaatatttatatatattttttcttataataatacctagatcatttggttagaaacaagaatagctacttgaatgaactcaaattggaatgattggttctatgtttgatgatgttacttacattgttatgccatattttgtctgttcacctctctctgaggtcttagatatagaattataagttttctttctttcctttttttttcttgacagagtcttgctctgtcacccaggctggagtgcagtggcatgatcttggctcactgcaacctccacctcccgggttcaagcaattatcctgcctcagcctcccaagtagctgggattacaggcacccgtcaccatgcctggctaatttttttgtatttttagtagagacagggtttcatcaagttggccaggctggtctcgaactcctgacctcaggtgatccacccacctcagcttcccaaagtgctgggattacaggtacgagccaccgcacccggccataagttttcaatagtaatcaattaaaaaccctcagctttataagattttgctatcacatcatattattaaatcatacaagtgtaaattttttggacacagaaatacaggtactagaaagaattcataatctccagcaaaaccttcagcaaacaagatattaaccatctgaaaaggatggtgattgtattttatttttaattgcctgcattaatttaaaaagttactattatacattatgttacttatgaattgattatattataggtctaagttacagtaataaaagtttggaaagttttaaaaagtagaactatacataatcctactatctaaaccctattatccatttaaaaaataatacttatgacattttagaaatgaaagaacattttcagctctatacatttaaaccaatcacaaagtttttataatattatattttcaagcaattgtgcctagcattttataagcgtggtattatttcagtgtcttagcaatcttatgaggtgggtactcttggaactgttatttaacagaggaagagaccaggcttggaaaagttcagtgactcgctcaagtccattgagttggcaagaggcggtgaaagggttttaactagatctgactgtctttcatccagctcagtcccctaactctaccagttgaaaaaaaagaggacccagaaaatttaagtgagttgtccaaggtgcaagagcaccttgatgtatgatataggcctgattataatttttacaacctctcaggattacttgcattttaatatttaacatttcttactcatcagtgttggttttaaacctgcttcatgccccaggttaaatcagttttatctcattccgcccttagttgtctataccagagactctcaacttctcctgcacactagaaaaatactaaggcctttaacaaatacagatgcttgtaacagatctccaaatttttggatttaattgaccagggctgcagcctgggcactgggataagaggtctctaggttaatctaacgtgcaggtagggttgagaagtattggtctatacatagaacatctggtcatcaactctttcatatttatattcccaaacattttagatcatgttatcacctgcttgcacatatgtcatgtggttaaagtattttcatgatttgtatgcctagaaggaagaagtaaacatcaacacatcactcagctaaatctctgcacaaatggcatatgtaaaaaagagataaataaggtattgggttgaattggaatattgaatttcaagcactgatcatgtacctaattatactaaacataacttaagccatgatatagccttctgcttctagtgcttatgtcagtatgagcccaattaagtatatcccttagctaatttattatttgaagcaaagacactctttggtactatgggtttataggaaacagattaatatagccaaagtcactttctctagcattgcttttgaattgcttgaatgaaccaagaatttgtatttgtacttgtgcttgatttaaaattaaattaaattaataacccgaactaattccccaaattaaatttttacatctgtgagaaacctgcccattcaccaagctgtgcttacctgagcaaatggagtcacaatcaagtcatctccgtgtctgaaaaataaaccaaatcccgcattagaaatcatcaataactctgtgctcagtgtcgttcaatattaaacggcaagttccactttcatgagttcccatagagaattacagtgattccatccttatacttcagcacatgttcttcccagcaactgggttaaaaatatgtcttctgggatgttaacaattgtccaactccctgggtaaaaagaggggcttcttgatcatcagccagggtcactgttgctttttaggcacacaggatatgcaatagtagaaatggtgttccagcagtggggcctgagttttacttttggcctcttactgtagatattagtaaggggtgctgtggaaggaaccagcaatgcagtgacttcagtgagagaacccttgaccatctaatatttgaaggtgattagcatggagtgttccacatcatcccgtgtaagtcttggacaggctaggaactgtagatgacatgggactgcatcatacactaataaaaacccagtgaaatgttcaactgactcatcccagccactgtagtcactgggaaatgttactccttgtgtgctgttgctgcagcaaccccagctacaccgtgcctggggtatgggagcaaggtgtcagcatgacgtgtcttggagggacagggaagggcaaggaaagttgtgcaacattccagttagaggaaagtgagaaactggggcccagggttcttttgtggtatttcttagcatgaataatttgagacaaggatttccagagtcaccatcagctatttcttgatctagctagataaaattcttaaatcaaaagtgaatgctgttattcaacacagacagctccctggacatggccctgagaacagtgcaaataaacttttcgctcactcatgaacaatctgaaaacaacctgagtgacccaaaacaacacccatgaaacatgctggggcacagggagcatatggatgatgttactcaataaattgttaccaatagctagaataggtgctgtggtcgtcatcaaaccatgtggagatcttgaaaataaaaatgtgggaaataaaagcagaagaaggaaaaaacaatgtaaaggaagcatgtgttattttacacccccttagttccagaatcatgtttttcaaggggcacctgctctttgtagagattattcatagaactctagaactctaagaaggtaggacattgggttttatgatcattttatagaagaggcaactgaggttcagagagggcataaggtctaaaaactaataagtggtagaggcaggatgtcaattgaaaaaggtattttcccatgttgatgtttaattgccattgcaacagtattaagaggtgggggcctgtgagaagtaattaggtcaggagggcttcacactcatgaatgaattaatgctgttatggtgggagggggttagttatcataagagtgggttgttataaagtgagcccagcccctcatgttttctcttttgcatgtgctcacttgcccttccatttttccattgtttgggatgatgcatcccaaatatcctaatcagatgctgatgccatgtccttgaactacccagcctctagaactgtaagatataaacttcttttctatataaattaccctgtctatgctattctgttatagcaacagaaactggactaagatagtgttcttctgtcatcaataaataatttacataatttaccttgactctcaaaaaaaaaaggtcttctgaggtcaagcccagaaaggctctttcctagaacaatggcccagggtaggagcaggcctggtgcactgaagtggcaaggaggccattgagcccgtgggagccagcagagagggatgaagccaaggaggcagagcagctgcctagatgagaaagaagcagatacagagctgcaacgagaagctcggtgattctagagaatgccatggaaggcaggaaattcagaatcatgggtggtaacgagccaggcagcagatcacagagcccttgtatgaaatgtacaagaacttggattttactctctgatggaagtttgggttggaatttcagctctgccacatactaggtgtgtgaaattgtgcaagttattaaacttcactttcccttggcctcttcatctgtaaaatggagataacagcacatacatagagtgatgttttgggattcaataaattaataatgttaagtgctgaaaaatgtgcttaccacacagtaaatgttcaataaacatttctataataataattagcagcagtagtaaaaccttttaaatcataatgatttttgctttcctatgcagtcaggaaattgcaaagactcagaaaactgatacttcgctaagaaggactcttgagaccctgtgacaggtctataaaagattgagggctttaaaggggcaaaaatggaagcagggagaccagtgtagagaaaagaagagatgaggacctaaactaaatcagtggtagttgagagagagagagagagggacgatgacagcattaaaagctctgggggaaagaaaaagttctggggaaaaaaagatatgaaaatttcaagcatttacaaaagtaaaaagaatgttatcacagcaagtgtattttatatacaatcatcagctgttacaacaatgttgcaaggtaggtgacattactcccatttttcagatgagaaaattgtagctcaaattgattaagagatttaacacaaagacacgcaggtagtaagctgcacagccatacctggaatggtccccttttgtgatatgcattggctgattcctatggaacagcttaaaaagattaaaaataaagctctaggaaaatggcccaataaatgcaaattacaaagtgatgccagggttggccagctacatttcttccttggcccatcattctgactttcccttctggctgtgtcatataggtaaatatagggctgcaatttctcttatgtacttattttgaaacagtagcctaactctcacaaaacaactgagaaatatttacagatacaccagtgtttaaaaagcatgaagacaaaatccagagctaaacacttcagcatttgacaaatttctacacacataaaggcacctttagagttcatttgaagccaaacattcttgggagtggtggacaaatcagtaaactgtgtagtgtgttagaagtccgaagacaaaaaacattttcaataggtgtatatactacatatattgcattcaagatagttcaatggtttctgacattaaaaaatgttattaaaaattccataatgggaggtatattacacaaggagaaaagacatgccacctatgccgacttgatttgccagtctgataaactattcatctgcttcagtgcatggccaagctgaagacattgtattgtaaaatggatgagaggcagttcagataaccaaaattaaaataatatgacatcttcttattgtcccaagctatagtctcttctttcattttattctttataattgacctactataaagtttatttttttcaggactaagtcatcttgacaaggcacatcatcaatctgaaatgaatccatggaaatatgtctcctaattttttatatagattgcagtggatttgaatctttcaaaactcaaaagggttgcatatttattaaaacatttaattttctctttggttgtatctcctttataagtattataagtaatacactttacaatatttatgataatttaccagccttttttccctatgaaagcataaagacagttatcattttagtgaaggaaatatattactttttaataaattgcccagaaattgtttctgccaaatatctcaagatggtctcattttagtaacagtaaaatgatacctagcatttcagtggcagatgtcctcgataaacggcaggttatagcctatccatttattttcaaaagtatgtcatgcttaaattatctttgaatatatacctaacatataattttaaaatctttgtctaagtcctcaactcaatattaaaacagatcttttcagacatactgtcactaggagaataaggcaagtaaaacctatttttatttgtggttagaagaaaataaatataatacaaacatatctttgaattgtgtcttacactttgcttataatcatttaaaaacagatctggtagttaagatcaacagaagattcactttgtgaatatgatttggtttaaagtatgtgtgggttttaatgaactgaataatcacatatgctcaaaaaaatcctatgaaataaaataattctgaaatcttgcacctgaacaactttacccacagaagctttttaaagcgccttgccacgtaaagtggggctgggagggattacaatacaatgtaataaattggggcttcctaggcctacttggctaaatatttttctgagtctcttctgagatgggaagagactattagggtctctataaagtgactgaaaagctagattcaaagtcacacagtgaatatcgcctggacattttgaaattgtaccgcctggtaatgtgaattttgggtgaggatgatgcaatactgtctttcatttaaataaaaacaattataacaacaacaacccttaacaaaaaacagctgtgatctgttttaaggaaaatacagctcttttaaaaaaaagaactggagtgttcatggaggacaggcggagaatgaatgagggataggaaggctcagaaaaaaagtcattttgacactgcgtgtctatatgtatgtatgtatgcacacatgtatacatgtatgtatgtatgcacatatgtatgtatgtgagagatgagattggtaccaaggtaacagtcacagcagaatgcaagtgcagaaacttctagaacagccaggatgagccactgtaggtcactgtgggagtcagtgtcacattggttttaaatttcatgatgtccaaggaggtgccacatgctctgtcaccttccctggttaccaggaagtgaaccagagtcatcttcactagtcctggcgagccttgtctctcccaaagagaaagacttgctgagtcctgagccagcgctgttgaaagcaggagaatacagggctcaacagtatactattgtctttttttttctcacaagagaaatgacagtagagtcaggaacttctattctctattccccctcccatccttcttctacttctgtattatttatcacgttattttctaccctttttctttctgtaataaggaaacagaaacaagcaagaaactaaaagcaagaaatccaaatgcccacactcttatggtgactttgttgagatccatatatggttcaagtacttaaaaatgaaaaagcctgttgtcatcttaaaaaaataagttcaaccaacatcagcacctgaaaatataatttcctatagaagttcatttcatgattggttgaaatcttaaacacactaggtggcaatctttatctgttttactattacgaaatcataaggaaaaggagatacagttaattagaagaaagtttttactttatggagcaaagacccctaatcctactatatttaaagcattagtggccatgtaagacccactgcttttgaatatcacacattgcaaattttagcatgacaaatgaatgcatgaactagcactgtgaaggagtcacaggctggggcttacgtttgaatctaatcctttttttttttttttcaatggcatggaggtttgctatgttgcccagactggccttgaactcctgggctgaagtgatcttcctgtctcagtctatggggtgcctaggattacaggtgtgcaccaccgcgctggccgaatggaatcttgtgcaaacttttttcatcttctgtgcttcactcactcttactagaaagatattctcctctgaagtttgtcaataggattaggaaattgataaacatatagaaaattaaaataatatttttgaaatatattttaaagtccaagattttgataattttgaaatcttagtatctttctttcctcagcctaaaaactatcatccatctatcaattcacccttgacaacttcttttagaattatagagaaacaagtatgttctaattttaaaatgaatataaaaatatttctgggagcctagactatttgacaacacccaaggattagctataggaggaccacgtctactcacaactctctagacccatcttcatagaagtatggacatataaaacaaacatataatgtaacctacttgatctttatgtgtgtgtatgtgtatatgtatatatacatacatgtacatatatacatacatctatatacacatgtacatatatacatatatgcatgtatatatacacacaggcacatatatacatatatacatacatgtatacatacaggcacatacatacatatatacacatgcatacatgcatgcaacatacatacatgcacatatacatacatgcacacacacgtatgtacacacatgcatgtacacacacgtatgcacacatacatgtatgtagacatacatgtatgcacacacatacatgcatgtagacatacatgtatgtacacgtatatgtatatataagtatacacgtgtatgtatatatgtatacatacacgtgtatgtatagatacacgtgtatgtatacatacatatgtgtatgtacagctacacgtatacatacatatgtgtatgtacagctacaagtatacatacatatgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagatacacgtatacatacacgtgtatgtacagatacacgtatacatacatatgtgtatgtatagatacacgtatacatacatatgtgtatgtatagatacacgtatacatacatatgtgtatgtatatatatacatacacacatatgaagtacatgcatacatatacatactttgggagatatagaacaacttaaagaaccattcaaagataactattgataacattttcccactgcatgtatgtgagcacatgtatgcaatatagtatgtgactattatggactacatacttccttatagaattagagtcatagtgtatattcaactgtatatcttgcttttagcattaaacattaatgaaccataaaaattatacatgcctttattcttttaaaatattgttaatgattccaatctatattcggtaatctctaaaatttttcaagttatgtgaatccaaatgtattaaaatgtaagcattgattctatttttaaataaattaaaaaataatcatatgggtttttcagacgaatttcagttcatttatcattcattcatttttaaaaagctacttattaaaggaaacatgcttattttaattaaatatacataagacaaaggtaaatattaaaatgctacatgagaaactgggctgcacaggtaattcatgggaatgttaagtattttatattgctacctgcttaaattaaaatcatgaaactctaatttcagacaacaaaaattctgtaaaatgtgactaccaagaaaattttgcaaaaccaaattattttttccatatagcgtttaaaagagatgatttgtttttccaaaaataatgttcactctgacaaattataaatttaagaatataatgaatgatttaaaattacttataaaggaggcattagatttttttataaactctaagtaatctatatagtaaataaaacaataccaaaaatacataaaaactgtttccttggtattagacatacttgaggatatggatcctctgtattgcttggccttttaatttgaaactagctccatttaagtcaaaataaattaagcagtacatctatttatgaaaccctagggaataaagttcctaatataataaagccaacttcagttacaagtgaatgtgcttttcctctttgaagctattgccacttagaattaaaataatctatttaacacaaaaacttgtattaaaaatcacaactaccaaaactttcaatttggcaagaatgtccagcaaccttttactgagaatcaaagaaaatgtaaattaatatatgagtaacattaaagctgtctagtattgtgtgaggtaacatcttccaaattgaaacttttcaacgccaaactcaggccacctgtttgtatatctgtgtatgcagcttttctggtgttttgatcatttttttttttttttttttttctgagatggagtctcactctgtcgcccaggctggaatgcagtggctgcaatctcggctcactgcaagctccgcctcccgggttcacgccattctcctgcctcagcctctggagtagctgggactacaggcgcctgccaccatgcccagctaatttttttgtatttttagtagagacaggatttcaccgtgttagccaggatggtctcgatctcctgacgtcgtgatccacctgcctcggcctcccaaagtgctgggattacaggcatgatccacagcgcctcgcccgttttgatcattttaaatattttgaaaaaattttaaagagatgtggggtctcactctgttgcccaggctagagtgcagtggcacaattcacagctgactgcagcctcaagctcctggactcaagtgatcctctcacttcagcctcccaagcagttggaattacaagtgcaaaccactatttttatttcttaaagcaggttagaattttttttttttgagatggggttctcatcttgaattttaactccgacaacttccacatgtcctgagaggagcctggtgggagatgactgaattagggggtctggtctttcctgcgttgttctcatagtagtgaatgagtcttatgagatctaattttttaaaaagaggaggtcccctgctcaagctctctctctttgcctgttgccatccacataagatgtgaattgctcctcctcgccttccaccatgattgtgaggcctccccagccacgtggaactctgagtccagttaaacctcttccttttgtaaattgcccagtctcagatatgtctttatcagcagcatgagaacagactagtacagtgaccttcaaagatatttagttttctgaaatttaaactgtttgctcacatcttattaatattttaagaattaagaaacaactcaatggcaaaaaaacaaataacctgattttaaaatgggcaaaaaacctgaataggtctttctcaaaacaatggcctgacacagtggcttacacctgtaatcccagcaccttaggaggctgaggtagcaggatagcttaagcccaggagtttgaaaccagcttgggcaacatcgtgagacaccttctctacaaaaaaattaaaatcaaaacaagacctacaaaaaaaggtcaacaggtatatgtaaaagtgctcaacatcactaatcttaagtgaaatgcaaattaaaaccatgatgagatatcacctgacacctataatagtttttttttaatcaaaaaaaggtaacaaatgttggtgaagacatggagaaaaggaagcctttttacactgttggtgggaatgtaaactagtacagtcactatggaaaacagtatgaagggtcttcaaaaaattaaggataaaactaccatatgatccagcaattctacttctgggtatatatccaaagaaaatgaaatcagtatgtcaaagagatacctgcactcccatgtttggtgcagcattaatcacaatagccaaaatatggaatcaacttaagtgtctaacaacagatgaataaagaaaatgttatatacacacacacacacacacactagaatcctactcaggcttaaaaaggggatatccttccatttatgacaatatggatgttcctagaatacattatgcttagtgaaataagccaggcaagaaagataaataccatgtgatctcacacatatgtggaatctaaaaacaaaatcaaacttatagaagcagagagtagaacagttgttcccagggactggagcagggcctgggggagaatgggaggatgtggaatgggagatgttggtgaaagggtacaaagtttcagttagaaggagaaacaatttcaagagatctactgtacaggctggtgactataattaataatcatgcatagtatacctgaaaattgctgagagtagattttaaatgtactcatcacaaaaaatgataaattgttaggtgatggacctgttaattgcttgatttaatcattccacaatgtatacatatatcaaaatattaccttgtatataataaatgcatataatttgttatttgttgatgaaaaataaatttaaaacaagaattagagcccggccccatctttgaccaaaaaaaaaaaaaaaatctttcaaccaaaaatccttaatttttggctcatgtgtgctcatatcacttgtggaggacaggcactgatgataaagcagatgggactgaagtttacgcaacataagcaaaaaataatctagtctaaaatggaatctctttatttgtcatgagaaaacaatttaggactcattagagaaaatacatgatgccaatgaatgccttcaaatttgttagttatatgatggcacaaagactatctctgttagaaatgatacaccaaaattttccaagttaaataattaaacaaatgtttagcacatgtgtgtagacatattcactaagcatattaggttattttgtttaataaaaaccaatacaatagagagacttttctaggacggctgatgtcccaaattatcaccagaaggtttgagtacaaagctgagagtctgacttccatggagggaagaaagacagcgaaagagttgagtacatgggcagggattcacaagtgctctcactttgtgttctaggaacgggatcttctttcacagtttatcttattggcaggcttgttcttaatgccagtggccctgcccttttggtttttcaccagaatgggatcctagggaaaagatttttggtcaactagtgcaacaattttaaaggtctgcatgtggtgaaaagattcaatagattaaaaggaagcccttgatcaaacagagaggagagcaatgtgttttatgaatgcctactaggcaccagacacggtgttctaccaacatgctgaatttaatcctgacaactctgcattaaatggatgctcatattcccattctaacataaggaactaggccctgacaacttaagttactcattggcagtcatgcccttgacaagctgacagaactcagtggtttccaaatgccactctaagatctggtacttgcccaacagaatgctcagtggtccttgtcaaagtcagagtgtacatggaccatgcagtgagattttttttttaaactatacgtattcctttggaaaattcttttattctgagattatgctctttctttttcactgaagtgaaaatgtctttaaaaaataaaattaacatatatattgatgggtaattccttgttaatgttctttacctggcaaaataaggagttagtaaccctaggtcagtgtcccagaaattttactgggtcataaaatcccaaggcatggaaatgttcagtgtagctggatttgagcccaggccttcaaatactgttttgtttttaccatgccgctttctgtatgctcaaatggatttagactattctgaaggcacatagaagtaaatgttttagactctagaacagcactgtccaatagaatatttctgcaacattctatttctgcaacagaatattctgcaagactctcggtgctgtctaatatgctatccactagctaaacacacacacacacacacacacacacacacacacacacacacacaccaatccacaaaaacaaaactgatcttggtggttataacaaattcaatttgaagttctgtaagcaccaaagaaaaaatgaattttgaaacatggaaatatgagatctgcatgtagctttgttctcccttgggagtgaaacaatgagttaaaaaattttggacttgggatcattcatgacatttattgggagacaacatcatttactgaactggtgaaatgatttcttgtcacatcacaaccttccacatttgttgaggggtgagcagttattctttttctttctgctctgaagttccctgcgtcttaaagagagggttgcaggaattgacacattatatatgtttagatacaactttccagtattcaatgtcagcaaatttttcttgacccaaggttaggaaaaaccataaagtctcaaggcaattaaccgtaggtggacacaaagcctaggagatgctgcagtaggcagacggaataattggggttgtttcctctgtgaacctggtgtgaatcataccacagattaccaggaatctgaaagcaaagcccagtggttgatattccttacttggttttctaaagaaaaaccatgggtctgcttgatgctttctttctgtttatttatagaagcacatctttagatgattcatattgcaagggcttagacagtatgatttagtaatactccctggaatatcttatctcaagaaacacatcacataaatgttccagcagtgtgactgtttttccttatatggctcagaaaacagtaaaggagacattgagaacaattcattaagaagctaagactgacaagcaaaagtaaatatttaaaatgattgatgtgtaagtgaaaacaagtattcatatgggaatctcagtgttggctggaaacatctccttttgtatcaagaatttttaaaaattaaataaagacaagaatgcatgctccaaacaatttttttgtcttactttcatggatctatggtgtcttcaaatgataccctggcatggagtaggtgctactgttattttccaaacgagtaaaacagtgatactcattcaaaaatgcacatcaattaatacacacctttatttagaatgtggtggaaaacacgtattggtcatctccaatagaagtcaactttcttcttcttcccagcctgccaccatatgccccaccgtcaagacttaaagttcaggctgtgcatagtggctcttgcctgtaatttcagcactttgggaagccaaagcaggagtattgcttgagctcaggaattcgagaccaacctgggcaacatagcaagacctcatttctgctaaaaattaaaaaaaattagccgggtgtggtagcatacccctgtgtttgggctactagggagactgaggtgggagaatcacttgagcccaagagctcaaggctgcagtgagctgtgattacactgctgcactccagcctgggcaataatagagtgagactctgtctcaaaagaaaagaaaaaaaaattaaagttcaaaatatttctattttacaatacactggagcatggttttgattttagtcttctttaatatacagagggaagagggttgagataaagtgagagtacactagtgtacctctaggtacaatatccacaactgggtgaaccaatatctctcctgtaatggccatttgcctcttggaatttcaagaggcaggaagaatcagtaattttcaactatgggtccttcatctaggggccgtgtttcattgagagcactatccaggttactggactagtttttttctttcaaaatgttcttcaaactttccttattttagtttatttcacacataatgtgctcttagagattgcattcttttggtatgcactgaaaaataggctaatcttccttgactgaggccaattctgagtttactttcttctggcaggaattcagtgtctcataggattgtggaataattgctcttgttattaaactaccacttctccctgcatttttttttaaagaaagtagatattatcctttgaaatgtattaaatctgatgtataagcataattatataatcattatttataagtttaaataattcaccttcacactctttctcttttatacaggagtgagaaaaactcacatgatttttagagttttttttttcacatttaaaagatttaaaagtgagttcagtctgtaatcccagcactttgggaggccaaggtgggaggatcacttgaggtcaggagttcgagcccagcctggtcaacatggtgaaaccccatctctactaaaagtaaaaaaaaaaacacaatcagccaggcacggtggcaggtacctgtaatcccagctactcaggaggctgaggcaggagaatcgcttgaacctgggaggcggaggatgcagtgagctgagattgtgccactgcactccaacctgcgcaacagagtgagactctatctcaaaacaaacaaacaaaagaagtgagtgcaaatactgaggaacatagtgagtataaaggaaatctagaaaataaaatggtatgctaaatattagcacaaagtcctagagttcgaattgcagcaggcttgtcatagaaacaatgaattacgtatatgtttggtcagttttcacttctttttccctctgctttaacaactttttataactaacatttatccctctatctctcctaagacttcagtatatatctattactttggcagtaatagccaagatatattactacatataactcaattaattcgttattttaaaggttagagcactggcaatgatacttagaggtgctggcaccatctcactgtagcagtgcattaaaatcaatgctttatttttatactgtggcattaaaaacattaccatttaaaatgtctaaacatcaggatttcatttttatgatttttttgaaagtatgagattaggaatataaaatgcctattcagctaatattttaaatcccccagttcaaggattgaagaaacttgtttagctaatttataagacttattttacaattcatgaaactcccatttttttaaatcagaaataaaatgacttaagtgattgaataaatggcaccaaataaagcagaatttttaaacaaaaagatagtaaaaaggtattctagtagcagatgaccttagcatattttgccaataaacttcttgagatttaatagctagtattaatgcctgcatcaacactccgaataatactagtaacagtggccagcacacagcaatggaagaaaaagcctggtctatctaggtcattaccaaaataatatcacattttataaaaaaagattttggctacctgggatcctaacagaattaagaaaaagataaattctctactctagagcacatcagatacttcacagcttggaaactgttatttttttaactcctaacaaaattctctcaaatagtctcacatagagatctgatttatctttaatcatttttttttgtcttgaggcagggtctcactctgtcatccaggctggagtgcagtggctcaatcgtggctcactacaacctcaacatcctgggttcaagtgatcctcctgcttcagcctcccaagtagctgagactacaggcgcccaccaccatgcccagcaaatttttgtattttttgtagagacagggtttcaccatgttgcccaagttggtctcaaactcctcagctcaagccatctgcctgccttggcctcccaaattgccaggattacagatgtgagccaccatgcctagcctgatttagctctaattcttcagatatgaataaacaactaatccaaatattttcagactttctcagtacatggtgcccttaatatctcaattttttaataacagcaacacattggccaaaataaataatagttccaattattaaatagttaagtccaaataacttaataaggttttgttctaacaatttagcacccactgagcactatgtcaatttctcattttggaatgagattggacattgcctcccttattttttgttgcacattgatttctgctcagcacttcatttttatccagcaactgctgaaaacccaattttgcaaagatatggtgtcacagaaaggaatatcatggtcttaattggaaactgggaactattccaagctattagttttccaggtggttgacagatgttttcgtgtttttcttgaacatttaaaataacgcttgcacccatgtacattccctctgttgcctcaggacacattttgagaactctggccctagtcccatcactcctacaccacagggtgaggggtgaggatacctccccagctgggaaaaacccagaactggggaagagatgatttggccatggtagctttctttctgtggttaatggaagaaagctttcaagataacaaattgatatgcttttgaaatgttcattagtgtaatattatcttgcaatctaggtaagagatgactacaaacttttcatgtagatccagtgagaattagaacctttgtaatgcaacgtgtctttttatttatattcttcctagtgagaccagggaagattaataatctggaataaaagatacaaattgacataaagggaattcttcttcctttttcaaactcaggactggaagcaatactactcttatacttagcaggcaaaagtagtagagaggagtggctgtgactgaaaacacacattagaggcccaagaagtggtgagggacttgttaattgctaaagaaaggacagtagtttgacatgggaggtagggagagtattatctactagctgagaaaatgccccaatggggcaccccgaaggcctgatcagtgaggtctgagatatctgtatagtgcctggggataacttagctagattcccaaatatgccccagctttttatggtatatcaaatctactcacttcctcgtcactggccctctgaatgcattcaccccaccccatattctgtgtgtagaagcaatgtatatgaatgtgagtgaagagccgattggatcatctttgcattctatgtgttggtgttaatttaacagaggatggggaatagaggattagttatccaggtgaattgagtatttcttaaaacttaagtagtttgacaggtaacttatacttaataaattcatagttttgtgacttaattctacttatcttgtcattgctaattctcctcttaatctttgcaatgtatcataactttatgtgtttccaaatacagatactatattactggatgatgtgaaaacacagaagtgattgttattcagatgctgaaatattaagatgacaaaaatattgtctatttacgctgtaattttcttcatgttacttcatgacaccacttgggcaaccagccttttgttatctagttgtttctactgttataaaaaatttttactattaatggtaatgcaagtttattttcatgtatttatttactagactcatgctaatacttaacatttttctttttcttacttttcttaagaattaagttgctactgcatcatctatatttaacaaattgtgtgacggtctctgagcagaagtggtcaggaacttctcttctgccttatatgagctaattttttagattctgaatttagcctagtgctatatacttgtatacattctctaagagttggctgcatatttactttgtacctccttgagcttttattttattcttaatcaaattttgatactgctatgtatttcattggtttaatgaatttggtcaacaattacttctgtttctcagcagtttttgctgtagtagtataaagtactttgtttacaatggcattatcaaattatgtgctcctagaaataatcaaaatgcttgcttttttttcaaaagattaagctcattggactttggctttctaacctgtaaaatggcataacaatgtccctatcaaaaggactgtgagtatatcaaataagatagctggtgtgaaaatacttgggaaagttgatgatatacacacaccatgtatgttatgattattattactaccatctttatctgttttgttcttcagctatttcattggtttctatttatagaggataagatgacgatatcctatctactaggaagggattatcttccttcttctcactttcccaatagagtaaatagttatatttaaacttaaagagtatttaaaggttttccaaaacagttcaattaaatagataaccacaaaccttcattttaaatacccttcattaggtacctatcctcattaggtactgtttgtatttgaaatttctaagaaaatttctcaataggaaagcttaactagaactattaataagaaatcatcaagtaattaaatatataacatcattctctataaagcgcagttgaattatacacatcagacagtcttcatagcattattgtgaactaggtaaggtgagaaaattaaagtttacacatggccatatgagaattcaaattaagagaaggcacagtcctttatggtggaagatatgtgtcgtgtcagattaaatgttgaaatagttattatttattctatttccttttccttccacagaaacttaatctccttggtagaaagaatgctttctaggagttggtatcaaaggaatatcttactgctccaatgtaaatatccaaggagaatggaaagctaaacatatcaacacattacttttcagcaaaatatagtgttgactcatggtctgattaaactcatcattcctacctgagtctgatcagataaagaactcttgaggcacacagcaaaatgaggtatccttgcaagtttgattttgaaataaaagcatttcatatttaaatatgaaatgctataagcttttcataaaatatatgtatatatttaatatttactaactggagtagaatgtatgaaagaaacaatctatcccaaactcagtttactacaatttaaaaaggtagaacacataactacataaatggactccactaactcactgtgagttttcctctttcttttgtcaataccaagcctgactcacctttgatgaagttgcattagatgactttcaattctgtcattcgcctatttaacattgtttattgttatctatggggctggtcagtattctactcacctttaccctgttcccttttttgatctgcatagtggcttttttaagcctttccctttcttctcaagctgccccatccctctctcctctggctattgatggctgtaccttctacttttacattcattcatctggagatggaggagtaaaatgtttagagaactcatggctaatatctcttaacattttactcctccatctctaaatttacatttcccttcttttactcttcttctccttctccttcttctcttctctcttattcttctccttctcctccttcttctttttttctttttttccagacacagtcttgtcttcctctgtcacccaggctggactgcagtggcatgatcgtagctcactgcaaccctgaactcccaggctcaaccaatcctcctacctctccagagtagctgggactaaaggcatgtgccaccatgcccagctatttttttggatttttagtaaggacaaggtctcactatgttgccaaggcaggtcttctttgtccttcctaaagaatacagttctggtatttactacttttccaaggatagcctccttactttggctcatgatcatgtttttgtcagcaactacagctccatctttaaaccctctttccccttgaatttttagtctctttctatctcctggagccttccctcagctcaagtaacctgaattcaaaaaaattccgcttgaacctaattctctgtcaggcagccttagttctttcttcctactccacccatcagccttttaaagagatgcctgcatttgctcacatttccactttcaattcactccttaacccaggggctcctaatgctattacctgaatacaacgcaccactcaactgtcattcaaaaacctagtaattatagaaggtaactgttctatttctcctggtcctctggactgttatttctgtttgctgtcccagtactttaactgttgtcttgtttcccctagccttatcatgtacaaaccaattcatcacctgttatctgtcatgttttctactctctgccctttgttcctcatcaccatgtacgtacatcaccatgtacgtactcattcatggacaaaaatcagcactctctttgattctccttctccactggctgtcccccaacatacatacatacttcacacacacacacacacacacacacacacacacacacacacacacaaccattctataagcctcttgcatctaaaccagctctttgctccactgccatcactcccttgacttaggtcttcatcatatttagcctgccttacttctgtgaatttcgacatgaaatacttccctgtagtgacttcgctatgcaatcattcaacaatagagtaatcaagatgcaataaaaacaagaatatgatcatgccaaaactcagctaaaaacctctgtggctctcaggtcccatagactgtatttgaaattttcttctctcttgccaggtttcgctattcacatcaagcagattgtcattccttagttcagccataattttccatgcctcacatttagtaaatgttgttcccttagcccggtattttctgtatctttcccttgggtggaaaactctccatctcctctctctgttcctgcagtacatgataaatgcctcaaggattgtgctcaccatattttattacaatggtctaaaatgccagacctcactgctccacagattcagagctttaaatacaccatatttgctcaagaagcattctcattatgtgtgaatgaataagtaagtgtcatgaatttcaaatctaaggaagtgagataaaaataatgtaaaaatagggccactaggaatagaaagttgtttagagatgaagaagggtagacgtcaataatacaactgctaaaatagcaaccatagtttgtaaaaatgagtgaaatataatttcatttctagaaccccatgtagacctattgcaatacaactgatgctctgttagaatggcaagaataacactagacactcaggggttccatacagactaattcttataagataaattgcagcctgttatgagtttttgagatgggtgtcatgaaaagatggtgaatgttattggacaaatgtatagaccaagagagaaagatgaagatcgattctatacagaggcagatgtgccacgaatgatagtataggtattgagtgagaataaagacctatgtagaaaaacatgcacactaccacaagaatgaaatgcactgagaaaatgagctagtgatggtacaggatctgcaaacctgcttgtcagttttcattgtttttcaagctgtactatatcttaaatgatattcaagtctgtctaatgttttctgtgcttgcctctcatgatccttaaaagttggtttaattttggcaaagtcccacaaagatttcttaaatgatctggcaaaccagtgctaacatctgtacatacattaattgaaatatattcaaaatgctatacagtctattatcacaggacttttcaatggagttgaaagcttttcaaaatattagaaaatatccatgtagttaggtagctaaaactcaggctctacataaatataagctaatgatttaagtgttagtttccattaaaaatttaattctcagttttcctataaagtattttctgggaaaataaatacatgcgtgtgtgtgtgtgtgtgtgtgtgtgtgtgtgtgtgttaatcaagagtgacagtgcactcaggttaaatctaccattcatttctagcttgtataattttattcatattctttctacattggaggagagtgatacagttgaacaaaagtcattagttttattatgtcatcagctctagatataaatttactcggttttctctctctttgcctgcccttgtacttacatatcactggcaatggaggagttccgggacatagactttggagagaggtcataatcgctgtcggatcgatacaggaaggactcccgtcgttgactgtggacaaaatttgcttggagaattagcccggatcctgggctggtcatgggatccaagggactccgtcccgcagatgtgccattgtccacatcaaaactgtaaaggaaggagaaggaattatgttgctgtgaacattcacatgttcatattttcaaaaagcatttagcgtcagctgaggaactgacagtggaattagcaggaatgaaaattacagctaatttctgccataaaaatatgataatattgaaatacataaaagaaaaacacattgacttcacattcttgttctcctggatactgttgttaactgaccagatacaagatacaggtttttccaaactctacttcagttaaaagggaaacactctgcaaaacataatcttctaagtacaaaattcctttcggaaaataacaaatacacagtaattcatcaaatatttgaattcgattcaacaaatacccattttgtgcctaatgctgttctcccaaacctgggcttctccctccacactcctaccctataacatccatccaagcattaatttctattgtacccacttccttccatccctactaccaatattttaaattcaggtctccatcaaatttcacctatattattataacaacctttatattagtgtcttgaatccattttccagtgtcattcttcagtttaaaacccttcagtaacttaccattgctctcaggatgaagtcaaaatttctttgccagactgccagtctaaccatctgctctcaattgcaattagttgcccccagcctcaacttgccatcctcagctattgggtacttcttgctcaactcatattgaggcactatctccttctcacaggccatcaccacctcacctcctgctcccctaaataatcaaatcccctttcccctgcctaactgtcactcatccttgagacttagcctgcacctgaaaggctaccctggtacatcagagctttatgaaaggccctttctctacgctcccaagacactttcccactccctaatgacagaatttacaatgaattgaaaatgtttttcacccggtctccattcctagattgtgagctctctacaaatggagactcagcgtattcttggcacattgaaaactgtgcccaagtgtcttgagtaaatgattaaatgaataaaaggcactgtgctcagcaatacatattttagagctgggaaaaaatctacacacacagttcttaacgtcatagtccttataatctagataaactttccacaaagaacctttctagtgaaacatcaaccagtattaaaataaagtcaactttcatgtgttcttaggagaggagggtgatagcttatgatagcccagcaggtgtgtggttttaaagaaaaacttgttgaaagaataaataaacatgtgaattcaagttttgctgtcattaatattttccccattagaatctttattcaaactattaactagctcattttaaaacattcctttattttctttatcggagtcattaataaatagagttatgactctaagattggaagatgtttcatggatcacttttgaatctgtgatcaaataacagtggctccgaaataatccatcaaataaacagaagagggaaaactcattatcttgagcagctgtaaatatgtttttccaacttaaaattttcttagaattgtgtctctttatagatatatttatttggttcaggaaggacaatgagagattgtcaagtcgaacagactcactttacagacgaggataccaggtcctagaaaagttaattgaccagtcactgagctaactgcattgaatcatcgattgttcctaaagtccttccagctctactgcatgattatataaaccacaaatatatgtggcacccaaacaggggacatctgtttcaccagaataggataggcacatatgtatgtgaaaccttgtcaattcccaggaaggctggaaggggaggatggtctctaatcattcaatagacatacattagggatctttggcaaactctccttggatatgcttaaataggcatttattaagcacttaatatgagtgcattaagatacaaaaataaaggatgaatgactaactcaggctgggatatctgagaagttttcatgaagagtagtatttaagaaggtttttgaaggtatttagtacacaactggaagacattaaaaacttctaaatagtgggggtttggcaaagtagatttctcttctaagaagatagtcatggcagcttttcagcatgaggaggacctagtaatgtgaatgcctgtagaaatgtttatgtttatttccctttaatatcaagatattcttattgctacactttaaaaaagaaaataccccctccttcctgtgcatgaacagaaatgtaagagatacagaagtgtgagttttggtttagtttttttcagttcaactgagtaaacaccaaatttgtataaatcagtaattttttctttaattataatttttccaattaaatcaagcaagtcttaacactccactataagttttgaaacaaatattgctaaataccttaagtcatttagatagttatgatatttttaaatcttacaacttttaagccataatattagcactaaaaccaaaacatttattaataggtcaggaagtgcttgatatgagatattctaggggctttaatatttttctttgtatactgtaatataaaaatttgtccactagatggagatcattttcttaaacaaggaaactattttctactgaagggttaaataaccttaaaggcctaaattatttcttaggaactcatgaaaataaccctttaaatgacatccaaaaaacaaagttcacaatgtatactaagtaattatcaatattgataaaattacattaatctaatattagtattagctttacaaacattgagaatgaagatctaaaaatagtgactgatattttattggactttttcttaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagttagtgggtgcagtgcaccagcatggcacatgtatacatatgtatctaacctgcacaatgtgcacatgtaccctaaaacttaaagtataattaaaaaaaaaaaagaaaagaaaaaaaatacttgagaagacttaattgaatttccgtaacaaatcactgagtacttattgtgttggagtaaagtaacttgagcatcattaatagtctggggtttcactctaaattttggcaccacaagtattctcagaatacggtttgttctgggaagtgaacctagggtctgagttcatttgcataatttatttccatgatattaaatcctcttataatcaaaattaattatcaagaaaaagtaatattaccgagaatctccagtctgaagtatcagccaatgtcagtattagtgaatgactttatacaaagagagactttgtattttgaaatagtcattgaataaacttttacattacatcctatgtccttagatcagcacttgaataagtacagatatactacacattgtccttttctagaaagcactaaagtctagttaaggtaatagaacatcaagcaaccagagaaaataaaagcagcaaaacaggtggcatctgtattaaatagcatataaatactaaaacacgaaattgtattatataggcaatcagactatgtgatgtagacaatgaatgtaaagggaatttaagaagttgcaggatgtacacctttgaaggagagttaaaaaatgtccagccagagtagagctggggttgggggtggaggccatccagcaaaagtgaagccacaaaaacaaaaccaagaaggaatgaataaggcgtgtatataaaacaggacatttagtgtctggctaaatttgaggcttggtattaaagaatagtggggacctataaaaatggcaattttgtacagttcaacctaataggtagggatggatgtgtttatggaaagctgggccaaggagtgtcagcagaagcttgttataaagacttacgtggaaacacacaaatcaacttttaacattgaaatctcaggggagtaagatgaggaagaccagtatttgttaaaataaacatgttgcttttgcaacaaataaaaggtagaaaacagagtagaggctgagcacagtagctcatgcctgtaatcccgacactttagaggcacacgtgggaggatcgcttcagaccaggagttcaaggttacagtgactgatcgtgtcactgcactccaatctaggcgacagagcatgactctgtctcaaaaaaaaaaaaaaaaaaaaaaaaagaaagacaaaaaacagagttaaaaaaaaaaaggagaaaaataaatgttttaactacaagaggacccccaaaaaggcttgttcattaaatacttcaaatattagaactagggggtttgccttgagtagggaggttagttgtggattttaaaaggcagcacatttttactcagtaggtagtaagttaactgagaattagacacttacttaactttctgaaagttagcctaattagtcagtttgggctgaaattatagatggcttcaaataagctagttatctttgaaacataattttatcaatagtccacatcgtggtgttatgaataaaacaagaaggtgatgaaggataaggtagccctaaccttagatgctggtatcaaaatgatcagttgtgaattttccaaagacattctttagaaaacacttggatgtggtgaattctcttttgactcacagccaattagatggagcccaagcaaaaaactagaagtttgaaaaagtaactaaaggattggggagagtaaaaattaccaagtttaatgatgatggtggcaataataataatgttaataacaataaaacttctggagcactttccatgttccaggcgctgtgctttgcatatattatctcatttaatcctcacaataacactttgaagtaggcactgtattttccattcgaccatggggactctgaggcatagacaagtgactctatgttcagtagtatgctcaagctcataagtgggttttaaactcaagctgtctgattctaaggctggggagaatggactctgtttacacctctattatgaagtttcatttaaaaaaatacaagaataccttttagcttcctcacctgcagggaacttttgaaagtaacattctgattaacttacaggtgacgcatgcaaaggctaattctgagactaaattttcgtatggggctgggtgtggtggctcatgcctataatcccagcactttaggaagccaaggctggtgaactgcttgagcccaggagttcagggccagcctgggcaacatggtgaaacaccatctttacaaaaaattttaaaattacctgggtgtggtggtgcttatctgtagtcccagctaccccagaggtggaggcaggaggatcacctgaactaaggaggtcgaggctgaagtgagccatgattacgtcactgcactccagcttgggcgacagagcgagactctgtctcaaaaaaaaaagttttcatatgacccaacattttggaatttgccaaatccccagctttttccaattctgaacataacagtagggtgtaaaaaagtctttgctgtaacccatttggcgggtttctttatagcatttgagatttcatttggaattaaggaagggtcagtgggtctgcaaaagggcttagcaaatggaactaagtgaggtgctttcttgttccatatgtttgcttcccttaatgcaatttaagaatgcacacaattcttaaaagagataacttttgccagaaggcagttttggaggaggaatgatatagctatatttggtctcccatgagggggcagtaacagtaatgaccagctggcctgctgcattcagaagtgttaaagaatgtgtgtggctagcactactcatgaccatttactccacagacccatccttttctatggaaccagccccctacaagaaacaaagagaagtcggacaaactgacgaatgaactaattactcccagttctccacactgttccatttcagtggaattactggatggtaatacagttccaatctacctttcatccacgctctcaactgctcgcatactttgtgtctactgaccttgtaattgtttgtctgctgaaggtcatttctcatctttttggccttttgctagacactgcttccctagtttaaacttttcccaatttatttttgaccatgatatgggccctctcctgagccagagtcctgctactgtgctgagtaaatagctttcctcatctatcctagccatcaggaccttatacttagcactgacccccagtatgaagcccaaagtgggtggggcaatgagggcctcagtggagcagctgctaaggaacctctatcaatagcagcctccattaccgaagcatctatgaaggccactcacagggaagatcttgctgaatgtcgctgggaatcctgggagccatcactgaagccaggaccatctgaaagctgcctttttcactacatagtaagaacaatggcacatagaaaatattgacctaccaaaaatgttcctgttaagatgtttatttaagagttagaaaacacaggttaaatttgaaatcttggttcagccacttcctatttgggtgctctagggcaagttgctgtattttctaggctttcactgctgataaagataattacaatacctagctctagggccattataaggattagaagagaaaatgtttggaaagcattcaccacattgcctggcagctagtacactcccattatttagcagctattgtttttcatttttattactctttttctcccagggagatcttcatctaggtcattctctttaactttatttgaacacatggctttgggaagaacctaaagggagagatgaaagaggaagagaactgagggccaaatcacctgaatcagcccttgcaatcaatgaggtgacagatgctggagccagattgctctaaaagtttcagctgcttttatgtctccacccaactccataattccagtgtgataacatctggggagggtggagactgctgatttttttctagatattactcactgaggagaaagaataatttcctaccaggaagtgtggaaggcttggaggtcccaacaacctaggtggggctccagctgaatataatgagcagaaacagtccttcagacctcaggtctccagacacagggtgtagcttggggacctcaggtcacaattatactgatgtttatattcctgtactccactctcccctgtgtattgtagctcatgctgttagccaacacattggaactcattttgatgctttgccctcaaggggaggggaggcttacccttgagcttaaggggagagtaactgtaactggatgactacatacatttttccctctttataatactaaatattttacccattgttatcaatatcacaaggttatgaagctcgtttctaatcaatgccactgatacttctctattgaaaatttccctgcaggtcaaatagcttctctgaagtaaacaaaataatgatttgcaaaattcaccattttaatatttacttttctctgattatctatggagatgagactgtagaaactagcattttacagtgatatgcacagatggcaatctttcccaatcaatcataaaactgcatattaaatttaagtaggatacccggagaaggcatgatatttagctactttacaagattacacagctaaattatactacacatgttagcttgtataatatatatatttgcacagagttaagatatttaacagacacgttttaccctttgttttcacagatgatttttataaacaaaagcccagggctgggcatggtggctcacacttgtaatcccagaactttgggaggctaaggggagtggattgcttgagctcaggagttcaagaccagcctgggcaacatgatgaaaccctgtttctacaaaaaaaaaaaaaaaaaaaaaaaaaagtcaggcacgatgatggcacaagcctgtggtgctgaggcaggagaatcacttgagcccaggaggctgaggcttcagtgagtctaaatcatgccactgcgctccagtctgggtaacacagtgagatcctgtcatacacacacacatacacacacacacacacacacacacacacacacacactggtacaaagatgaagggtatatgcttacttatgagtaaaacattaggtggtactggaaatatacaacatatgtttctggcttgtcagtgacactcccaagtaacacagggcaataaagagattcaagatggaaatgatagcatgagtttgatgtctggactataaatgaaagaggataagctggacttgcttagcacacttttgacacaatgatatgataaaaggccaatttttctgaaaagtatttattaggccagtgttatggactgaatcttgtttcccctataattcatatgttgaagccttaatcaccaatggttacatgaggttgaggttgaggttaaatctatcttgtttcccctagaattcatatgttaaacgaggccatatggatgaggccctaatccaatagtgctggtgttcttataagaacagagagagacacaagagcattctctcttcaccatgtgaggacagagtgagaaagcagccatctgtatgtaggaagagagccctcaacaggaaccaaatcagccaatcttggtcttggacttctcagcatccagaattgtgagaacatttctgtttaggccaccagtctagggtactttgttatgcggcctgagttgactaaggcaaccagaaagccccaaccaaaaattgttttacttgaagtttatacattactttttaatgactgttaagaaaaattttcttaactgaaactctctctaagaaagcatctcaaattattgccaagaccaatgccatgaaattttccccctaaattttcttctaggtttacagcttcaggtgttataattaagtcttgagtggattttttgtgtatgatttaagataaaggtttagtttcattcttttgcatgtgaatatctagtttccccaataccattttccaataccattcaagacttttcttcattgtatattctggacatccttgtcaaagatcagttgactgtgtatgtgtgagtttatttcttggctctattctgttctattggttttatgtctgtctttatgccagtaccacattgttttgattactgtcacttagtaatatgttttgaaatcaggaagtgtgagatctccagatattttgttctttttcaagattgttttgactattcagccttttgtggtttcttatgaagactgcttttctatttctataaaaaataccattgggattttgatggagattacattggacattgtggacattttaacaatattaagtttcctaatccacagcagcatcaaagcataagcaaaaaaagcaaaaataggcaagtgggactacatcaaaataaaatgtttctgcacagcaagggagaaaacacagtgaaaatacaacctacagattaggagaaaacatttgcaaaccatatatctgatatggtattaatatctacaatacataggagctcctacaactcaatagcaaaacccccccaaaacccaattgaaacccctcaaaattaaaaaaacccaatgaaagaaatggacgtttctccaaagaagacaaaaaatggcaaacagggatatgaaaagatgctcaacctcactaatcattaaggaaatgcaaaggaaaaccacaatgagatattgcttcactcctgttaggatggccattattaaaaaaaaaaacctgttggcaaggacatacagaaattggaatccttatgtactgatggtgggactgtaaagtgatgccactactataaaaaacagtatggaagttcctcaaaaaattaaaaacagaactaccatatgatctaccaattcaacttctgggtatttatccaaaaaattgagatcagcatgtcaaagagatatttatattcccatattcatttatgtatattcacaataccaagatgtggaaacaatctaaatatccatcaatgaacgaatggattaaaaaatgtggtatatacatacaatggaatattatttagccttaaaagaaggatatcctgtcatatgctacaacatggatgaattttgaggacattatgccaagtgaaataagtcagtcacagaaagataaatattgcatgatccctcttatatgagggatttaaagtagttgaactcatagaagcaggaagtagcatggtggttgctgggcctgggtggagggagaaatggagagttgttgttcaatgtgtatcatttaatcatgcaagatgaataaattctagagatatgctgtacaacattgtgctaacagctaataataatgtactatacacttaaaatgtaagagggtagatctcatattatgtgtctttgtttttagcacaataaagcaactttttcaaaaaggatctcaaatggccctaacatgaggccatggtatttggactcttgaggcaaagcctgcagtagcagtatgaggtccatatttgcagtaattacctagaaatcatgagaacttcaagtagtaaacatatacattcaatcagaatacgtgctgacaatgggaagcggaaagtgtctttttttttggtagtcattgggaggccttaatttctctggcaatttcatgcaggtgtcactgtgattgagaataaaacaagtagagatttatttcttcccttacatcctattatcatgtgctgaccactaactaagagtatggagggaagagcagaaaagcacatgctctccaggccaggctggacctgagagtcagctgtagtcccacaggaataactcagttttattttccttgtactgctcacagcaggttactaccaatctttcactttctaagatcacttctaagatgctatatttccaaaatgcactctttctcaaaatgtggcttcatcaagctaaagtccaaagaggaatagcgtcttgttaacaaagtggggctcaagatggattaaagacctaaatgtaaaagctaaaggtataaaaaccctggaagataaccaaataaataccactttgaacataggaactggcaaagatttcatgataaaaatgccaaaagcaattgcaacaaaagcaaaaattgacaaatggaacttaattaaactaaagagcttctgcacaggaaaaaaaaacacaactattaacagagagtaaacagataacctacagaatgggagaaaatgtttgtaaattgtattacctgacaaaagtctaatacccagaatctacaacgaaattaaacgaacattcaagcaaaaaccaaaccgccccattaaaaagtgggcaaaggacatgaacatttttcaaaagaaggcatacatatggccaataagtgtatgaaaaaatgctcaatatcactaatcattaaagaaatacaaatcaaaaccacagtgagataccatttcataccagtcagaatggctattactaaaaagtcaaaaaataacagatgctggcaaggttgcagagaaaaggaaacgcttatatactactggttagaatgtaaattattaatagttcaaccattgtggaaagcagtgtggtgattcctgaaagaactaaaaacagaactaccattcaactcagcaatcaaactacagggtatataccaaaaggaatataaatcattctaccataaagatacgtgcatgcatgtgttaattacagccctattcacaatcacaaagacatggaatcaaactaaatgtccatgaatgatagattggataaagaaaaatctggtacatatataccatggaaaactatgcagccataaaaaggaatgagatcatgttctttgtaggaacatggatggagctacaggctattatttttagcaaactaatgcaggaaaagaaaaccaaatactgcatgttttcacttataagtggtaaccaaataatgagaacacacagacagaaagagaggaacaatagacactggggccaacttgaggatggagggtgggaggagagaagaggatcagaaaaaaaatactaactgtcaggtactatgcttagcacctgggtgacaaaataatatgtataccaaacccccggggtcacaagtttacctatataacaaacctgcacatgtaaccctaaacctaaaataaaagttaaaatattaacaacaacaacaaaaaaaaaaaacaagcaagcaaagaaaaatacccaaggtagtgttgcggggtgtttctgtctttatttattgtttctatgacatagagcaagtaaaattgatttaataagccgactttgaaacattgatattttaatgatgtgccctgctacttctccagccacccacccacatttattctttatattgcagacagagcgatcctcctaaaatgtaagcccattctcggcaagttcctactcattatcccataatggtgtcctattttattcagagaaaatactacgttctcccaatggtttaaggccctcagtgacctggtccctggtgcctctctaatctcatctttacctacatctctccctcttgttcactctgctcagcctcttggtccctagctgtccttgaagcactgtgcatactccctccccagggcctttggatttgcagttctctttgcctggcatattctttctagagatatcagctcaatgttaccttcatgagatattcccatactggcctatttaaaactggcacccctaacctcctaaccttttttttttttgaacaaacaaacaaaaaaccttccttactcttaatttttctccatcgcatttaacagcttctgatgaactttgttttttacttattttatcatcttactcaccccattagaatataagctccacaagtgcagagatttttttttaaaaatctactttgttcgttaatgtgtcccccagcaggtacaacagtgcctcacacgtacgagttgctcaataaatatttgtatcgtgaatacatgggtatctttagacgcagcggtactttttctataccggttatcatttaccatggttatctgtgtagttctactttaaataaacttcataactattttttaatttagctaggagttggtcacttatttaaagaaataggttaatgagattgattagcacatttgaagaaataatctggaacatctctaagaaggcattttaacgggggttattttgaatatccttctgtttgaacagcagtcagccatgcaatcaggggtgggatcaaggttttgtggtacacgaagattatacaattataagggtctgctttcagaaaaataatacaaaaaaatcttagttttttgaattttacaaaacctaaaactacgtgcagctgctagtaccacttcttacaacttgaaagggaaccaggccagtgagaagctcttagcttgatcttcattagtttcacctcagatctgcatctgaggtaattacatatcaggaaagaataagaaaagaaactggatgggtgaaaataaaaatttagcaccttatatcattacttaattaattatgtgttttctgagatggagttttgctcttgttgtgcaggctggagtgcaatggtgcgatctcggctcactgcaacctccgcctcccgcgttcaagtgattctcctgcctcaggcccccgagtagctgggattacaggcaggcgccaccatgcctggctaattttgtatttggggtttctccatgttggtcaggctggtctcgaactcccgacctcaggcgatccgcctgcctcggcctcccaaagtgctgggattataggcgtgagccaccgtacccagctgcaccttctattttcttaagagataaattgttattagttttttcttcattcctttttattctttccctccctccctatcacctccctctctccctccctctctattttcagtacccaaattttcaaagcttactcataattctcaaaatttctcttgttagttgcacgtgtttatttttcccagatcagtgagtgtcacctagtcctggggaatggggagtgattccattaggtcagatattgaactcactttgaagaggggtgatcttcaaaccatacctgtctctcaagatattacaattttctttttgagggatgggttttaaaaatgtgatcctcaatcacattcctggctatttgggtatttaggcttactaaaaattaatctccaaaagattttattgactaaataagaatgattgaatgataaatcctttgtagaaatacttagccttaaaatattatgtgttaagtatgttaaataagtctaggtaagattataacagaaaacaaaaaagtaatagttctactataattgcctttaaaatataaccgaattctgattcttttagactaatggatacgaaaactcatataccatgtttttcctctgggtttgcactctgcatcaaacaggtcaggaaaccattcaccagccctactattaaatctattttggagaagtgatattattcagtttccaacctcaacaatccaaacagatgggttttctgccttaatggggcttgaatgaatggcgaagggcttcagagggttgtgtggcctgaattacagacaattttttcaatcttactgggcaaagcaatgataagaatattatcttacgatggccataaacaatcacttgcctcttcaattcttttaaaatatatagtggagaataaaaaaagatatgtctcattatgtgtctcattgtataataagtacactgagattagctttctctcatgatttcttatattgggtgaattatgtatggttacaaattatcttttaaaagttttaagatgttggatgggctaccacagaggtagcaggatctacttcaacaatgattttatagagtgaagaaacattttcatgtttccttgaaatggaatctggctgaagacaaaatgaccttgggaaagcatagaagtcaataatcaggactgtgagtataggaaattctgcttgttgtctgccatattccattctctgcctgttcctgggcataaaagaagttctcgttcccttgcaattagatttggccaagtgactagatgtgagcagaaatattgcatgccactttcaggactggctcatagctcctcccacatgcctatcttgatgttctttttctgccagctggatgctaaagatgctgatgcgtgaaggatggtagaaacagaaggtgggagaatcctggtccgtgactgagagcaaggagagctgccacatcctcctaaacaccatcctagaacgctacttgatgaagaatgagtttattttttaagtcatttaatttgggggcttatttgtcagcacaataacattcaacacagtgcgttccatcaaagtaaactggaaagtacgtactgaaagtacattagactttcaaatgtctcacattcaatctatctctggcccaagtgaaaccatctatgtctttacttctaccaccttcacacttcatttaggttttttgttttgttcccttgatcttcctcggttaacagatattttcattatgacatttctcattacctaagtgcttaagagatgttagagaataagtctataatcattacacacagttgtgattgttgtgtaaagtgaaagccagtctggttctgttctgtcttaacaacaatcagcaaagttacagaggatcagctcaagtgtgaacctgacacatgaatttgtctctggattacagaagacacacagaaccgagattaacaaacactcaggatttacacccgtgcttcacttgagccaatgagatttcagaagtaccagatcgaaataggcttcccttaagacgtcaaagcattgcaacaaaaacaaaaacaggcaaatgggactatattaaaaccaaaaatctctacatagcaaagaaaataatcaacagagtgaaaagacaacatgttaaatgggagaaaatatttgcaaaatatatatctgacaacggactaatatccagaatatgccaagaactcaagttaacagcaaaaacaaaaccaaaccaaacccaaataatcccatcaaaaagtggacaaaggacatgaagacatttctcaaaagaagatgtaaaatgaccaacaggtatgtaaaaagtactcaacattactaatcatcagggaactataaatcaaaaccacagtgaggtatcttaccttagaatggctattattaaaagaccaaaaaaaaaaaaaatagatgctggtgaggaagtggagaaaagggaattcttagttggtgggaatataaattaatatggccattatggaaaacagcatagagatttcccagaaaactaaaagtagaactattatacaatccagcaatccccctactgggtgtttatctaaaggaaaggaaaggaaatctgtatatcaaagggatacctgaacccctatgtttattgcagtactatctacaatagctaagatatggaatcaaccaaagtatccaccaacaaacaaaccgatagagaaaatacatatatatatatatatacacacacacatacacatacaatggaatactatgcagtcataaaaagagcaaaatcctgccatttgcagcaacatgaattgacctgaatgttaagtgaaataagccaggcatagaaacacaaatatggcatgttctcactcataagtgggtgctaaaaaaagttgatatcatgaaggtaatagaatgatagctaccaggaggaggggaatgaagagaggttggctaacgtatgcaaacatacagctggatagaagaaataagttacaatgtgtgatagcagaatagggagattatagttaagaataatgtatcatatatttcaaaatagccagaagaaagaaattgaaattattccactacatagaaatgataaatgcccaaggtgctggataccctaaataatttgtctcggtcattatacatcctatttatgtaacaaaatatcccattatcctatgtacaaatattgtgaattaattattttaaaattctgttaaaaaacaaaaattaggcttgccttattcaaaatgttattctgaagcaaaatgacattttgaatgtgcacacttctggggaaatggttcagagtctatagaaaaattctagaaatatttcacaatttatccaaacccagactagaaccactcttcactgttgcctagctcatttgcagtgggatcaggatgagttggttcagactggcaatgtcgtaggttgaatcagatgcctaagaccattcctgttctgaactcataggctaaatgcctttctagagccaaatgttcctctctagaagaaggaaaggatattacctggggcatcctcttgccagtatagcactctcctcaaatttgagccctctttctctgagtttcagtgtatttctggtgtaagaaatatttcattgccaccttagagatcaaactcaaaggattaatagatcctgagggtgatagagtaggtcatagaaaagagatacctatccattccacaaatgctcatcaactacctactctagccactctgggaggaataatgaagctcattgagaagacgtaaggatggtagtagttacactgatcttctgctccaaaattaatttggggttttccttcccctcaggatgaccaaattcatggtgaggctattcataaatcctgttgacttgccaggtccacagccaagataaatgcacagctgttttctaaaggcatttgacctcttctctaatcacctcaagttgagaagcaatgttcattgctgactttctttgttttgacattaactatgttctcaaataaaaaatcaagttttacttctccagccattaaaatttctctcatttttatgaagtaatatttctcaaacatttgaatatattcatccatttttgtgccacttcatctattttctagatagattatgatattcaattatgtgtattttgtctttcttttttctttttttgtagaatttattcgatataatcttggctcccattttatttcccacttatcctcttttaaaaaatgacttatgcttttttaatgaggagtccaaaatggcacacagaactctaagtacagtgtaaacaaggccatctgtaatgagaaagccattcaattcagcaaagatttttctaaccagctatacatagtcatgacagaatcctcagatttagtgtttcctagtagcaattgtaattcttttgattgctggcctgtaaaatacttagtactatactgtaccatgacagtggaaatatgtaaatagaacctccatctccagcctgcttatataaaatgaataccactggtaaataatttaatgttaaatgtagttacttttacagaaaaatatatgctgtaaaataacttctactcttttttcatacattcagatagcctaaaaaaaggatagatgtcagttttttaaacttgggggaaaaaagaacccaaacatgattatatactttgctgacctttgaaatttaatttgaccaaattttgaaaatagtctttgagaattacagagtgagcaaatgccagtacttcatgaaactcaaatcgagtttttttttaaataagcagtgtaggtatcgtctttgctttttccatgtctttaagacttttaaaaatcttaaaatatgactgtttcaccactctttttctttttttatagaattcagaacttaagttaaatttgacaagaggaaaaataaaatccaaaccacatctatgcttattctgctcttggcttcttcctacagagctgtcctttaaatttgcaatgtaattatgagtttccataccacatatgccactaatcccacgaaagtatgtggcccttcagaccacatgaaaaaaatctctcagggcaccttgggtgctttacccacttgccatgtccaaaaagagttccatctgtgcccctgatggtcagataacctgtcctgggtgagacaaaagaattattcccaaaggccttttcctcctgtgcttcttatgccctcacaagcaggttgtttctgagcaccttcacaggcattgttcagtggaattcacacagtgaccctgggcaataagtgatgggattgggagtgtagatttttatccttatttgctgaagaaaaatctgaggctcaggaaggagggcaatgatgtgcctagagtctcatagatttaaatggctggattacgactcaatcccaaatcttctgttctttggactaaagatttaaatgaaggattgaacaattggattacttttaatccttcataaagcttgaatgaaagacaaatgcttattttaatgtctcttatgagcactcactagaaatattctctagccgagcacaatgttcaaaacctttgtgtggaatgttacattttgctgaaatgaatggatgtgcttacatgtctgtaaatagtagaatgaaaaagctggaaaaggattttagcaagagtccttcattttggtactcttgttaatcatcctaacaatattgtaatgctttatagtgtatggtaaatgtttgttaatacttagagggagatacagaaaacaactatctggttaaatttacttaaacatatcagaccagctttgcaaaacaaagggattcccacttgatattctgaagaatatttcagaaaaatatgaatgtatttcttttgtattatttattgatttttaaattttagatccaggggtccatgcacagttttgttacatggctatattgcaggaagctgaggtttgggcttctaattatcttgtcacccaagtagagaacataggacctgatagctattttttgacccttgccaccctctcttcctccctgcttttgcaatccactgttgatgggcaggaatgtatttataacgcaaagataagaactgatgctgggcaatactactgggttgagaattgggagccttgagtttgagttctgaccccgctactacctcgttgtgattttggcaagcctcttgacttctctgggacttagctatttcatcaatgaagtaaagagattgtccttttcaattactgctacatatcactttggagaggcttttaaaaatacagattcttaggcctccttttggatactctgagtcggtaaagctgaagctggatccaggaatctctattttcaaaaggctgtcatagctatttgatgtgttgtcaggttgagaacaccggacttgctgaccttctagctttaacattcccaattccaactggacagcactgaactcagctcatattcctctatgctgtgcttactcgggagcgggagtggtgagaagagccaaagctgtcgtcaccaggctatattacaccaccttccttggtggtgtccctgcccacatgcccagctcttcaacaccactttctacgctgctgttgggattttgtgtgtggttaaacgggatggagaaagaagggaaaaaaggagagagggagagaaggaaggaaggaaagaaaggcaggaagaaaggaagaaggaatgaaggaagaaaaggaaggaaaaagagatagcttgcagtggctagaaaatgtaattattttacttccttgaataactacttttgcctataaaagtggattctttatcacggcacttaggttactttaaaatcttgtcctaattcccttcaaatcttgtctctagcccctccaaagatacttctggtcatactgttctcactctctggagtatgtgttacagataatgaagttttagacccaaccaatttctgcctcatgaaatcattctcacttttcaaagctcaacatgtagtaagaaatgtgtaatatgacctccagttcttccttccacaattccaaacatcttattcacactgtcaataaagcattatctcagggttaaaataataaagcaactggctttaaacacatttctccccttatcaactaccccttcccagctatttgaggttgggggtctccataccatttactttaatcatcataaaattaacattcatgttttgcttgaccatttgccaatttctttacatccattattttatttgcatttcataacatttctgttaaataaattttttgtcaacccattttattgataatgaaactgcaaacagggaggtttactggtttgctggttaatgatgaagctgagatatgaacctagatgctgtgatttcaaatcttatgattttcctgcactgatttacaagacatcgacaggtgctcagcaaatgcatattaagtgattaatattaagtgaatgaataactggtgagaaaaggcctcatggtctcaaataatggtctctggtctatgcttgcatcttgaatctgcttcttgctatctgaacaatgtcagacaatatatctaatctgtctgagcttccctttccttctttatcacatggggaaatcatactgccctcatataggtgtgtgtgtgtgtgtgtgtgtgtgtgtgtgtgtgtgtgaactcagtgatatgaaatgtgtaacgtgtcctcaccagtgtgtgcacagagtaagtcctcattatatgtttgcttcttaattttgtgggaggcagtcattttgttattcattgcatctgaattttatgcataagcctacctgtggaggttacatttattcctgagattttaatcctctctcatcttcagtgagaaacagtaagagagacactatatgatgatagttaagaacacagggtctaggcagccctgagttcaaaacctgattctctgcctttgtagccttgtgagtttggccaagttactcactctctccatgcctcagtctcttcttccataacatggagaacatgccatttagaattatgcctggtgtgtgataagtgccatgtatttggggctattacttatgttatgggggcacaaaactaataataggcatggttagcacaataatgagatatttgtcctttgtgtttctcaaccaaaattgatgactcttgtaatataggatcaacagtaaactgggaccttgtcatttgcatttggaatagtaggtaacagtaattagatgagcatttgaagaatacatgagaactcacatataggaaaacaaagtaggagtgtgcattttgtatttaaacataatgaagcatcagctcttatgtatttatgaatggagaaggaaaaaaggtcattcgacttttgttgagcaccgtggattactatctttgatgctgtcatttgaaataacaaaaactgcctctgcctttccccagccctactattgaacagaaagaactggaaggagaaagagtgccatcttttagaaatggttcctctgagtcatagttatcccttttgagtaccacatcaaaggctctatttcacctgagaaatctcatacgcatttcaaaagtcaaactgtaataacaaaacctacactacctataatgtcaaaacatcaagcaagatgtaacaatctctctcatatcctagtctcatacatattggtgtgagttaaggacaaaggtacttttgactttaagacagtaagaaatgtgaggtcagtgtccttgggaataactagaaaccagagatatttattgcctagagacaacgttaagatgatctcagaaaggttttctttggaatggtggagattaagtggcaaggccaggtattcttgttaccaaaataaatactgcttaagcaacagcaaacatgggagagggatgacagaagaagggtttctctatccctttgctggagctaaagtaaaacaggcaaatgattttgaaggctcagcatttaaatctaccatatagggtttaactattggtgctgtactgctgtctgttgatagaactatgccttctcctgaagcttcaaactttagttgatatctcaggtagaaagtgtgttcttcaacatctttcatagctttggcaacactgatcacgttgctgaaatgcctcctcaccggagatcttaccacctgtgaaattctcctcaaccctgctctctgcctctgaattcctggacagaattagagctgatatacaagaactcccaaaggcaagcctgcccagacagtttttaggttggtagttcactgtccaggggacccagctgccactattctacaggcctttttccaagggtaacacaataatcacaatagataataacaacagagaatgtactatttttagcatttcatatccattgtctcatttgatttttattactatgccggataaagcaatggtgctaagagaagtaacttgcctgaaatttgtatttttatccattataattcgttgcctctctaggatccaatggccccttagtaaaaaatactgatgctttaactctaggttcccaaatgccatttagctccccaagcatcgtactgtggcaaaaactacatgcactttgaaatcagatctgaatttgaataggttctgttacttgccagctaggggaccttaagcaaagcttcttaccctctctgagcctgcaacactcaaaaaggattacaaagcactcacatattaaaatgagttaatgaatgtgaaagcacctagaacagagttttgaaaatagtacatgctccgtaaatatgaaattcctttttcttctttcccctttgaatacatgggagtttcctatacaatgctttggtattttaataagatggtcttaattttactcattgcatgcatcttgaggccagtgaagcactaacgcaattatctctgtcaagccttccagttattaaaactaacagccatgacacaaccttctcagttcaggcagcccacctatatttttaatgggagtattggtatatttacagtctccatcagaacaaagttctgttattattttgactctaggaccattattttatgtgacagtgactttgtcagaggagagaaaggatgtgactttaaccctggtttttaaaaaagagcaattttcctattataaactagttaaaaactcttgttgaatagcatattgcaattgatgtttggggtaatatgccagttttagcaagaaataacacgaaatagaatgctccaaatttattatttatttgcacctgtgctcacccacttattttccttcagccttcatagttcttcagatatttgatgagtggtgtaggtgatgaatgaatggcacatgtctgtaaaacactaagctcagctcaagacctgcagatcttcctagtgaactaaccaagtggttcagttgataacacaagtatagtatcccaataggtttagaccctgctctggactctggagaacattgtatctgtttatgtcattctaaaacatagccaccctgttgcaaagagtttcaaattttggagaccagagacccctttgagaacgacatgacttataaatctttggaaatgtgagtcttcggaaaaattcacaaacacacacacacacacacacacacacacatcccttttggatgtaattccataaagttcagtatagcctagtgattaagctaagggctttggagttagataacctggcctaaaataatgaccctactgctatttagttttgtgaccttcttcaagtcatttagtctctttaaatttcattttaaaaatgggaatgaaaacagtacctatgtgatgagtctttatgagatttaaaggagataaagcatgtgaagtgctcagcacactgtatgacacttactaaatgctttgtacatttttgttattttaagggagttacagatctccaaagcttatttgtgggcagcagattaagaatttctgctatgaaaagaggacaaagttcaaaccaattaaggaccatctgcctaccataaaaacaagatcctattgaagttaaataactatcaataaaagggcattcaacaactaggtctgctaccctgcctggccctgagcaagtaggacaatgggtccagccatgtccctgttctttctgaggagtggcaactgtgcctcctactgcacccgcctgtaccagccatggctgagaacttggcagtcatggatgctctctacacttgactgaaaaagaaaacagcttcttggctgtctgagccttaaaaggtgattgtcctattcctgacatattctttacaaagttctaggtgtaagaaaaggctgtttcaggttttaatgagagaatatttgttagagagaatatttgttaagcgcccagcttaaggacacacacaaaactatcaacaaatgccatctctttccaaaggtcaagagagagggtaactttacttgacgaagtcacagctctgggagaaattccactgacactcaggggactaagttatgtagtttaactaaatttgacttgaaataagtaggcatttaagagggcttttctctggggattttacacatattttgctgatgttgtattttaaggtatcctattttggtcaaagtagattctttagccaaatcagtacattttgaaatgactaaaatatctagcagccagcaagttcagatacactgatctttaggaggaaatagccacaaattgaatagtacttaaagaattctgtatcattttgctttgtttcagaaagattatcacagggaaaagcttagttaagtgactttaatattaatatattcatttctgtatttccaatatctagcataattctcacaccaggtataggaaagtgataactatttattgaatgaattttctatatatgtatgtcaatatccatttttaagaactccatggtcaggcatggtggcccacacatgtagtcccagctactcaagaagctgacattggaggatcacttgagcccaggagtttgagtctgtagtgtgctatgatcagacctatgaataaactaggtgaggggaaatttactgtgcaaatacctgctatggctgatacaaggtgcagattatagctctatggtggcctggagaacctcacacttcttaatgggttctctaagcaggtgaccaggagaatcactattctatttttgataaagtttcactgatcttttttcaactagtcttaccaaattctctgagcaacacctgctgcatttgatctcaactcaatttcaactccactggggtgcatgggtgggaacaagagaaaaataagggaaatatttaagtaaatgaaatttagcaatgtcagaagagacagcaggacaaattgcaatcaataatccaccagcaatgctaatcacttaaaattgtacatttacattttccaatgcaggaataatgatatcaatatgaataccaatgacaacagtaacgataatgagttcacatttattgagtatttactgtgtgctgtagactgtgttaaatcatttgcatggcttatttcatttaatctcacaagaatcccaggtggaagagactggcatttcctttcctcctttatagataaggaaactgaggcagagaggagttaaataaattatggacagatgtagagccagtgtcagagcatcaacataagaattctccatcgttatactggcttttctcacaatatggccttagaattacctgggatgcttgctaaaaatgattagctctcagtgttatctaaagcaaatgaatcagggtcttagggatgaagatcaggactctacatttaagagacagcaggcacagtatttcttacgtacatcacagttggagaaccagtgtctgagcagtatgaatttcacagcctgatactgctacatgaaccagattgagtaaaatgattctcgtttttactatagagtcgtataagagagaaaatatatcacaacattaaagagaaacagtaaaatcacctcaactattgaaatcatttcaacagaggactcaacttctgaattgatcatagagatataactgcttttgaccagctttagaaggcagatttttgtatttgtctctcatatggaactggggcctcaatttcccatttgtaaaacaagagtgtcggactagacaaaattttataaaactgcaggtttaaatattaataaatatataaatgttttcccttttttaaaaaagagaattcactatacaatttcttaaaataaccttttttttttttttttttttttttttttgagacggagtttctctcttgttgcccaggctggagtgcagtggagtgatcttggctcactgcaacctctgcttcccaggttcaagtgattctcctgcctcagtctcctgagtagctgggattacaggtgcccaccgccatgcccagctgatttttgtatttttagtagagatggggtttctccatattggccaggctggtctcgaactcctgacctcaggtgatctgcctgcctcagcctcccaaagtgctggaattacaggcgtgagccaccggaactgtttttttatatgtaggcttaaaatttgttgtaaaaactatctggaagtatatttagtatgtcttgacaagtttagacaccatttaaactctttgacccagtaatagcatttccaaaaattttgccaaagtaattaaccagagatacagattaacatttcttctacaaagatgcttagtgaaccactacaataaagaaaaaagaggaaaatttaaaatgcccaacaatgaaagaatggctaaatattgaataaatcattttattacatgtaaaatggattcctatgtcaccattagaatatcagatttttctagaatcctaaatgacacgagaaaatacttcttaaaaatgtcaagcgaagaatgcagaataaaaaattatatatatatacaggctgggcatgttggctcatgcttgtaatcccagcacttcaggagttcaagaccaccctgggcaacatggtgacaccctgtctccactaaaaattcaaaaattagttgggtgtggtggggcaaaactaaaatcccagctactcaggaggctgaggtacaagaatcacttgaacccaggagacgtaggtttcagtgagccaagattgtgccactgcactccagcctgggcgatagggcgacttcatctcaaaaaataataaataaaaattttcaaaatttggaaataatatatgtatacacacacatatatatatatacatatacatacattttaatggtcatatatatcctattatgtgccagatgaatatcaggtaggtctctctctctatatacacacatatatgtatacgtgtacacacatatgtatacacatatatatatacatatatacacatatatacacatacatgtatgtacatttacatatatacatatatatgtatagatatatgtatgtatgtgtgtgtgtctgtgtgtgtgtgtgtgtgtgtgtgtgtgtgtgtgtgtgtgtgtatagagagaccgacctgatttcatctggcacataataggatatatatgaccataaaaatgtatatatatatatatatgtgtgtgtgtgagcatgtttgtggggtatgtgtgtatatgctttaaaggtttattcaggaaataaaccaacacgttttaatgatggctatccctggaagctgcaatgacaggttatgtgtattttataaaatattaataaatattggaatatttattgggaattttctgaagttcccaatttgtccacaatgaacatgtgtttattttgtagttagaaaaacatgttattacaaaataattcaataggaaactacttttagaaatgcatttatgatgcaaggtgaagcatatctgcaacatgcttcttgctgacaaagaggcctctgaagcaggcctcaccaatgttcccaacgatggtaaatttggcaataattgtgttgttaggggagctccaagcttaaatgctgcaattatgagctagggtacacaaggacatgttggaagtgacaggcaatatcagcttcctccaaaataatggtcaagcgaatatgtgcttttgcccaaaaaggaaagtagcacagctgtaactggatattgtaaataagtggtcaaaggttccctaaataagcaatatcatataagcctccttgaggcatattttttccttctgggagccgtgttaggctcacagacatgaaggcagccaggaaactgttatctgtttacttctaatttatttttataactgtccatgccagcaacaacaacaacaaaaatgtttctaggagaaaaataaatttggcaataaactctctgagttttcgaaaaatcttaccaaatcaaaaacttctacttatcatgttgctgtcaaacccagcctcataaaaactttacttataattgagtgtatgtatgtctatctgtactgtaaccttgatacttggcctcaaatcctggttctgccaggagcttcgtgcctttgggaagatttcctagcctctccacatcttgcttttctcatcttaaatgtagacaatattataccatgcagggctctgtgaggttgaatcagaaaatgccactaaactgcaaagcacaatcccaggcacattgtaaaaatggaaaaatcagcttgattccattcccctcttgccatacaaggatatttcaggtctctcaaaagcgtttcaaggaatagaggaagtagtcaaacaagtgtgtgtgtgtgtctgtggatgttggtgtgtgatgaaatatacatataaatattatatataaatgtatatattatatataaaatatttgtaaggatggaataactagtatctgcttaaacaacaactacacttcgaaaatcctttatttttcctgatgagttttgttcaggtgaagatgttcactggtaaaaagacaaggcaatccatttcttttctacagtgtcagctttgtttgaaggacacaatgacatctattcagaaaggtaccaaccattttgcttttaaaatactgaggcaaacctctctgaggtttcttcaaagccaatggcaacaaacatatttcagcatctgttttgcttcactgtaggtctgtgtgtgggtaggttataaaataaaaatgagcttgccattacagatactacttaaaaaccaaaaaaactatgatcatgatgttgataattctgtattcattatcctaataaaaacacataaatgtctagaaagaaatagacaattatgtattaggccttccgtctcttatttaataatagcagtgtcattgctctagttaaaacccgctctgatcttaataaatctgatgtaaaaacatatcaccagatggggactctgttaatcttatgcgatactttcaactatgatgactaatagttctataatttttatatggttgctcttattgaggaaagagtaaccatttaagggaatcttccaccactgttctttgttgaaaggaaggctggatctacatgcatgccaacatactactgaaaagtaaatatgcaatccaactattcaacaatttggaatcattgcaatttttatagttccagatggtgatctttatccagatgaagtgagactattttactactttgtcagaactctacaactaaatatttataaccctcaaatacacagatacattatcacagtgtgtgtgtgtatatgcacatgtgtgtacacacttttatagaatgagaatgaactaggttttgtaaaagtttcagttacaagccacatgcctatgttacacattctgtctgtaaactacctacacccacacacatatacattcatgcaccaatataatatggttttcaaaatcatgtcacatagttgatctcattttatctcaacaggaaccacagtctaattgaaataaatgcctctgccatgaaactaagtcagttagtaactgtaaaggagttgatttacaggaatatctattccatggcctagctaactgaactcattaatgacacatgttatgtaatgcttgttaaattagtgaatgctcttacattgaaagacacatagtaaagtgctgaatttcaggaggtgagctagtagtttcaatgtttgtgggcaccatttaatgcataggaagcctgcatttattgagtaaaatttagagaaaaaaagaggccctgcccattgtaactcaagattaagggcaacttcaatttcccagagcctccgtaatgggcactttaggagaggtgaatatggtttgactggatagagtacaatggctttttacattgataaaatttgctgtacaattgtttactggtgaactttttaaaaatggaaatagaatgtaggcttcatatgttactaaggatacccttgattatgtaataggcacttgcattacaaaaaatgaaaatggctgaataggtagcctgagccatagtttctgcaacctgttctcctttccagtgttattaatcacttgaacctcacctgctgctctggctcctcctccttgatctttacagatatgactttaggcagaaacagattcaggagcccagcaccacaccatcctgctgcagttaacttgaacatacgtcttatctctgattactactggcttctgctttaattccctgtgcttatcttccgtccctgagactccagtccacctggccttccaacataggcttaagatactctcttcctgtcccatccatgaactgcaagctggtgtatagagcttcctgaagtcacatgatccagacaagtgattaccaattttattggataccgtatctattagtaaaaaaaaaaaaaaaaaaaaaaaaaaaagtgcaagcacctccattacgtatatttattttcaataagttatgttcttgcactattatgtcaaaatattatctattttacaaaatacaagaaaaagaaaatttgtgagcggataagaaaaaatataagattttatttccatacctcaataagttgtcctgttcacgcctgggcatatgtctaggaattacctgttctgagccactttttaggagactgttatgttttgcccccaaagactagtcagggcacactattgccaatatgcctggctagatggagcttttcctagtgcctggtgagtggttcctgctcttgcatctatctgccaccttacccacctaccacccagtcccatcagcctctgcttcatcccagtgaaagggctcattgcggattccaatccttatcattttgtcttatgctactgtaattaaataatcaactccctgggacaagaaaaggtaaaagtttcttcaggagttagcaaatggctacaagcaataaaaaggtttagaaggcaaatagaaatttagttacatcattgttatagttgtaatgtagtatgtttctctcaatgggttgcaccagagttcttttttttctacttgtttctattgagatgttatttgtaaaatgtaatttatatctgaggtgtctacacatgatagatgatacataaaattttatctgtgacacaaagcaataagcaaagtagggcacatgtaacaaatggtcctgagacgtatagtgggaaaaaataaacttgtatccctaccttatattaagataaattccaaacagattaagagctaggttaaaaaatcacaaatacggaaaatgtagctaaacatttatctactcttaagataaaagccctcaaattattaaagcaaagaaagaagttacaaaagaaaaaaaatcaataaatttgactgtataaaacaccatgaacaaaagtaaaaaggggactaaaaattggaatatataattacaataaatgtgagctggagaaggttcatctatctaatacataaagaactcttgcaaaaagtaaaaaactatgcaaccccaatagaaaataagcgaagagacaaacagaaaattaacagaagataaatggctaataaaaatattaaaaccatttttattcacaccagtagtccaaaagtgttaagtaaaacaacactgaaataccactttaacctaatatgtggataaagattttttttaatgaaaaacatttcctgcagcagcacagtaagatgagaactctcaagcagtgtggcttggagtgtaacctggtataacctttagagaagtattttttgcaacatatattaatagtcttaaaatagtcatattctttgacatagttattttactaaggaaatattcagagataagccaatgtttcagttcaaagatgttccttgctgataattttaataattgggaaaagctagaaacagcctgaatatccaataattggcaaatacataagttacaaaatctttttagggtgaaacattttgtatccatataagtaatgtttgaaataatgttaagtgatatggaaaaatgctcatgataaaatgctaaattaaaaaaagaaattaaaactgtacaatccaggtaattgctattagtatcatacttgcttggaaaaagaatagaagaaaataactaagaattagcagtgattatttgggagtgtgttgaggttatgagaaatttatatttgtatttttattttttctatacgtgtgtcgtattgtgtgtgtgtgtatatgtgtgtgtgtatgtttaagagtcttgttccatcacccagggtggagtgcagtggtgcaatcatggctcactgcaccctgaacacaatcctcccacctcagcctcttgagagctggtactacagggacacaccataaaaaaataatttttattttttattttttgtagagacagggccttgctttgttgccaggctggtctctatttctaggcttcaagcagtcctctcactttggcctcccaaagtgctgggatttctggcattccaccatgcctggcctcttgctaggtttttaaagaaacctagaatgcacataaattgcctttataataaaaactattttaagggctgggcatggtggttcatacctgtaatccaagcactttgggaggctgaggcaggcagattgtttgaatccagcttgggcaacatagggagacactgtctctacaaaaaaaaaaacaaaaaaaattaaaaaaaacaagccaggagtggtggggcacgcctgttgttgcagctactcatgaggttgaggtgggagtatcgcttaagcatgggaggtcaaagctgcaatgagctgtgattgagctactgcactccagcttgggtaacagagcaagatcctgcctcgaaaaaaaaaaaaagaaagaaagaaaagaaaaaaagaatatgtaagggtcattgtgccttgaatataaatattttgtagattatatgacaagaattttaaattaatgttttcctatttggataaaatataaagatgtccaacaatagaatgtagttagaagctgtgaaatacagaactagaaaaaactttttaaaattcatatggaaccaaaaagagcccgaatagccaaggcaattctaataaaaaataacaaagctggaggcatcaccttgcccaacttcaaactataatacaaggatacagtaaccataacagcatggtactggtacaagaacagccagatagaccaatggatcagaatagagagctcagaaataaaactgcacacctaggaccatctgatcttcgacaaagctaaagaaaagcaatggagaaaacactccctattcaataaatggtgctgggataactggctacccatatgcagaagattgaagctggaccccttcctttcaccatacacacaaaaaaattcaagatggattaaagacttaaatataaaacccaaaactatagaaaccctggaagatgacctaggcaatcccatcctgaacatagcagcaggcaaagattcatgacaaagacaccaaaagcaatcacaataaaagcaaaaattgacaagtgggatctaaataaacttaaaagcttctgcacagccaaagaaactatcaacagagttaaacagacaacctacagaatgggagaaaatatttgcaaactatatatctggcaaaggtcaaatatcctgcatctataaggaacttaaacaaatttagaagaggaaaacaaacaaccccattaaaaggtgggcaaaagacatgaacagacacttttcaaaagaagacatacatgcggccaacaagcatatgaaaaaacccttaataacactgattattagagaaatgcaaatcaaaaccacaagataccatctcataccagtcataatggctattattaaaaagacaaaaaataacagatgctagcaaggttgtagagaaaagggaacacttacaaacttttggtgggagtgtaaattagttcaaccattgtggaaagcagtgtggcaattcctcaaagagctaagagcagaactaccgtttgaccatgcaatcctattactgggcatattcccagaggaatataaatcattctaccataaagatacaggcaaacgaatgttcattccagcactattaacaatagtaacgacatggaatcaacctagatacccatcagtcacagattagacaaagagaatgaggtaaatttacaccaaggaataccatgcagccataaaaaagaatgagatcatgtcttttaacatggatagacctggaggctattatccttagcaaattaacacagaaacagaaaaccaaatactgcatgttctcacttataagtgggagctaaatgatgagaactcaggcacacaaagaaggaaacaacagacattggggtctacttgatcagggagggtgggaagaaggagaggagcagaaaagataactattaggctttgggcttaatacccgggtgatgaaataatatgtacaaccaacccctgtgacatgagtctacccatataacaaaccttcacatgtacccccaaacctaaaataaaaattaaaaaaagaacctgtgaaatgtttacatatttcatatttgactgtggacaaactgctactctgctatactttatttttaaagttgtattgtaaagttgtactacgttccccataaagcaaactatccaagatacagtccagcagagtgcttaatggccataggctttggtgtccggaagtctaggttggagcactggctctgcaacagtgtgcaggtgattttatctctgcaagcctcagcccaactaaccaggtgtgtaattgttttcccctccatggatgccttgtaaatcttattttctaataactgaataatgactgaatatggttaaccatatcatctgggttttttttttccccgagatggggtcttgctgtcacccaggctggagtgtagtggcacaatcacagctcactgcagccttgacctcccagtctcaagcaatcctcccacctcagcctctcgagtaggtgggactacaggtgtgtgcaaccacgcctggagaatttttaaaaatatttttttgtagagacagggtcttcctatgttgcccaggctggtcttacattcctggactcaagtgatcctcccacctcggcctcccagagtgttaggattataggtgtgagctactgcacccacccagccatcatctagattttaaatgccaaagtgataatatggagcagatagaataagatccagaaataaacaaatacccaagtgatactttcattattgctttctttcctaggtacccttgctccccagcataacaacgtgcacacacagtcgtagcccagccatggttcttagcattgcaattagatcatcatcatcactgaagtcacattctctagtcacattatacataaaaatgtcaaagaatcttgccccctctttttttgatgagggagtaaactaggcaactgtgaggtttttacaacataaaattctttgttaactctgttgacatttggaaaaatggctttatgctggctttacagcagcataatctctatttgtttctttaaaaatgctgtgattagttactgtcttttcctttaaaataaacaatagtgctgccaaaggaaaaatgtataactgtttgaaaggaatacattttatgattaacatatctttatatataaacaaaataaaatatgacttctctctagttaaaatcatcttcataaacaaatacttcaggaatagattgttaattggcaagctaattggatgcggtacttgttctgggagcatctttattacttccattactcaaactccctccacctgcaaacacagtcactacacacagcgtactcctcattatcacgatgggatatagatgatgattgaagaaaatgtatgcatttttttcattaatgattttactcctctcaaagggacttttaactctaagtaaagtctgtttatgaatttctgataaaaccaaattattttacattattaaatttcattttcatagaatctcttttctatatctttcttaatgtacttttaggcaaagtcaagttatttttcaaaattgggtttggttagaattttgatcattaaaaaggatattaaattattcttcctccagctggaaatcaagccctctatggcaccctagaaggaatcatcactcagtgaggagtgatgtcataggagtgttgaataaataaatgcttaatgaatacatgagtgaatataagaatgaacaaatctataaggcaaacgaattttgattctttcctatcatttaataaggcaaactaatttaaccaaaggcagaaatcaaatctactggtgtgtttcatgtataaccactataggtaggttttgtcttaaaaaatagaaaagcccaaaataagacagctgattctcaagcaaagatgagaacaaacacaaagcccttccagagctacatgatggaaactgtgcggaaagtaaagactccctcttccagtcaccaacacatgatacttggagaagaatgtacaaaaaactgggaagcacttcagacagactgcccagctctatttgctaataccattaatgattagttcacataccaccctcctatttctcaatcccaaggttcactcagatgtctaccctagttttccctcctattttgcttttgatgtggattgatttgaataaaacatttaagaaacactaatttagagtaagagctaaatgtctgttttttaaatggtgtcttggcttaaagatagaaaagcagtcattaattttttgtcctaataactaaaaatgatgtcaagcagagcagatggcaagaagagtgcttgtacagcactaagcacctcatggtgccggatgactcaaacaaagcacaggtcaagaagcccctggcctgaccaacattggtcagaggagtccaggaaaatacatttcttcttcttcttcttttttattttttacatttcttcttctttacattaatgaatcaaattttcaattgaaaaattaattagcacacatagtaaaatttccccaagtttaaaatggtgagtactcagcccccttctacctcagattccaaacgtgtagccacctcttcctcaaagctagcaacttctaccatcaccttaagtgcatacgcagaaagatgcttttgagtgaaacatatttatgtatgtacagtcttagcatatttttccataactgggaacattgtgccttaacttttccacttaaaaatacaccttgactacatcaataatgatgcagccattcaagagaataactttctgctgtaagaaacatgagaatgcagatacactggaaaataaccaaaaggttaaacttagagctaccatttgtcccagcaattccactactaggaatatacccagaagaaaggaaaatatatgcacacacaaaatcttttgcataaatgttcattgcagcacatttcaaaatagccaaaaagtgaaacaacgcaagtgtctatcaactgatgaataaataagcaaaatgtggtatattcatataatggaatattattcggtcctaaaaaatgaaatctgatatatgctacaacatgaatgagacttgaaaacattatgctaagtgaaagaagcaagtcacaaaagacctcatattatataattccatttatatgaaacattcagagtaggcaaattatagaggaaaaaaacgtagattagccgttgcctagagctgtggggtggaagggaggcaggtgatatggagcaggtaatgggggagatggagggtgataactataaggtaaggggtttcttatagtggtagtaaaatgttctacattgattttggtgacggttgcaaaagtgtgtgaatatactaaaaatcacgaaattatacaccctgtattgatgaagagtagggtatgtgagttatatctcaacaaaggtcttccagaacaacacaagaagcttctctatgtattgacacactgtcaagtgcaaaatacaaactgcagaacaatgaatgtgcagattatacttctttttgtttaaaaagggaggaagagaatagaatttatgttttcattgcacttacataaactctaagagtatatacaaagaaaactagtgaaaatggatacatgggagtgtgcatatcttcttttcaaagtataaaaataatacaatagtaaatgtcatctggagatagtgtcatactagagaggtcttcctcatagatgcacagtattgtcttatagttgtgcatcagttgttcaatcagccatataccgattgacatttaggctttctccagtgttctgttacaaaaactccagcagaacatttttgtacatatattttttgcacctttacacaagtacatagagtaaatgttaaaaaatgaagttgctagataaaagatagacaagaaatccttaaagtaatgcagctaaagaatatcccttaaatttgttgacaagtatagtagctgtaaccccagtagtattttattgcaattactgagcaaaatacactttctttctgataagaataaatgaaaacaggatttccccattctctgtagttagagcattaaaaaggaagcacaataacttccttttaaaagaaagtcagacaaaaaccaaatggtttattctatgtaagctctggaagttgagaaagagaagcctccttttaataggcatgaatttgtttgaattcattatgtggcttctcgagtgctctgcagatttaaaatgacctttcagcctcaaagtgggagtctcagagcaaaaggatgaagagaatctgtttcaattaagataaacatcaactaccaagccccaattataccatttgaatttgaaaaaggcaaaactgttgtcaaaaaaaattggaaagcatcaggacagcagtaaacctggtaaaatttaattgcatcacgttttgatgatgttactgagtgttcatggaacgtagggctatgtttggatgcattcctccttttccttccctccactctccctggctcattttggagttgtttttgagtgattctatttagctgcattggcatctttacttaaatggacatatctgtgcagagaaaaccctgttattcattatggtcaaagaatggtagatattaactaacaactacgtaaatatactaaaaatcaatacattatataacctctatagatgaaaagtatggcatacgagttatatctcaataaagttcttccagagcaacacaagtagcttctctttgtatcaacatactgtcaagtgcaaaatacaaactgcagaacaatgaatgtgcagattatgctccattttgtataaagaggggggatgagcatagaataataaagtgatacatacatctttaataaatgttatgatgttgaaataattacaatgcaatacatttcatactaaataaaaatcgtatttagttacttttggttgttattgttgcttttgtcatgattttgctgttttgtgaccaaaaatatacttgagaacttgcatacatgaggaaaatgatcgtggcaatgatgtgtgatgggtttcagttcatacaggccaaactgtgtttgctgtttgaagctgatggaacccattcataaactccttaagggtggccaggaaaaagaacaccacatacatcctgagcagtctttccagtaagaatatcagtacctggcctttgatatgtgtggctgtcatgctcatccctactgcagtttggggaaccacggcttacatctgtcttttgcatcaaccatgtcattcatccagcaggcacatcctattaccagctgaaggccaatattacattctttgggaaaactattccaaccatttggtagaatttttttttactcacatatatctactatccaattacatttagaactcagatcagaggcaaatttagctcagagaggcattagaacactgaaatctatgcacttatggcaagagagaattcagcgagggttgcctggtgtgtcacttgctacttaaagtcaaagtgagatcttacacctaataaaaatgctcttgtagtttagcaagtcaaactcttgggagggtcttaaactttgtgtaaagagaagggatttacagcagcagaacattttcaagggcacttttatgtcagaagcctttccttttttcctaggtgaagtccactctctctgacctcggctcaccaaggcccctgggaagacaggctagcaacagaaatcaggtcagatatgtacagaaaacaccccagtcaaagacaaacactggagacttgtaggtaggaaacccatcatttcacgttgtccaacttttcactggaaatctatacatgagtgccatataaatttaagttcttaagacagcaatctttcacttcttttcctttttaagtgattgaaaaagatagcctttctgctcctcatatctgctggatattcaagacctttgtacctgctataatccccttctccccaatgtttgtttgactggttctttcagttctcaacttccctgaccactccaactaaagtacatctctaggacacacagccacaaagagacacacagacacagacacacacccatacacagacatacacaaacacactgtttaactcggtccctcctgtgttctcttcactggacttaaaacacaattaggaataattttatttagtgaatttgttttgcttggtaagctccaggaagggagggaggcaccattgcatctccagagcctagcacagaaaggagataaaatatgtattttttctgtatagaaactaccctaaataaaactgtagaaaattattctaaataagaatcttgctgttgaactattttatatataaaagtatatttatttcttatcttcttgtatcatctttgtaggctactattaaaatataatttacatatctctaagaactgagatacattgttatatcagttagaaatatatatcatatattatatatcatatagataacatatatataatcatatatcatatcatatatagatatatatatcagttagaaatatcagacatttcagtttagaaatagcatatttctaaataatatacaatttagaatataagatatatatattttaagaagactatgtcaaagaagtttcaaggccagatttagttagaagtgatactgatttttttccacattcatgtgactttaacagaataataaatttagattaaatctaattcatacttttattaattttcaaattaaggaaaaattaagttttacctagaactgttaagacattttcagtaaactttccattatcatttcacttgtgagagatcatatacatgtcatatcatacaccattttgtaaatggttaaaattctcacattctcaaacagtaacttgttttaagactaacatgaaaacacaaacataaacaagaaaatattaataggagtttttcccttctaataataaactggctagcattttttttggtttgctgtgtccctaccattacttcaagcactttccatgtattatttcacttaacattcacagaaaccctatgggtagcttttcccccttgtccaaaatcacccagcatgtaaaagaagatgagttccaaattcatttgacttcagaatccacccccatctctccagtacatattgttggcaattccaaactgccctggaattttaatagctcagctctatgttttcctacagcctaacaaaatagaaatactttgaatgaagttaagcacataaggtctgacttcgaaatgataccaaggtttaaaactagccattaacttttacatggaacaaaaaggaatatttataaagccatacagaacatggccatctggcctactcctgatgcaagaagctgaaacatgcttctgaaaactaagtgctttttatttctttctttagaattgttaaaagtttcttggataactgagaaaaaaaagaacctactttctcttgaggatgccagagtaagtatctttcatgtagcattaatgttctatttacccatcaaaaacaagggttaaaagcaacggttacacagagtccctccccaagcctctcatatataatcagaaatatcctaagggaccaattattttctattactcctattagtcagaaattcacatattgcaaataataatttcttctctccgtcggtctgaatgaatttattcaggatgttatactaaattagaaactgtgaggattatgaccaaacaagtttccatgaatttaacatttttttctacaaaactttataggatttcacaaattccagcatcagttgatacacaagggactcccctttctattatctgactacctgaatctaccctgtcttagccaaaatagattatctgttactcctttaaaaagattgtcctgagagtctttttttctttttctccccaagttggttcccattctgaatttggacactaacgaacatagaaatcaaagactgtaaagcaactatttattcagaaacatttcagaagacactaaggtttttatttagtattcaattaagacttgcctcgaaggctgggacttctttatgtgaatttgaaatttacagggtatgtcacacctacgctatatttaggatgcaactgagtgaagatgaaatgcctaaagcaattggcaccaagggaatttggtactttaaacattttggaaagcccaagattgcatgtgtagttacatttcctatattctttctctatctcttttatacacttaacacacaaatggcatgaattacgaaagcaaatgtgtttggcactttgaacaaattatccatcttattgaagtaagttagctaaaacttttctttgtgtattggaaatttagacaattgtttgactattaagaaatgatccatgggaaatttgaaagataaacttctgtactttattcaggaaattactaacaatttataagaaagtcaaatcgtcaatataacagaaacagtgaaaaaccaaaaaaaacaaagcttcaaaaaagctaattacttaaggagggatgaccaagcatataaagctaagagaagggagaggttcaaattagaaattaatttagaattcaattaaaatcttataagtaacgtttataaagcttacaaacaaaatcttacagtttttcccgattactggctaaagtttataaaaatcatttatggaatttcccacaatatacaccaaaaaaaaaaaaaaagcagaggatagtaaatgggatgggttttaaagtcagactaagttcaaaactagccatatagaactggagctgctgtaactgcacacaaatggtatagtagtccagatgtatgactggcagtcatagaataatgtggttcattgtgaaagtcagataataatttgatattttgttgtaaacaggttttccattcttgcatggtgcccttttatggcagttgtaatccttaagggcaggccttttaactgaactacactaggacataaatgccatttccttctgatttcctgcattgaatctggtctttgatagtccattcgaaagtttttgttagatccctatttgatgtaatggccttacttattaatgcagttatagccagggattatgcacagtaacaaaggaatatataacagcactcaagcatagtaatagtaaaatgagtttatttagagagctgacaaacaagctagtagcagttatttatagaaagaaaaagtttatttctcttattagtgaaatagagcctcaagcattcaaaaaatattttaactagggcctataaaaataaaggtctcccgaagattatctgtaaagacagattttggcaataagtgaaataatgccttatattcattttatgagttaattttgtataaaattcacttttttccaactattttttcctgatgtgccctttttgtgttccctctctacagatacattaaaatgttctactctgtatattttatctttgaaaactcaaaggctaaattcattaaaatgagaaagaaatctgttggttttaaaatttatttaaataaaaataaatttaaatatttaacttggctgacacagccttgttaggaggtgattaagtaaacaatttacctagaataaaaatatctcttattaaaatggcatggatttccaggccagtaagaaaagaaaatatctctctaacccagggaaagtattttggtctaaaaaatcaaatattccagatttattttatattactccaccccaaattcaagtagggaggttttaaaattatgttgtttaccactggatttctggaagcaactgaaacacttatataaatgcacactcctaccaggaaagtaaaaactattccaaggatatagtagaaggtgaaatagaagtctcctgccctatagaaatacttcagaaagtcactagaccataaattttatgaagccgagtgctgtatatttcaccattgtctctctaacagccagcagggtacctgtggcagaacaagcttaataaacacttaaataaagcaataaaaaatgcacctttacttttgtaactaatagacccacagaaataaaacttttctttaaggactatatattttaagctatagaactagactaaatgatcaggtagctagaaaatgtttctgtacaatactaaaacaaattacttcctcattattaaggattaagccttaatttccttctttttttttaagcctaatttcttgccattccaaatatttaagtctgggagtgtggtaaagctaaaagctggcttcacaatcggaaaagttcacaatacaagaaggtaagccaaccctaagttgttccctgactttgaaggtcgggggtcaatccctgtgttagggctccaggacaagcttgtcactttggttcagcatccctcctgtggaatctgctcatatgtgacaactgtgtggggtttcaagatgcacacaatgaggttagagtgagcctgaagtggtggtcttagtacttaccaccaacagatttcttggcttcatataaaaatcacccattgatagagtcagaaggtcagcatgtcagtcgggtgataaccatgtgcaacacatttatcagcatttctatatgcactactctttactagtttatgacacgagaagagtcattcgagcagtcagaaaatatagaggaaaacttggaagtatatattttagaatgggaaacacaggaggcaatggaaggtgtgcctagattagaattgccagtggtggtggcaaactaagggtgaaagaaagccacagggaagaggcaaaaatcctcccggatactatacaactcttgccataaagagtaactactgtgtctacaactcacccagtacaatctcctgaaaagtgccatctactaaaagaaaattaaaaataaaaattgactgtaatattctttgtaatatggaagaactcactgttctactttccatgcaaaggacagatgttgaatgcccatgatggagcaggcatggtgctgggaacaggggttcattgctctacaaagatgagcaaacccagtctactccaaaacatgctcacaggagaggtacgtgagacagaagacaataattgtaatccttcaagagttagagaaatgtacaaggtttcatgacagcacagagaagagagttttaattctaattggggaagtctaggaaggcccttcagaagaaatgtccactgagggtgaatctaagcaacagaatttggatattaaatcatactaaaataattattgtaaaatgacaacagtttaaaatgctcaaatagtcatatataccaaattattatttaaatagaaaatctgatttttaccctgaatttgtatctcaaacaaaagtttgcttaattacctatacttaagtgagaatgaatgaaccatatccgcatcaacaagggatcatctttcaaacataattttgcaagggggtgagggaaacagccaaacacaaaagagtacatgctatattattccttttatataaaattcaaaagcaggaaatttaaaaagtttgtgattttcaaaatcaggatcactattatttttagtaggtgggggcaggggcttaaaggggcataaaggtgacttttggctgctggtactatttttaatctgggtggtgattacaggggtgacctttgaaaattagaattacttatttttcttctttgcatttgcaacatccaaaaagagtttttctgtttacaatatttatatgttcttcataggtgacaaatagacaaaacatatcaaaaaatacacatgtatttgtatgtatgcataaaacctgtttctgctacaatgactttatttgcatgcaaatttaatggtgagattagatatatagagttatgatgagatcatcaaggccatttaaatggcaagcagccacactatgtccctcttctgtctggcagagatcaccaatggatcacagcacattttctctgagaccaacgcagctctcagtacattattccaggcagctactgctattcgtaattacaagttgcccatagattaaaaagactagctatcttggttttaaacaatgcagactgtctaattcttttgatatttacatgaaaaagatcttgcaataatggagggatttcacatatatttctaggtaaacataaaatttcattcctatgtacgtaaaatgattttttcagttacacgaatacctttaaaaagttgtctgctaacatcaaatttgcttttttgtgtgtgttttatattaccctagaagctcttactgattcatatactagtagactcttaacgaaacacagaaaagtaattgggctatctctttttaaagcaaaacactcagggaatctttaatggttaattttttttcccaagctggtgaactccaccctcaatcacacttaatccaatgtgcagttgttaattataacaaaataatgcttttacagtttgttttgttttgttttggtaactactcataataaaatagtagatatcagagacaggaatgctaaatgcctgctctaacgtattgcattcttgacatttctagcccctgtggctgttcagctcatcctaacacttcacgccacaagaacagacctaaccagatctctatttttgtctgttgttctttagaaatgatggagaaagcatcttaagccttctgcactgagctgggatggcgggacaaaggaaaaaggagtccttctcagtctggtctgatagagatgatgaggctcagctccagggagataataatctgtgaattacacaaccaggaatgcaccttaggactagaagagtaagggatttgtagaggtagagaatgcctggcagtgtgattaccgtaggaccaagccacagggtggcacccagtaggaaagatacatggagaaagtctttacaaaggtgcacctagagataatgctcaggtagctgaccattcctttcagatgaaacccctgcctagttgtgcttccttagagggttctcattgagttttaaataactaaatcagaggtggtttagcttcccactgaccacttcttattttgccacctccactaagtagtttacttctttgacccacctagatagcagtgtgtcttctttgaatcacactattaacgtgatttatctggaatacctagctctatataaatgcttaattctgactgtgttaaaaaagactaccttatggaaaagaaacccttacaaaatgaatcagctttcacatttagagttcttgattatttagaaagtcataccaatgtgtaaacttcaaaaatgcataatataagctaacagttcctggtcactcacaaggagccagccatgtgctaagcacttcaggtagatcaactcattgaacatattaacatatacatcattgctaaaggtaacattttataattaagaaaatatgcgaatcatgaaattatcttatttgccactcaaatttaggcaagccactttacttcattaggcctcagtctgaggaataagactaatgagtactgtctaggattcatcatgaggatctaatgagataattaggtcaagtgaacagcacagtgcctggcacatagttaagtacacaataaatacaaattgccacaatttttaattcagatgaagactatattgagaggaaagaagtaaatttaaaatttcaagatgcgaattacagctacttacttagctatatgacataagtttaggaattacattatagctcaatacaaattataatagaactgctttcacacatttgcctgacagactaatttttagctctctttttcagctcaaacttcatttttgaagttaaaaaaatatttctccagccaggcatggtggtgtatgcctgtagtcccagttactgggaaggctaaggcaggaggattgagactaggagttcaaggctgtagtgcatatgatcacacctgtaaatagccactgtacctcagcctgggaaacacagtgagaccctgtctctaaatatatatatatatatatattcttcaacaaatctttttaccacttaagcattgacattgtttttaacagtttttcttgaccctacttgactggaaatgttaaagactagcaaaatgtttccagctccacattggggttaggggtggggaaaatcagattataggttattctctgtggtctcttttatttcaaaggttttatggtgctactaactggtcaaatgccagagagaaggaaaactgcaatttatagtctgaccagaggaagagagtcaataagctgaacgagtcaggaactagctagatctccaaggaatggagccgtgtcaaagtccatgttctatttctcaatatatctctagggctcacggttggaggcttgtatacaaatcttggggggaaaggcagacaaataccataggcaaacatgttcttgatatacataagattaaaagaagaaacttgaacagtctaggacaggaaggaaaagtataagtagcagcttgttgactacttttctaataccatgaaacagaactatgtgtagccaaagcagtttagatagtgaggaaaagcaaacaaaacaataagaacaacaacaacaaatatgggatgtagtttcgacagaccaagatttttctgcagcactgtaattttataagctgtgcgacttcaagttttattcatacagtttattcatacagttgcttcaactgtatatagtactaagttcattgtctgtcaaagagtagatgcccaatacattgtagctatcattaatgaggttatgactccaactatgactatagacctagaagctgctttctccagctagctggtgatctagctgccaatcagttacttgctattctataacaaagttgcagtatcagagcaaaaatcacagcccgctgttgcctatcccatgttagaatgccattggttaaaagtggacacattttacagtaatttatcctgactaaaatagtatcagtcatataaattccttgatgcaaagaaaaaactctgtgccacattgcaatggaatgacatcctgaatgttaggaattattattttctgtattccatatgaatgtctcaagcaagttcactaaaaagagctcaatttctcatctttgatgtattttaaacaagaaagagaattagatacaacgggagcacttttctctaggaagtctgaaaacaattacatactgaaattatgtttaatgaaacatttattttaacaagtcacactggtgccatctattttacaatttagaatgaatattttgcaatatgaaatgaaaaaagaccaagaagtcactcactagcagttttcaaaggccataaagaagaattggtttatctattgattcactctcattatatctactgacaactaagaggaaatgggttagaatttaagcaaagaagatttgtattagatataaagaaaacttcctaactctgtgggtttaaaacaacaggactgcttcctataagggtactttggaagatgcaatccttggtgtgcatacattctacacctagtttctagttttctaatttcttattcttcctcatgtgtagtagggaaatggaagggcttgcaggtgaccccctttaccctatggcagaaattcttagggctgagatggggggcaaatgtcctctacactgagtttcattaatggcagcttttgcccagaggttgccagtgttattaaacagggtagggtgctagatggtggatgcttagttcaaactgggctggaattcttccatattggtctctgtataatctcttttttcttgccacacttccccagctcttctcttgaaatattcccttgtgtttttctaactcttattctgaagagcagttcacccttctgttagcttctctaattcgcatcctcagccatcacccaggatgctcattagggagccaatccccttagaaggcttaggacagataataaatacttacaatattgcccctgtcatgctaaaaaactgcatccataggttctggcattcttcctactttccatacttttgaaatgctttctaatttaggtcaaacttgacaaagaactaggcaatttgagagctgagacatatcactggcacgggctctcattagttagttacctgtacacagttatatttaacagtgtctcacccaggcttgctgtcattgtgccccatgtggtaccccagcccttcccataggcaccaatccctggagagatttggtgcttgtggctgaagtataccttacttctgtccattttctaatataccttcaacccctgtattatattttgagatattggatcacctctggaaaggcttccaagaaaatctatattgattttttattaagactgtgctttctttgtgactatcttccttaccaacctagctaatatccctcaggccctattctctatacctttatctaaactttgacaattctatatgtttagtattagtattattgggaatatttatacatatcgctcagcatctttccctaaaaagcttaaaaactccttaaaggcctcattaatattcttccccttcagtttcatcttagaatctacttttctcaatcttgctagtaatggttgggtggatccatgactaaccattcgtatactcatggttaccttcatgtcatcatcccttctgattcaatagaattcactacatgattggaatgattgacagaggaactactaagtgagctattcctttacctctcctaaaaggcaagttttaatgataaggccaaaaccatggtgtgcctcagatccgtggggaagaaaaaaaaaagagttgcagtcaggactaagtattattgcacacataaccacagccagttgacatgatagaaaaagagggtggagaaccccattttgaaataccaaaagaagcgtcttgcttctgaagaatttcataccaattcagcatttctttaccaacaaccatactcacttcctgaattatcagctatgcatcatacagtgtttagtgcatgattttctcattccagatgagcctaaaataaacttgtaaaaaataagatgctaaataaaatgaatagatcttaactattatagtgataactcttctgtgatatctcagaagtgggaaaagttacataacttcaaggtcttataaggcagaggtatttgaactgctacattacctacgagtttatcccaatccatatagagatacagaatacacaaatgactctcccgcggtaaggcagcactgcagagagtaaaactgtaagtgatcttaacagtcattagcttagtggttttcaaacaatattccttggaatcctaaagtctttagaggtattttaaggagagggtttgaatttggggtggggggtaaatgtacaaactcagtggctgttttattgttttatgtgtgcttatactttttacttatatatttcacacatatctatgtttttaaaaattatatctatatattgaatttatatatgattttatatctaaaaattacagtataaatattcatttatattaacttcaactcacatttcattaataaaaaatgtcccattgaaataaacgtgtttaaaatccattgacctgccttgccccttttattttacaggacagtagacttggcttcagagggactaggtgactcctccagggacacagagcatgttagaagtacagtggacaaatggctttttccagggaatctcatacttcatgactttaaagagtaaacctatctgtgatccactctgtgtctttctagttatgttttaaatacatcaaatatttcaaggtatcttaatcatttctaaaagctgtatatctttaagtatatttcataacagatacatcactaacttgggtaataggaccaaaaaaagtttacctcatgctcaaaaccctgaaccaactttgacagtagtcacatacctaaaccaaatcataatatatattgcacaggcagaaaatatgagaattccatttgtttgcgtatttacaagtttctaagatagaagaaataggaaggaagattgcatatttttttcaaagctgatcttagatgtcatacaaaatctgatatgtactacttgtttccaacctgaagccttacagagcttgcagagaacagaaaaacttggtaatagaattggaaagataatctattcaaaattgtgaggcattggccttttgttctttattgtctgttataaagaccagaggaccttatttgctaccagtagagaatataatggtctacaagctgcaagagcctttcacaaagctatttttcaacaaccaacagtctttcacaaagctatttttcaacaaccaacaacgtcaaccctgaatttcataggctaccatacttccgaaaagaaaactgccaaatactgtaatgcatctagaaatattcacaacatgaacacttttatggccattaaaaagataattatatccacagtagaggaaggcaacaagctgaagaaccagagcacgttctttgaggtagacagacttgggttaccccagcctatgaccttgctcaagttatttcatctcacggaatcattttctcacctgtaaaattaggattaacaactccttcttttcaatattgtaataagaactaaataatatatatgtaaaattcttgatagagctctttcataagacactcaataaaatgaaagctataagtattagaaaaatggattttttttttttttaaattgagacagagtcttgctctgtcacccaggctggagtgcagtggcacgatcttggctcactgtaacctccacctcctgggttgaagcaattctcatgcctcagcctcccaagaagctgagattacaggcatgttccaccactctggctaatttttggatttttagtagagacagggttgcgccattttggccaggctggtcttgaactcctggcctcaggcgatctgcctgcctcagcctcctaaattgcaggtattacaggagcaagctacgccgcctggccaaaaatagaaaaatattgatatgttaaatgaagaagcagagtacagaaatagtatttacagctatttaagatatgtaaggtaagttgaaaatgagaataactgaggatggaataatggggttaatgggttattttccttccaacatattaatgttattccatctttttgattctcaattataaaattggacattttagcttatatgaatgctttccactgtgatcatgaggccaaaataagaatgctaagccagtctagatttttacaaccttaagagaaaagagctaataaaaaaattataatcctccattggtcagagttgcaagaaaattcagaaaattgtatccaaccagtactgaaatactcatttgcatattatataacctgagcaaattgtggtttaatgtctaagtagatattggcatatataaagatgagcttgctaatacatatagtaggtatatttttaatattttaaactttcatatataatactttattgataaaaactacatacaatatgcaaatacagtgaagaaaagagaggcagtcccccttaccttcactcctaccatttttttttttactcctaaaaaataaccactaccaaaagcttggacagagtcttccagaattttttctgcatctacaaacctaagtattacatgtatacttattacataataatacttataatgaaaagtataagtactattacatatacaataaccaattttaaaatttgctttaaaaacaaccacagtcatattttgaacagtagcatctcttttattttcagattacataatgaatgatcttacatgtaacacataaatcctaaacactgttctgtcagcaggaaagaaaaaagtccacttccattgactaaacttctctttatatttatatttgtaagactaataatgttttacttacttaaactaaatcacaagtcttaattacattaatgagaagtatccctgggaaatgtttataaatgtttataaaagtgttaaagagatatcaaggaatatgtaaggtaatattttcatagtatataacaactgactaaatctgaatttaagatatgcaagaaaggcaaacaattctgcaatcaatgaatctgctaattttattagctttatgagcataagaaaatatataaagtttttctcaatttcatgcaggcacatttttttaaaataatgcttaagaataaatactataatcactttctgctagaacgtggcatataaataactgttccttaaataaaagcaacctagtatacacctttattaaataaaccctaaatttggacacctatgttacaaagagacaaatagattaattttaaggttatttgtattttgtcttgaaattaataaaattttaattataacaggctgacctttaataagaggaagggtataaaatacaagtttgccatgaaatcccatttaaaatgtgaatatctcatagcaatttaattaaggctgtaaggacaagttagtgtggactgctttttatgatacttggagagaaacaaatagaaaaaggtaaagaagtaatccaaaacattggattcttgcacaatacaacaaacttccaaacgtaatgtttggctttagggaatcccggaggacagtagacagatttggagaaagtagaccaatggaacacaaaatagatttatgtaatcagagtgaagatggtaaagccagaaagatgtgtcccaagaacaaagtattttggagatcaacctggaaacaaataaacatctgaaaaagagataaatggcaaagttttaggtctctctcatgggaagtcaactgaaaaggaatgagggtagggtggtggtggagaaatgcagacagcaacactggtgagaaaacattgtccctctgagcaatttgaggcctgtggcctttatgtgcagaggcacaagaagagaggccgtttgggtttttttaatgctcaagtaaacatgtgtgtgtgtatgtatgtgtatacatatatatacacacaaacatatattttctctatataccaaatctataatctatattgattttatacatgtaattaaataaataaatataatagatgtgtctaatatttgactgatagacggataataaaatggcaaaactgttactacagctgattataccctcaggccaaattttttggcagctgcagtgatatacccaagcggttatattattaagtcagatgtaagattaataactggagaggtttctatagtgtgtagttaaatctaagaatcatgcatatatagagagagatttatttcttacacagaaatcattctatccccaagtctatggagaatatttttagttaaatggaaaaatacacacattaacaaatcaaaatatttaaaaatgcattttaaattgtggcttgacttatgaaaatatcccatacaatttaaaacaaaaaatataataattgtggataaaaatagactatgataatctcagagaggtaaagggtgtcaatgttactcatctcctgaaatgaacaaattatttccaattgaaacctgaatttgaaaatacatctcctggcagtttagacaaaaagagaaatagtttggttaaacactatttttaaagtagtaacatcttttcacataggaatggtataaattataaatgagttaaattcatgtatattataaattctgtttactcatgttggtgatttatattagctatggtaattcatacaaggattttaaggattttccagtatttattgtttgaggaaaaaaaggacaggactctccaaatttgtttgcagatgcaatcttttctttaaataaactcaaggaataatttattgcacgtgttattttgtaagaaatggcaagtaacgttaagagacaaaatcttcatctataatttattaaaactcacagaaatactgcggatggggcaattcttgtttctggttgactgtaaaacactacaataacagcaaaggctaacctatccacaaaaacacaagctaaattcctgacgcaaataatttgagtatttacatgtgtgtttgcctgctcacatgataatgcatattttgctggcctgttttcctcccattctcaaccacctcacttcaatcattgcttttatttccccagtgtgaggtatgattatttccatttcaaagaggtgagcttagttatttataatcaatcactaagaaaaacaaaataagactaacccctaaaatagccataaaagtattttgtaaatacctattgtagaaaaaaaagttactttgttggaaaatactccttaagggccatgccatatgctgattagcatatcaaatcaccattggggaaataatagaacattagaatacattgaaactgacatattttttcatcagagtaaaagcattaaaataaccaaaaatataattactaggaatcatttctaataaaataaaacataagagatgaatgaatgataagcaacttgatatacatttagccacatagttaaattcaagtttgtttcatgtgtatgattaaatataaataacattattaatttctaacacatctgtgctaaaagtgagggtattgcttttaaagacaagggcaaagcctgtcaaccaccagcctgcttgcagcaagcaaagaagataagaaaacaagcaactgaatcaaacactgaaaaatgacaagttttcattttcaaaactcccaacatatctgcaagtttctttcctcctttaaaaattatcatcagataaattgttacagtccaagaggaattaaaaaaaaaatcagcacccatttggttaaagcacatgagtttgggaacaaaataaagaataaaagagccgccaatactgccttctttcacaaagcctcgacatcacacaacttactaaatactcaaggagtacgtcaatcttaaaagagaaaaggggaaaagcatgagagaaaagaacgttaccaaactgcctctgcagtccttagggaacttgtagatcgggatcttggcttcataataatgctcattttgaaaaaaaataaaaaggaaaataagtcttcaactattctgattaatacattctaactgtctttctgcaaagaagattttaaagatattccatttccaagggaggctgcttgaagaaatccaattttcctggagtccatctcctgtcctcggtccagctcatgggcaaggttctaacacgcaggagcgctttcttccttcatactgaatttactccagtactaggctgttaggaagtgacagtttcttctgtgtcttgcaatgccaagggaggaactgaattctgaattgattcttcatctgggtcacaagggaaaccagcatagtgaaagagtcacttgatctcttttttgcaattccatagtaacagctttaaaggtttctgacactcgaagagcgcaggtagagagagagaaaaagaaaatgaccgggaggtactgtaacacgggagagctgtcaaggaagttccatttcagggcaagcacaggaaaacactcctctccgtggagcaaagaagtcagccaaggaacaaatctctccacactttggctgggtgggctgatttacctgcgaaagtaatttctgtgtgtccctgcttagaatccagggttttgtgaatgagaactatcattcaatctcaccaggcagaaactattcctcaagggctgtatgacgtctgtaagaaggcagttcaaaacaccgcagggcagtgagaaaggaaaaaaaaaaaaaaaaaaaaagaaaagcccagcgcccagcctagcctcgtcaattgctgagacttacaaagcaaaggggcggatcagctccagagaccagcactgtaaaccggccaagcagacaagagacctcacaaaacttataaaaccatttccttctctgggaaatgagatgtctgtgttattctgggtaacattccgtgatcacctttacaaggaacacaccccttgccattaagttgtttatttaccataataaacaaatgaattttataaaagtcattctttcaaaaaagtatttcactgaagcactaaaactaaacttttctctttagaagcaaagttgagagaacttgatgacttagcagctgttcattttgagcggatgtaatgaaatgtcatgctttggagttggttgtagagatgtaaattacctcttaaaaattcagcagagtgtaacaggcacccttggatcagaacatactggaattttaaactgaaaaattgaatgtattattcctggacaagtggctgcacgtattaaggctgttcccttgcacaatgttttctaaaccttatttttttttaaaaaaaatgcaaatttcattcatctctacacacaaagacttgggtttgctaatccttaacagctcttcagtaaggaatgaagctttatatcttgtcaatatctcttattatttcgaaggccaaaacctttcccacctcctaaatataaaatattttctattacagtagatataatctaagctgattccaattgctcccaacagaaggaacagttgaccagcctgcctatctctctgaacatctacacagaggatatatactcctctgggtgtgccaacttcaattattttggatgtgaattaccaagtgaaaataatgtaagcattctgattgcttaaatggcattagctagtacgttggttctctagtctgacgtgaacttggtgtttatttagcatttgcagacaggatgttggagtgcagttgtgacccacccaaacaacttggaaaatgtagtacggcatccgccagaggctctggctgcttcttacaacaaacccttcatctgctcccctggtcacacttcaaggtgcatttgtgacttagtcttctttcaatgactctcaggcctcttacggtaaatgccaataaattgctttccacatagttatccccttaagcttttcagtttccttatgactgccaggggacattcacactttcttagcactgtcccatgtctagtatattgctggcattttaaagcaggttaattaatcatgtatttttttggaaacttaaaagttttgtgagactaattatttttaggggagaggggatttagaggaagaggtttaatttttttcttattggaatttaaatgtgggaaaagaaagaacaaaagcaaaccaagtaaaattaggcaactactatttatttgaaacactgttccctccatgtaaggtctaccaaatagcttccagttgccatttcagaaagcaaatgacaatgatcagagaatgtaatgtctgactgttgagttttcaactctccagaaataattagcctgtgttctaccgtcccccagatccatgttacaatgagcttatttagcctgatgctactcccttctctgtcacacacacacaagtttagtgcagccccatgtgctgttccttgcttacttgcccaacattctacatcttccaagaatctttctctgaaaacctaacacacttattgggcatctactaaagactgtataatagtaccataatgactaagaaatcgtccctctcccctggcaaaaacaaacttaagtggggaatctgacaatgtatggaactaaccagaatactcaaagtttttggattggtacatcaaggttgccattacagagaaagaaagatgcgctatgttgtaagaccattgagatttaaatttaagttttgcttctactcctaatatttaaggtagtgacagaataaaaaaaaagtatgtatttgatgttacagagttttatccacttgtaagaccatttctcacatgaacatttctgaaagaatgttttgttatctaagcatcctgtagttttccctctgaaaagcttccccaaatggaaaagatatggcatttccctcgaaattcctgttagcatgcaagcatatgatggcatgcaggctgatgaggaggcctgaatatggggagactggatttaggaaccatgtggcccatgcttttgatccagaagctgcgattatttctcagtatttccctgttgtactgaattgtataatgtatggaccttttactttctggttgttaccacatttcaatagactgtaccatagatgtatacatccattgggtcatccatctgtagatgttttgttgaatcaaatgactatgtcatttgatgtttctgaaacttcagtcataacaccaccttcataattctttccatattagcattccatctataccatgatttgatatttttcttaattgactcactttttaaaaaaacttaaactgaatataaaaggtaactttatatttattctgtaaatagatttaatatactggtataatttgcccccaaaatataagatatattaatagaaaaaaaggagtccaaaataactcctaaagtctgtctcataccactaatggtgccccgatacaacttggcaacacttacatggaaagcgtcaattgcatacaggtagattgtgcgcacctaaaatgtgatctccctttctcttatcatccaatggtgagcgtgacttgtgagacttatgacatttatccatggattaaacattaaacattaaatgaagccaactgaatgaggtgttacggagtaattttactatacaactcaggttttctcaagtattactattttcaaatactctgcctactatcaaatcttctgttctctaaattcctattttcagattacaatagatattctatactttccaatctatcatgagcatatttcttagagccatattatatatcaactaaatattcaggcctctcaaatatgctgaaattcagtactccagatatgtcaaactaactttttagaaaaaaagaccaggggactgcagtttttacagtttcctgctattctctattgtactctaacgttaatgagaataagacactgaactcctgtagcagttcctcattattgagaaatattgtgttattttccttatctggaggggaattttgaggcaatttctagaggtttcttttattttattacacttactaggaatacagttggattcaaggactttcctactggcatgaaccttgcttggagctacatttcttaattcccaaaggagaagtccggagtattatattttgaaggctttcctatcttcagatttcctacctctttcataaactgtcaggttaggataataataataactactaattattaattacctacatgctaagtagactatactttcttaattatacatcacaacatccctccaaagtagatgtgataataataatttcatacataaagaaagtcaacaatttgttcaaaatttttggacccaggtatatttcattccaaagcttgctcttcatgatgtgtatgtgtgcatgtatgtatgtgtatgtgtgtgtttgtgtgtgtgtgtgtgtgtggaagacagaaagaaaagaggaagagaaagagattaaaaaatgctaccaagtttttggaagtttttaaaattcatccatcctctttagttgtacagtggcaatgaattaatataataaaaatggtgcacgtacattactagtataatgataaacatatttaacagctagaaaatgttagatctttaagatatgcaggattaaacaatctaacttcactgtccttgtttctaatttttaggcactaacttttaggtatcataaacactgtgatgagggcatatatgacaacatcatgagtttgttagccataaaatatgataaggtctttgaccatctcacaacatgagtaatggtagtttcctgttacctatgcaacagatgacattttgattgcctcattaggcaatactggttaataaatgatcattttaaaaggtaacaatacgtgagacctctggtaacgtataaatttcaatatttgtcaacaaattacattggctattaaaaggtacagaatactagtttttaaaactagaataaacatttgtgcatggagtcagtaatgttgacataaaatgaattttgtaattgactttcagaattttgcactaattcaatactggatttcagaagaaaaactatctaatttaaaattttctaagtgctgctgtatttcctttgcattctgcctctcctcttgtccctctttcacatttcttgttcttctttattctaaacttaaatgaatctctgcaaatttaacattattttgaattaaatatttaaattttattaaagaaatacatgtaaataatgtaaacaaagagcaatgagtgtaatatcctcaaactccagcattgattcctgatcccaattcatacacaagaatgagaccctagaaaggtgacagtaagttctaagtgcatgggtgaggcttgtgtactgggagttttactgcagtatcatcaagtgcccagtggggattttttttgcctcttccaaatgttactatttgtaagagattttttcctctggggtatctctatttttctagagaaggatataaatatgcttcctagcattctggtgtgggtaggagaaggacgctgaaggtcttactgacacattgcagacattcatttaattgtcctaaataaagttaaacatacagccatccttctcctactctttgcttagtatcccaaagtctctgtcttccatggagagggatgcaaaatatgttgactacactgaaaaagagtgagggcttatggagaagtgtatataatatacatgttcatacacctgctatatttagaactcttccatcttccaaagtatgttttgggcgactggggcagctcagtttgcttcactttagtattgttctctgatttggttaagtcattgaccttttctcttcctacttctatctttatgtattgtggcttagagtcacagacatctcccagtttcctcaaagatgaaatgtacctttctgttttttgtactaattattggtttgagtgactttttaaagaaaaaaatggcataggaagattgtttctccacagttttaaagctagaaatctataagttctactttaaaacaattttctatgtttatctaagcatacgcatttacaaattttatttatcaaatgactatatgtcaactctctctaagcataggtaaatattaagtattttttattatggtaaaatacacatcacgtaaaattgacattttaaccctttctaagtatactgatcagtggtgtaatgtatattccccctgttgcacaacgattatctccatccatctccagaactttttcatccttccaaatcgacaaccctgtactcattaatagtaacttcctattctcctcttctcccagcccctgacaagcaccatttggctttctgtccgtatgaatttgactactctagatatcttatataggggaatcacaaagattaagttgtaaaggtagattcagaatcacatagccagttatggtctagatgtctcattattaaagaaaaaacaattatggaagcacaaagtttgaagataacaattcacaccttgagaaatcaatgtacttgccttatccatcatcaattctttcaaagtattcacttgactttcatagacaaagtcaagagcaaaaatatctttgcctttaccaacatctggtgtgtgtttttaaaaattattcttctaactattttttttctgtttaaatatatacaaatgttatcagtgcttacccagtctggtcacattataactttagttcttatttcaaatttatagtagcttcctgtatttaatcaagtagttcctaactctatataccaatctcaagggataaagcaaaaatttaaaattaacttacttcaataattcttaaaagacttttgaaagagatgaaacaactggaaagaccacattgccaaatgaagccctagtttctaacactgagataaattgagattttcattaaaataagattggaggctgcgcgcggtggctcatgcctataatcccagcactttgggaggccgagacgggtggatcacctgaggtcaggagtttgagaccagcctggcaaacatggtgaaaccccgtctctactaaaaaaatacaaaacttagctgggtgtggtggcgagcacctgtaatcccagctacttgggaggctgaggcaggagaattgcttcaacttgggaggaggaggttgcagtgagccgagatcgtgtcattggactccaacctgggcgacaagagtgaaactccagctcaaaaaaaaaaaaaaaaaaaaaaaaagatgtgaaaagcagcctgtcaaaaataaatgaacacaagatgtgttttaataataatttagtttctgatgtaatgggaaatgttgaaaattgttttattagaaagtaaactctcatcaggacctttaaatttacatttatttgataacatttttcttgtacatattaaaaatgccaaaataatccaggcaactcaggcagtttctccttgatcacagattacaaataagttttctctaatgtaaaacagctgctctgagaaaaacgcctactatttaggaagggtatgtaggatcaagttaagaagaggcctttggagtcagactgcctggttgcaaatccaaattccaccaatcactagttgtttgattgcaaacaaattatttaaccttccctggcttcagtttcctcagctataaaatggagatagaagagaattttctgaggactaaaaaagacatgtaaaaccttagcaaagtatctagaaaatggtaaggaatcaataaataatatctgctattaaaaataagttttaaaagagtaatcaataagctatggagaaaagcagctttaaaacttaaaaatatatgttactgcactagtatttgatttaaaataattggtttgtgcttttgtcttcctttggatcctgtccccttgactccctttacacatagcttgtgtagttttcctgacttctattttacacatctaaggtttttttctcttatctttggattatctttcaaagatacaaaccttaaaatgtcaaagcctgtgatgaaaaaccttctatagcttcatattccttacaggatcaatttcagccttttttgtgtgttaaataaaaacttctaccatttgggttcaatctgctattcagctttgcccttgataactaatttttcccaccctatattgccaaccacacaatctcacacaccttgccccaaatctgctcactttgtttcccctgcctggggaacctctcacctttctcccacttccctgctaagtatatttcctactctgccttcaagatctagcataagtagcagtaaagcccaactaactccaagacaaactcagaagttcagtctccttggattgattcaatctgggaatatctcaggttaattttgtttattataattattattttataacacatttgcagtatatggcaacacacagtgaacatcacagggggattcaaatcccacagacactgtttagctatcgatttggactctgtaagctttgaaaacacattatctctttaagattcagtaccttcttctacaaaataaggacaatatgcacacctagaatcctcccagggttcctctgggattaaatgagaaaacatgctgtccaatctgcaatcccttgctcttgatcactttcagatctttgcacacgcatttctggcaggattatctttcttttcttttacccctctttttgatcaagagttaaatcaggactacgcctcccatcctgctgctctgcaatctgaattaggtgtctggccatgcaaatctctagatgttcatcctaatttctttcaatttatcagcaccatatggtcatcctctcttcatttggttaactataagccactaactaggaactcctactggaaaggattgttttaccattcttggtagagcacaaggcattatggaggcccaaatagaaacctgggcctccataatgctgtgagtttctttgaaaacagggaatgatgatgagcattttttcatgtgttttttggctgcataaatgtcttcttttgagaagtgtctgttcatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcgttagtgggtgcagtgcaccagcatggcacatgtatacatatgtaactaacctgcacaatgtgcacatgtaccctaaaacttaaagtataataaaaaaaaaaaaaaagaaaacagggaatgaggcttctgcatctttgtattcagaatacctagcacaatatctggcttacaaggtatttgcttaacagcagaataaatctttggtcaacggtggtagataagccctttacagattttcttcctgtgcccttttgtggcatttgcttcatggctggaattagatttcaaaaactgagtcttgcctctttcttgtttttcataagcctctatctctaaaagttactttagatgccttctgtgccaaaaaggagttcctacaatagtgttataattaaaaaaaaaattctcccaaagaaaaaggaactggttgccagggtaaagaaatacactggaagaagtcttatgcaggcactgaaccaacgccagcatcattgataagaagcgaaaaattttttgttaaatatttaggaaaaatggccttaatctggagaaactattatgcaatgtgatattcaacccagacagagtatttgaattctaataggaaccttttggaagctcaattcaaagaaataacttttccaggaagagtttccccacattttggcaggacaatggggagggtgtttgtgtcatcttataaaatctgccaatcagtcaccactgtctatgaatgagatggctgtttctctggatgaaaaggctgcatcctggccagtctttaagaaccttatctggagccactactaagtgttgtccaatctgcaacccctcactctcgattactttcagatctttgcatatgtatctctggcaggattatccttcctttcttttacctctctttttggtaaagatgcattagcacattcgtatttgtatcaaccacatgaagactgtatatccatgtactggatgagaggaccgaagggcactaagtgcttcccctacaagttcagtggatgaaccaggtcagaactcaagcctggctggctccagaagagaaatctgaagatgacaggatgaactcccatttattgattgctcaccatgtgccaggcactgggtaagatgttccacatgttctctcatttaacatttaaaacaaactcacaagctaggtactattatttcttccaccacacagtcaagaaaactgaggtctacaggaagttaagtaccatgccctaggtcttacattaggacttaaacttagattacccaaatgaagcataacctggggaaagcataaccttgagaactaaacaaatcgtattttaagtaacatctcaataggaaattttttaaaacttatttaagcaattctttgaaaagaatggtagaatgggtaaacttattactctggacatggtttttttgtgcacatgacattgaaatcattaaaagttagtcactgtttttattctaggaatcacgactttcaaatatttcaattatttagataccagactgcaagtgtactcaaaagtaactcttgaaaacagtgccattaagcaatgactcctcattctgcacactcacattccctggcaactactaacctgttttgtattctctatggacttacctattctagatatttcattaaaataaaatacaatatgtgatcaaacaagtaacttttggaaaaaatgcatttttactttactatgttggttctttccttggaattaagaccatttattttttatttcaaaaacactttctttggatgtatattttcatttaaagttttctttttggatggagagggaggtggagccatatggctaaatagcagcctcccaaaggaacaacaaattgaacaactctccacacaaaaaagcaccttcatgcaccttcataagaaccaaaaatcagcttaggtaccagcttagccacagcagggtaaagcaccaaaggggttctaggggttcctgattccagggcttggctttagatggtatttctggaccttccctggcttacaggtgggcccactgccccaaaatagattcctaggcctggcagcattcaccacaagctgattgaagagcccctgggccttgaatgaacatcagcagtagccagacagtacttgtcgcaggcctggggcagtggtggccacagggagagactcctctgcttgtggaaaggagaaggaagagtgggaaggactttgtcttgtgacttgggtgccagctcacccaccgtagaatagagtaccggtagattcctaagatttctgactccaggccctggctcctggacgtcatctctagacctgcccaggactaggaggaactagttgtcttgaagggaaggatacaagcctggctggctttaccacctgctgattatagagccctagtgccttgagcaaacataggcaggagccaagcagtggttactgcaggctttgggcaagacccagtgctatgctggcttcaggtctgaccctatgcagtcccagtggtggtggccacaggggtatttgtgttacccctcccccagatccaggaaacagagacacacacagagagagagagagagagacagacagacagacagacagactgagactgaatctgtttgtttgggagaaagtaagagaagagaaaaaagagtctctgcctggtaatccagagaatgactctggatattatccaagactactaaggtggtacctctgcaagagccacagtgttactgggcttggagtgctccctaatgcagatattcctgcagtgacccaaaactcagaccacaacacccaagtttcttcaagcatctggaaagcctcaccaagaaggacaggtacaaacaagcccagactgcaaggctacaataaatacccaactcttcaatgcccagacaacaacgaacatccacaagcataaagcctatccaggaaaacatgacatcaccaaacaaactaaataaggcatcagtgaccagtcctggagagacagagatatgtgaccttttagacagaggaaactcaatggaattcaagataacacacagaaggaattcagaatcctatcagataaattcaacaaagagattaaaataatttaaaagaatcaagcggaaattctggagttaaaacacgcaactgacatactgaaaaatgtctcagagtctcttaacagcacaaaacaatcaagcagaagaaagaactgtgagcttgaagacagcctacttgaaaatacaaagagaagacaaaagaaaaaataataaaaaagaaagaggcattcctagaagacttagaaaatagtctcaaaagggcaaatctaagagttattgaccttaaaaaaaagttagaaagagagatgggggtagaaaatttattcaaagggaaaataacagagaccttcctaaacctagagaaatataacaatattcaagtataataaggttatagaacaccaagcagatataacccaaagaagactagctcaaggcattcaatactcaaactcacaaaggtcaaagataagaaagaatctgaaaagcggcaagaaaaaataaagaaaaaacatacactggagttccaatatatctggcagcagacttctcagtggaaaccttatagggcaggagacatattcacagtgctaaagggaaaaaaacttttatctcaggctagtatatcctgtaaaaatattctccaaacatggagaaatcaagactttcccaaacaaacaaaagctgagggatgtcatcaacaccagacctatcctgtaagaaatgctaaagaattctcttcaatctgaaagaaaagcatattaatgagcaataagaaatcatctggaggaacaaagctcactagcattagtaaatacacagaaaaacacagaatattataacactgttattatagtatgtaaacaactcatatcttaaatagaaagaataaaagataaactgatcaaaaataataactacaactattttttgaaatacagacaatacaataagatataaagacaacagaaagttttaaagcgggggacaaagttaaaatgtagagtttttattggttttccctttgcttgttagtttgtttatgcaatcagtgttaagttgttatcagtttaaaataatgagttacaatatattatttacaagcctcctggtaatcgcaaatcaaaaaatatacaacaggttctcaaaaaataaaaagcaaaaaattaaaacacgccaccagagaaaatcacttttactaaaaggaagacaggaaggacaaaaaccatatgaccatttcaacagatgctgaataagcatttgataaaattcaacatcccttcatgataaaaatcctcaaaaaatcgggtataaaaggaaatacctcaacacaataaaagtcatatataacagactcacagctggtatcatactgaatagggtataactgaagactcttcttccaagaggtgggacaagataaggatgcccactttcaccactagtattcaatatattaataatactggaagtccttgctagaacaatcagaccaaagaaagaaatttgaaaggaagaaggcaaattatcccatttgcagaaaatatgatcttaaatttggaaaaacctgaagattccaccaaaacactattagaactgataaataaattcagcaaagttgtaggatacaaaacaaacatacaaaaattagtagcatttctacatgccaacagtgaacaatctgaaaaagaaatggagaaagtaatcccatttgcaataggtacaaataaaattaagtacctagggttaactaaaccaaaaaagtctacaatgatctatcaactatcaaatactaatggaaaaaaagagaacacaaaaaaatggaaagatattccacattcatgaattggaaggatcaatattgttaaaacgttcatactacccaaagcaatctacagattcaatgtagtccctataaaaataccaaggacattcttcccagaaatagaaaaaaaatcctaaaatttatatgaaactataaaagactcaaaatagccaaaggtatcccgagcaaaaagaacaaaactggaataccagttttgaacccagaaatgaatccatacatctacagcgaactcattttcaacaaaggcgccaagtatatactttgggaaaagacagtctccttaataaatggtgctgggaaaactggatatccacatgcagaagaaggaaactagacttctatcttttgccatatacaaaaatcaagtcaaaatggatgaaagacttaagtctaagactctgaactatgaaactactaaaagaaaacattgaagaaagtctctagaacattggactgggtaacaatttcttaagtaataccctacaagcataggcaaccaaagcaaaaatggacaaatgggacaaataggatcacatcaaattaaaaagcttctgcacagcaaaggaacaattgacaaagtgaagagacaacccacataatgggaggaaatatttgcaaactatccatctgacaagggattaataatcagaatatataagaagctcaaacaactctacaggaaaaaattaatctgatttaaaaataggcaaaacatctgaacacacatttctcaaaagaagacataaaaatggtaaacaagtatatgaaaaggtgctcaacatcattgatcgtcagagaaatgcaaatcaaaactattgtgagatgtcatctcactccagctaaaatggcttttatgcaaaagacaaataataagaaatgctggtgaggatgtaaagaaaagggaaccctggtacacttttgatgggaatgtaaattagtacaaccactatggagaacagtttgaagactcctcaaaagactaaaaatagagctaccatatgatctagcaatcccactgctaagtacatacccaaaagaaagaaagtcaaaatatcaaagagttatctatactcccatgtttattgcagcactattaacaatagccaggatttggaagcaatctaaatttctatcaacaggcaaatagataaagaaaatatggtgcatatatataatgtagtactatttagccataaaaaagaatgaggtcctgtcatctgcaacaatacggatggaagtggagataattatgttaggtgaaataagttactcacagaaacacaaacttcacatgttctccctttttgtgggagctaaaaattaaaacaaacgaaggagatagagagcagaagacagtttccggaggttaggtagggtagcgtggagggaagggtgggatacttagcgggtataaaaaaatgtaattagatagaatcaataagagctaatatttgatagtacaacagggtgactatagttaacaatttattgtatgttttttaagcaattatagggtaaaattggattgtttgtaacataaaaaaaggataaatgcttgaggtgatgcatacccatttaccatgatgtgattattatgcattgtatgtttgtatgtattccacaaatatatacacctactatgtatgcaccaaaattaaaaattaaaaaaagtaaaaagaagttttttttttttttttttgaatggatagcttctgtataagggataggaaagcagacttaactatttaacctgaccttgtatattaatttgtgctcttttggggagaaacacagcctattcattccaggcatgcagtgaatgctaaaaaaatatccacaaacaacatagaacagtgattttcagaagaagggatctagtgtgttctctgtgttcttaaagacagtgctttgtctgatatttttgcaaaaaagttgagtcttaagtatggtgcttggcaaaagttgctttatggaaaatggaaggcaaataagcaaaaagagatcatgccaaaatactccctgttttcagggcagattgttattccatatggggaaagaatatgaaaaagttctcccacccaagaccatgaaatttaagccttcattcagttgacagtcttcagtgagtcagattcctgcaggatttaagttactccctggctgactctcaggcatctctgcagatagttaacctttttcttgttatcttacagcaactataaattcttattagagtgataaaaagcaataacaatttaaaacataagctatttttaaaataacaatcttgcaaataggtagtaccttaagcaaagatgttttaatacctttttaggcctcactacttatatctaacatattaacatggacccactttccacaacgtagattatttttgctatcaacagtctgggaagggtctttataattttgcttttgaaattatgtggctactattaaactcatttaaccaatgactggccttgattttctttgcaatcatccagcatacttggagatacttgtaaaataaaaaactcagcacataagtttttttaatttagtaaaatgttaagaatactcatttgacaattattgaagtcgacataatcttatgctttgaacatttaattaaatgttagtcctcattttgcagttttctgtttgtattcaattacttcattttccaggtctcaaatggtttcatagccccatgagacgctcataggctgtagcccctgaggaatgtagtgcctggtatggaccacagaaccctggaggtgggatctggaaagaaagggaattctggtaagaagtgattcatgcaaggagatgtatttagcatttccagatagtgccctatttcctgtagtaccttgataattatgagttaccttcccttgctaatgagatgaagtaagtcatcaagcatttattgttacaagggttttattcatgatccagctcatacttagtatcatagatgatttttagaaagcataaattgtggttgccagctttgaggacctaaaatttagctgggaagaagaatacaattctccttaatgttttctctggaataactgaacacatgagattgcaagatgatgagtccaaggtttggatatatgaatgaccaaactaaagcaataatatggctttcttaaaaaatacagttatttaaatgattctagttgtgttaaatcattcttttaaatacctggtgagtggcttaggaactaagatagagtctgagaagaatagcattgctggtggccccaccaggatgagagtcattattatgatccaacaaaataggaggatcattaatttttcactcattcccagagatgtagttttgaacagggttaggttcttatttcaattagagaaactagaaccatgaaaagaagatttcagccctaaggaaaacagatatatcagagtttaaaactccgattcccattctgctcaattgctcagtggatatggtcattatttttgttctttgaaatggactttgttttttaagattatgtagaatgcattgtttggcaaaaagcacaggatattcaaacagaggcccaataaccaaatgcattttttctccattgcgttcttacctaaataggaactataataataacaaggcctcagtaatgcagagttcttgcccttctgtaagtgggcagggtgcgtgtgcaggtaggtaggccattaggtcaaatttcaatgtctgagatactctcctgaccccatgggagtcacataccactgaaggcaaaatctggctgcagggtcacctgtgttgcattggaggactgtgagtcatctcttcatactcagctctgcaacagtatgaaaaggtcaccacgaccacgctcacctattctggtgaattagacgtataagcagcctgctcccaactccttggagatcatttctgagaacatttgtcttctcaacctgttgctgggcatgactggaagcagaataaatgactacagaatgtttagtttacccagataaactgcttggcagtctttggattatgtaaaattaattgtggaaacttaatgttgaccagtgatcatagtatgcggacagacctacttagaaactgttttgtgtgtgtgtcagccagtgttactaagaatcatttaagggaatgaagagtaaaactcttttatgtaaggcattagtttagcagggccactgcatctctgtgtgagctgtccattgcccaactctagggagtaccatttttacaaaccacagcatgaattgtgctttcagaattgtgcaaaatggtggccctgtctttctgcatctcaaatggtgacataatgtaactatattttccatctttaaatagatcctgaaagctcaagttgaagcactgaggctgacactctgggctacacagagaaagcagtgtcagatggtggtgaggaacaccttgtaggcagaccgccaaggtataagtcccaacctggcccttactccagccaaattgctttagttttctatgcctcagtctcctcaattgtaaaatgagtgaaatcagagtggctgggagaattacattaaatagtgcaggtaaaatacttgaaagaacaatgcacgcagtcacggactcaatagatgttaactcttaagactgtctctcttttgttcaatcattaggattctggaatgaataaaacattatcacagctgttttactatgattctgctttaggaatatttgtggctgtagaggaaacattttctgtgtgcctttatgaaagctaataactaggaacagtttaatagaatgctcttagagaaaatgaaaaatagaattttgtgacagccattaagagtttaaaagagactgtggtaaggattgtctcttctggatgctttcaaatgtaattattggtgaaggctaatagaaatccatggagtttcagatactgatagaaaatgataggcatttcaaaaataaacattaagcaaaggctacaaaattaacattatacctccccatttatctttttttctctcaggtggcacaaaagcttgacaaagcgtccatgaaccatttgaagatttttgttgggataatcagatatctataaatgccattgtttaagaaagctaaccaaataacgttttactattgactaataaacttttctaataatcttcaattttattttaataaaatattagatgtagttcagtttctcaactctggaatagtgacccaggaaaaatatgagggaaacttgaagtctatggaagttgtatttggtgttaactgaggcctttgtgtcagcccagcacaaactgtaaagtcaaaagtgtgactttctctttctggtcttgacaggcttttgttttgatagacttgtcctcatctttaacctcctactgttcttctaggttatccaggtagctcttcaggtgcccaggttgcctgttgcctctgctagcctgcctagttcgtaacatcaggcagagatgaggcaggaacttcggccctcaggcttgattagtggttataaggccaaggatcataggaaaaaggtatcaccttcagattaccttccctgtgtattctgtttttgtagttttcatcagagagtaagcaaccgtcatgtgaatatcgtgtctttaatgatctgttaaaatggcggctctcagagaaagtgctctccattctcctcctcctacctcaggccccctcagaaatcaggctggtggtgttagggagtgaagtaggctaagtgtaagaaaaaaaaaacaaaaaaaaaaacagctttggaatgctgatggacagcaactcatatttgtcctcagtgtcaggataataaggactcatgggggtgggaaatattgtaaatacaaaccttgaaaggaggtagctgctattcagagagccaacatagccaacgtttctcaattgtacagagaaatgtgaagttatatgtgagatctttccactttcaatcgtgatgctaattcaaaatgaaaaaaaaaaatctgactggcctaacaaaacaagtttggggtcggggtggttactaggtttccttttagccattgtttgggacatactgatgtactgctttattaatctccaagaaactcatttatgttgagtggctaatgcatcagtagggtaatatttactttatattttaatattttataagttaatagatataataaataatagtaaccatacagtgggattagtttccaatggtaaacatttcaggccttcaggccttcaggaggaattttgaattgtgatgaaatggcaagtgcctattccatccaggcataaaaccaatcctagccaatttattaaaaaaaaaatcctgcattgttactctttagctaatgattaactaaagtctgagtgactagtagaatgagtaattttgttacataagccagagaaggtggaaggaaactaacatttattcaatacctactgtccactgggtacttcatctatatattctcttctaatcttcaaaacaacactgtaaggtagttgttacaaataaggaataattacaacttattccttattttgcagctgtaagttgatgtttagagaggtcacatccaagtctcttggaccatgcttcttcattatacaaggaatattgatgttgccaaatattaattcaggagctggtacagttagaaattagtaacacacacacacacacacacacacacgcgtgcatgcacgtaaaaagcaaggttaaactcgcaaggttaggcaaggttagctaccatatgatagcttaaagggaagaattctgtgctgataaatggagtatttttctccttaactgagtcatcctgtgtcattgttaggcactgtagacagtacataagttaactgagatctgatacttccttttatcccttaaaaatccaacacagggctcactgtaattaggtataaataggtgacttaacccttcagatctttctggaggagagataagtgtcttatgagattgaaataggagggatcaacaaagattgcagaagaattaagggctagcaaaatctgtcatgattccaaaaggatcaagttgaaagtgaaactagttcacacattttcacgacagcttcagagttaacatcctataaaggaatctatcaacattgtgacatttgtttaggcttctataagtgagaaaatgtgtccttccatgcaatactaaatgtaattatcatgttatctatttaatccaacttcacataaatcccaatgattaaatctactatctatttagaatattatcacatacttaggaagatatatcaataaatacttatgggtccttgtggtaaataaatactaatgtatagatgaggttatacttgccttagagagtttacaacaaaaagagggacgggtagtgaaagacataatgtccatgaaaaccaccacattattgctttatttgcttcacaggcctcatatgtgaatttttttttaaactatagattcttacctactaaagtaaagtttcagtgagtgcaaaatttgactggcttctatcctcctatgtccccagtacctagaacagtgcctgaacttaggaagcactcaagaaatattgggcaaatgaatgaatgaatgaatgacacagatcatgaatgttataatgagaaagcagagaaaaaaaattatctgggctggatagtcagagaatgtttccaggagaggggatcccaaatatggacttttaaagctgataaaggaaggcaatttccttgagaagaatggcatagacacaaaggctaggtaagggcaaagagacacctggagtaatgtggatttactgttattctatcagtaaatcttgatgaaaagacttgaggccatgtaaagaagaactctctaataaaaatggaatgggttcccttggggttggtaggagaggtgatttctgtgaggggaggtactggagcttggggtagaagaacacaacaaaaatatgatagcaggcagccaaccccaaggcacaagtgaaactttttttttttttttttttttgagacagagtgtcactctgttgtctaggttggagtgcagtgggatgatctcactcactgcagcctctgtctcctgggtgcaagtgattctcatgtctcagcctgccaagtggctgggattacaggtatgcaccaccacaccaggctaatttttgtatttttagtagagatggggtttcaccatgttgaccaggctggtcctgaactcctggcctcaagtgatccacccatttcagtctcccaaagtgctggaattacggtgtgagccaccgtgcctggccataagtgtaacttttaaagtttcctctcaccttgggattccaggcctctcttttggcctggttgctgaaacaatttaggagaatttctgaaaattttcaaagtattcataaatggaactttgctttcctcctcctaaatcaagacaaagctcacactgaccacagattatcttaaatttggtgaaaacatatttcagttggtggaaacacaattgttttgcaagttagctccagaagtggtaattgaaagtgacatttaagaaacattttctatggatctcagaagatgattactcattttgttttgaaggtttatgatatgctaaagtgtttttaaagcacattataattaaacaacttgtaaaaaaaatttaaatttccccctatggaagctcctatttcaaatgtagtctagagagaatttcaagtaaacatgtaactgcacatctgattttgtgataatttgctttatactttttaatatcatctttgatgttacatattcagatgtttaaataccaatacaaaaacaataataattttgtttaaattttccaaacacacaaaacaaagagaagcattcattcaaaatacttgtatacacatgcaaacaaaattaactttgtgtttatgactcacataagggaagttattggtgcccatagcctctgaatacccgcctctcaaagcttattattacaaagaccagtagctccttgcctgaaggtttttaattcctgtgagtcttggcaagggctattttctggctgcagttacatgcctggcctgagcataaataacctgggagtggtggattgttaatgacccccggaagcaggtgatggatgaagagttggtgaaaagcaccccagcttcctcatctcacagttgggataactctggggtctgttccacactgtcttccagaacccaacaatggggactgagctcctgtttccctctgtgggaacggacttgatgatgtgtattttttcagagatccttccatttcctgtctcacttccctactcctttacttaggtttcttgaatttcctaaataaacaactaatattccttatattggggtctactgctgcaggagcctaaaccaatacatgtctcttccattattttgtgacaccaaagaagattttgattaggcctagaaaatatacatgaaagctgatcaaaatgagaggaatgattaggtttgtttgtctgtttttggtaaatatggaaacaatgccatttcattttagtaaattgccaagttttctcaagtccctcctatctttctccatatacttgctcttctgtcatttgccttttttcatctctggcatacatacaacctgaaataaaacgccatggggtagattaacgagaaacactggaataaaaaaaaatgctcgcccaggcgcagtggctcacgcctttaatcccagcactttgggaggccgaggtgggcagatcacctgaggtcaggagtttcagaccagtctggccaacatggcgaaaccctgtctctacaaaaaatacaaaaaaattagccaggcgtggtgtcccgtgcctgtagtcccggctacttgggaggctgaggcaggagaatcgcttgaactcaggaggtggaggttgcagtgagcagagatcacaccactgcactccagcctgggcgacagaaaaagggtctgtctcaaaaaaaaaaaaaaaaaaaaaaaaaaggcttacagtgtcacgtgaatcacatgcttattaaatgaatgaaaaatacactttattatttcatgtgtgtattaagaggtcatatggatagatcagatgttggcaaatgaatgtgttatttctagaagaaatagaaatgtttccttatttgccagggcctaaatcagtgtttctttgaaatgagtatattttctgacagtatacttcatgcagacactcccacacactccccatacatgtgtgtgtgtacctgacttatatcacttaataatatgaacagactgaagataatgtcaattaatcaataataaatcctaaattccgagttaatgtctgtgctgttttgaacaaggtttgaccgtcttaaataaaaagatttttgtgtttgtttgtttttcacaaggtttgaatgtcttaaataaaaagcatctaggagctatagggtgtagagaaaactctccctgatggcatttttcctctactctcacaccacaaaaatcatcaacacagatgaagccttctacgaacaaacatgtgaggtttcccccccacaccaagcagccaacactagctgggtgtcctgtaattcagttccaacgctgtctacctggagataatgtcagatcccaccggttgaaggttcagttcccaagactgccccccaccacaccagtcacaagtgtgggcctctggagcttctaaccggccacctccaagttggcatactcataatcctctctttgggttcaattaatttgctggagtggctcacagaacccaggggaacacttacttatgtttgctagtttattataaaggatattgcaaatgttaccgattaagagatgcatatagggtgaggtatgggggaaggggtgtggagcttccatgccttacctggctgtgccaacctccatgaaagtccaagtgttcagctatgtggaagctcactgaaccctgtccttctgggattttatggaggcttcatgacatcagcattccttcccccagggtatagggcagtactctctctggggaaggtcttaaaagccacaatcagaaaggcaggaacaggtgaaaggagagaaggagaaggtcaggggcctgcccctgaggcctaacacacccaacattataacaaaagactgtaacaagggctgtgggagttatgagctagacctcagatgaaaactaatatatatcataacaccacacatagattcaaagatctaagttaagttggtcattagtcaacactatttaaaagccagatatgtccaaatggctcttgaatctacacttattatagcaaatattttaacgtgtagagatgaaaaggacagattttctttaagtgtctgaagccggtaaagagaatttctgccttttttcctctgtaaatctaaatctgtttgaagaaagaagtgcgctgtgaaatgggaaggcaggggtgggcaaagacacattttagtgaggttttaatctccattttgctgagtagaaatagaaaggagttttgaggtggtttgaagggaaagtgggggagagagagagagaagaaatgggagaaccactgagaaggtttaaaatgtcttcatgttacttaggcagataggcagatatgagcagggtaggagagtgccccaaggaatgtcaggcaacagtcaggtgactgtcatgcaattgtcaggggcctccttgggaatgacagatggtcatggctggcaccaagaaggggaaaatttcctcccaaacaggaaacatcttgagcttatgagcaacaacttcctcataagatcccaggaactaagcaaacatgaccaggcatctgcagtaaggggcaaaatggcggagtttggccttccttcggggatatgtccaggcatgctcaagaaggggcaaaacgtcagagtttgcctgatatgtgaccttcctttgggggcactagaccagtaacgaaaaattgtcatggagagcatacacacaacttcagccaccaaacggcacatgcagcccctgacagatattagcaagttactgcgcatgcaaggattagccaacagttcccccaagaaggatgaggggaggagatcaggaagaatcaggatacagtaactctataaaagccttgaaccaatgatcaagcggggcactcaatcttttaaattttccacttggtcccttccgaatgtactttactttgcttcaataaacttctgacttaaatctattactttttataaaatttttttccataagttattagggtacaggtggtatatttagttatataagtaagttctttagtggtgatttgtgagattttggtgcacccatcacccaagcagtatacactgcaccatatttgtaatcttttatccctcacccccctcccactcttccccccaagtccccaaagtccattgtatcattcttatatctttgtgtcctcatagcttagatcccacatatcagtgagaacatatgatgtttgcttttctattcctgagttacttcacttagaataatagtctccaatctcatccaggtcactgcaaatgctgttaattcattccttttcatagctgtgtagtatttcattgtatatatatctgtacaccacagtttctttatccacttattgactgatggacatttgggttagttccacagttttgcaattgtgaattgtgctgctataaacatacgtgtacaagtgtctttttcaaataatgacttcttttcctctgggtagatacctagtagtgggactgctggatcaagtggtagttctacttttagttctttaaggaatccccacactgtttcccataatggctgtactagtttgcattcccaccagcagtgtagaagtgtttcctgatcaccccttccatgccaacatctactgttttttaaaatttttttattatggccattcttgcagaagtacggtggtatcacattttgtgtttttgatttgcatttccttgatcattagtgatgttgagcattttttcatatgtttgcttgccatttgtatatcttcttttgtgaattgcctactcatgcccttagcctactttttgatgggattgtttgtttttttcttactgatttgtttggggtccttgtagattctggatactaccctttgtcagaggtatagattgtgaagatttttctcccactctgtgggttgtctgtttactctgctgactgttccttttgccctgcaaaagctcgtaaagtttaatgaggtcccagctatttatctttgtttttattgcatttgcttttgggttcttggtcatgaaatccttgcctaagccaatgtctagaagggtttttccaaagttatcttctaaaatttcatagtttcacgtcttaggtttaagcccttaatccatcttgagttgatttttgtatacggtgagagataggatctagtttcattctcctatgtgtggctagccaattatctcagcaccatttgttgaaaaggttatccttttccccactttatgtttttgtttgctttgttgaagatcagttggctgtaagtatttgggtttatctccgggttctctattctgttccattggtctatatgtctatttttataccagtaccatgccattttggtgactatggccttatagtataatttgaaatcaggtagtgtgatgcctccagatttgtactttttgcttggtcttgctttggctatgcaggctcttttttggttccatctgagttttagaattgttttttctaattctgtgaagaatgatggtgttattttgatggggattgtgttgaatttgtaggttgcttttggcagtatgggcattttcacaatattgattctacccatccatgatcacgggatgtgttcccatttgtttgtattgtctatgattcctttcagcagtgttttgtagttttccttgtagaagtctctcgactcctttgttaggtatattcttaagtattttattttattttttttacagctattgtaaaatgggttgagttcttgatttgattctccccttggtcactgttggtatatagaagagctactgatttgtgtacattaatcttgtatccagaaactttcttgaattcatttatcagttctaggagcttgctggaggagttcttagagttttcaaggtaaataatcatatcatcagcaaacagtgacagtttgacttcctctttaccgatttggatgccctttatttctccctcttgtctgattgctcttgctaggacttccattactatgttgaagaagagtggtgagagtgggcatcattgtcttgttccagttctcagagggaattctttcaacttttccccattcagtattacgttggctgtgggtttgtcatagatagtttttattacattaatgtatgtcccttgtatgctgattttgctgagagctttaatcataaagggatgctggattttgttgaatgctttttctgcatctattgagatgatcatggaatttttgtttttaattctgtttatgtggtgtatcacatttattgacttgtgtacattaaaccatctctgcacccctggtatgaaacccacttgatcatggtggattatctttttgatatgttgttggattcagtcagctagtattttgttaaggattttaccatctatgtttatcaaggatattgatctgtagttttcttttttggttatgtcctttcctggttttggtactagggtgatgctggcttcatagaacgaattagggaaggttccttctttctctatcttgtggaatagtgtcaaaaggattggtaccaattctttgaatgtctggtagaatgctgctgtgaatctgtcgggtcttggacttctttttgttgataattttttaagtaccatttcaatctctctgcttgttattgatctgttcagtgtatctaattcttcctgatttaagctaggagtgttgtatttttccaggaatttatccatctcttctaggttttctagtttatgtgcataaaggtgttcatagtagccttgaatatcttttgtatttcagtggtgtcagttgtaatatctcctgtttcatttcttagtgaagttatttggattttctctcttcttttcttggttaatcttgctaatggtctatcaattttatttattttctcaaagaaccaggttttgtttcatttatttatttatttttttgtatggtttttttttgtttcaatttcatttagttctgctctgatcttgattatttcctttcttctgctgggtttgggtttggtttgttcttgtttctagatccctgaggtgtgactgtagattgtcttttttgctctttcagtctttttgatgtaggcatttagggctatgaactttcctcttagcaccacctttgctgtatcccagaggttttgataagttgtgtcattattgttgttcagttcaaataattgtataatttccatcttgatttcatttttgacacaatgctcattcaggagcaggttatttaatttccatgtatttgcatggttttgaagattccatttggagttgatttccagttttattccactgtggtctgacagagtgcttgatataattcaattttcttaaattcactaaggctcattttatggcctatcatatggtctatcttggagaaagttccatgcactgttgaatagaatgtatattttgcagttgttctgtatatatctgttaagtccatttgttccaaggtacagtttaaatccattgtttctttgttgactttttgtcttgatgacctgtctagtgctgtcagtgaagtactgaagtcccccactattgttgtgttgctgtctatctcatttcttaggtctgttagtaattgttttataaatttgggggctccattgttaagtgaatatatgtttagcattgtgacatattcctgttggagaaggccttttaccattatataatatccctctttgtctcttttaactgctattgctttaaagtttgttttgtgtgacacaagaatagctacctctgctggcttttggtgtccatttgcatggaaagtcttttccacccctttactttaagtttatgttggtccttatgtgttaggtgagtctcctgaaggcagcagatagttggttggtgagttcttatccattctgcagttctgcatcttttaagtggagcatttaggccatttacattcaatgtcagtatcgaaatgtgaggtaccattgcattcatcatgctctttgttgcctgtatacttttgttttgttttgttttcgctttttagcttgtatttttgttttacaggtcctttgtgatttacgctttaaagaggttctgtgcaaaaatcacaagcattcttatacaccaataacagacaaacagagagccaaatcatcagtaaactcccattcacaattgcttcaaagagaataaaatacctatgaatccaacttacaagcaacatgaaggacttcttcaaggagaactgcaaaccactgctcaatgaaataaaagaggatacaaacaaatggaagaacattccatgctcatgggtaggaagaatcaatatcgtgaaaatggccgtattgcccaaggtaatttaaagattcaatgccatccccatcaagctacccatgactttcttcacagaattggaaaaaactactttaaagttcatatggaaccaaaaaagagcctgcatcaccaagtcaaacctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaacggttctgggaaaactggctagccatatttagaaagctgaaactggatcccttccttacaccttatacaaaaattaattcaagatggattaaagacttacatgttagacctaaaaccataaaaaccctagaagaaaacccaggcattaccattcaggacacaggcatgggcaaggacttcacgtctaaaacaccaaaagcaatggcaacaaaagccaaaattgataaatgggatctaattaaactaaagagcttctgcacagcaaaagaaactaccatcagagtgaacaggcaacctacaaaatgggagaaaattttcgcaacctactcatctgacaaagggctaacatccagaatctacaatgaactcaaacaaattcacaagaaaaaaacaaacaaccccatcagaaagtgggcgaaggatatgaacagacacttctcaaaagaagacatttatgcagccaaaaaacacatgaaaaaatgctcaccatcactggccatcagagaaatgcaaatcaaaaccacaatgagataccatctcacatcagttagaatggcaatcattcaaaagtcaggaaacaacaggtgctggagaggatgtggagaaataggaatacttttacactgttggtgggactgtcaactagttcaaccattgtggaagtcagtgtggcgattcctcagggatctagaactagaaataccatttgacccagccatcccattaccgggtatatacccaaaggactataaatcatgctgctataaagacacatgcacacgtatgtttattgcggcactattcacaatagcaaagacttggaaccaatccaaatgtccaacaatgatagactggattaagaaaatgtggcacatatacaccatggaaagctatgcagccataaaaaatgatgagttcatgtcctttgtagggacatggatgaaattggaaatcatcattctcagtaaactatcgcaagaacaaaaaaccaaacaccgcatgttctcactcataggtgggaattgaacaatgagaacacatggacacaggaaggggaacatcacactctggggactgttgtggggtggggggaagggggagggatagcattaggagatatacctaatgctaaatgacgagttaatgggtgcagcacaccggcatggcacatgtaccctaaaacttaaagtataataataataatttaaaaaaaaaagaggttctgttttgttgtgtttccaggatttgtttcaagatttagagctccttctagcagttcttgtagtggtggcttggtaatggcaaattttctcagcatttgtttttctgaaaaagactgtatctttccttcatatatgatgcttaatttcactgggtacaaaattcttggctgataattgttttgtttgaggaggctgaagatagggccccagtcccttctagcttgtaggctttctgctgagaaatctgctgttaatctcacagattttcctttataggttaccagtgcctgttctggtgcagggggtaggggttggggggcgcaatgggctctgtgggggttcttagctttcgtggtttaatgctctatttttgtgctggctggtctcctgccaggaggtgttgccttccagagagcatcagctgtggtagtatggggaggaaccctagaactcccaagattatatgccctttgtcttccactcccagggtagatagggaaggaccatcaggtgggggcaaggctaggtgtgtctgagctcagactctccttgggtgagtcttgctagggctgctatgggggatgggggtgagattcccaggtcactggagttgtgcacctaggaggattatggcttcctctgctgagtcatgcaggttgtcagggaagtgggggaaagccagcagtcacaggcctcactctgcttccacgcaaacccaaaccaaatggctagtctcactctcactgtgtctcccaccctctaacagcctgagtccattttcagttggagggcaagatgagcttgaaaatctgccccaggctacccacctcccagctgtgaatgaaagggattggttctactccacctgtggagtctgcacgccagatgtgtgccctcccctgagttctggccaggaggcttctcaccccattcaaattgttacaaacttcagctagagattttcttctccctgtagagttttaccccttgcacctctggctctggctgccctctggatggatccctgtgatgccaggcatggatggcctgctaggggactcagagagcttccagggcctttctgctactttctttgcctctgtatttcactcagctctccacattgactcagctccaggtaaagtcagaaacttctcttgcaaacagaccttcagcttctccagtgggggtgtgtgttcaggagaggagggtctccctttcccacttccacagttggggtactcacagtatttggggtgtttcccaggtcctgcaagagcagtctgcttccttcagagggtgtgtgggtcctctcaaggttgctggtttgttcttgcagtcaatctggagctataattcacaatgcgagcctccacatgctgctctgtccagagctgcaatctagtcctgcctcctgtctgccatcttaaatctacttctgtctcttggatgtattttttcttctcagacaataagaaccaaagactgtgtatcctgcccaaacccgctgccagtaacattttggtgtcatgaatcagattgcagcttctcggtaagaccctctgtgccttgccatctttggctggaggcacccaactctgcttacgtgaggtcttctttctcttgctgtctcactcaccagcccatctccagaaaaattctctttggtcactcttccctctagcagattcctcagttcatcctggtgggcgacagcagaggtggaggacttcagagtctgtactgagtagacctaagtcactgtggcccttttggacaggtggctcacaagggtgatagggcttgagcctaggccattcaaagactggagaccttcatttccttaaccaaagtggacttttccccaataagtctacaccctattatgcttcctttttttctgtggactttgagatggccttatatgctggccacactgtctgtcttgggggcaagtcaacctcttccctgcttctattctgcatatcatgcaacttctttctctgcttaatattgggaagactctgtctccaccaattctttatttcctatcatgaatttttaaatcctgctacacattgagaccaggttttccagtggctcttgaggtcatttgtttgtctccatagggcatctgtatgtggtccattaagagcaactcctacttcctttctagagctatctgcactttggggagaggacaattctttctctgccttttgtggtctctcatcccaaactccctggccctgacagttcttcctctacactgagaagactgataggcaatgtcctcttaggtctaagggctgctgtttgtgagactgtacaaaagcagccttccatgaatatcccttattttctaccattcccacgggtggcagatggattgtcctgtcattttaaatacttgttttccatgcttccccaggaatccacaggagggatgacaaggggactcagatgcaggttttcctctgttcctctgaccatctacattcttaacatatactgggacctacagtgctatgtccagagaaaggaaggcccagttcccttacagctgctggctagggataagatcctcacctacctaaagggatatggagaatgggaatttgagagaaaggaaaaccatttcattgctggaatgctccaaacaaaggtcactgtaagatcacagtgtcaaaggtacaggtcagccagaggccacaggtgcaggacagattaccattagcagagagatgaaggctggtcctggagggaaatgtgggaccagggttagtggtacctggtaatcactggtttattccagaactccaggatgaatgggggatgccctactcactactctgatccaaggtataaggggatcaggaaggaatgctttcagctgggcgtggtggctcatgcttataattccagcactttatgaggccaaggcgggtggatcacctgagttcaggacaaaaccccgtctctactaaaaatacaaaaattagctgggcttggtggtatgcatctgtagtcccagctcctcggaaggctgaggcacaagcatcacttgaacccaggaagtagaggttgcaatgagctgagattgcaccactgcactccagctgagcaacagagagagactctgtctcaaaaaaaaaaaaaaaaaaaaaaaaaaacagaaaaagaaaaaagatgaagaagaagggactctttcctcttccttactcttccctgttctgtcttgcagatagataacggtgtctccatactctgggactgaccccttggatgcatccttaaaatctgcgataaatccaaccaccaaaccctaaaatgaaaaaactaatttttcattgcagaggaagtctggctagagaatggaagtacaaattttaataccattctccggctagaccttttctgccattatcagggcaaaaagccagaggtcccctatttacaaacctttatggcctaaagggaagaccctaatcctcgtaaagcttgtaaggcaaacctcacatcctagctatgcttagccatctcctccagggccctgcatcggccctggagactcctctgctgattcctctccaacatttcttcctccagaagccaaaaggaaaaactacctcctcctttggaggtgaaagagggagaaacagccacccctggatcctccccctatttatcccactcccagacctttggaattggccccactttacaccgggctccttagttctcctctccaagcttgtaggaggtaagtgagccaactgaactcgtccaggtccagatccccttttccatgtacgacttttgacaacttaggaaaaacctaaaaaagttctcagatgaccccaaaaggctcatagagggcttccccaaattggctcttacatttagattaatttggaaggacataaatgtactcctgggacaagcccttttacaagaggaaagacagaccatctgcggagcagcaatccactgtcgaaatgacttacacctggaaaatgccaactaccctggaggggctacagctgttccccagctggaccccaatcaggactacaatgccaaagcgggaatatgggccaggaaccataggctcttgtgtctaatagaggtaataaaatgaagtaagatcaagcctctaaactacaataattagccaccataaaccaggggccaaatggaaatcctatagcctttctgaaaagtctacaggaaacttattaagcacaccaaacttaaacccagaatctcctgagggactagtcctaaaggacaatttacccaagctgctccagacattaggaaaatttacaaaagtcagccttagaacccagtgcccctatgccacaaatcctcaaattagcctcctcagtcttttataactgagatctggacaaggaggacagggctaaggaaaaggagaaatgcagggacaagatgcaggctcaactattggctgctttacaagcccaccagccccctccagggtctcctaaggaccctcctccaggtaactgccactgatgcagaagaccaggctactggagaaggaattttccaaatgggccaaatgggaggaagccccacacagcctgccctctttgtgataagctggagataagtcccactggaagagggactgccctgggatccaaaaggtcccccagttgaacccccatccaataatggccttgagctgaaggggccctccactctggccagcttccaaatcagacatcatcattaaaggaacagagccaagggaaactctggaaatgacaggtagtgctataaatatccttttaaatacaagaactgcctactttgtgctaacctttttctctaggcaacttacccccaaattctgttgggtaacaggagcaagtagcaaccccttcctctaaagattcacatcccctttatttatattgcttatgggactaattactattctcccactagtccctggcaatgtctaaatgcctcacactgcttttgagtaggaatatactttccaaaatgggtatccacttaatatttacccaacatctggactgatatttccccctaatatcccagtttctcccaggaaagccagcagtcctacctcagggttttagagatgccccacacttatttggacaagacccagcaaagaaatctaaccaagctatatcttgagtggggacaacttctgctgtatgtagatggcttactcatctgctccccctccataaagcttgcacaacaatatgcagtacaaaccttaaccttcctagcaaaatgtaaggtacaaagtatccaaatccaagacagagaatttcatacctagaaccaaatatatatacagagagtactgctggctccagaccctctaacaaccaacttgtgtacccacccaggtccttattaaaacctaaagtgatggatctacaaaatctcaactaatcccctcatggaaaggcccttttactgttttcctttccactgcaacagctatcaaagttcctggcacctctagttggatacatcattcctaaataaaaccttgagaggcttctgaacaatcaacaataggaccagcacctgagtattcctgtgagtcattggaagatctataatatctctttcaatgaaattataagtaatgccttcttttctttcaaactaatgctagctcagcataaggtagccccagtactctggatcttattcatggtgggattgcttatgcttacacttggttcaaaaccaacattcccgagtgggcctacacccctccaggctatgtatttttatatggacctaaacaaaataaactgccctgtgagggaagttctaaaagaacttattcaaccccctcacttgtaaacctttttatctgcatagataacacccaacatacaggggatgtgccctaggactcctggggccacaaggaacaggtgtaaccatctataacattacaaattcttaaaaaaggagagctcttggccttataatggtagggctaggggctgccataggattagctgccccatacagaggattcagttatcataaagtcaccctccaaaacctctctacacaaattggagacctaggtcagagaactgggaacagaatctctaaactcaaggcttcactgaattcagtagctaatgcagtcatggacaacagactagctctagattacctccttgcagaacagagtcgtctgtgctgtcatcaataaaccctattgcacttgtgtcaacaatagtgggcaagtagaggaacatataaagagaatctgtgaccacgctaagtggcttcatgactctgggaaagaaaatccctcagcagattccatctggaactctgtaaaatctgctctcccattgctcacatggttcctcccctgctcgaaccagctgtctccatacgtctacttctttttggcccctgccttttaacctactagataaatttgtcttctccaggatataacaatttcaaaccaagttcccaataatgcaggtgatagatgcaggaggcagataagagggaggatccctggagaatctcccgcccgcctgtgcactgcgacgatggggtaaagctaccaggaagttcatgccttgttggggggaaagagcctgggaactttagctcgtgtgtgggggcttggaatccaatctgtgagatgggagcctgctggcagaaacccctctcactttgctgaaagtttttcttttcttgttttccttttcgcccaataaataataaattccattcccctcacccttccacgtgtctgcatgcctaacttttcctggtcgtgacacagaacctggatttagctgaactgaggagcagaaattctgcaatacaggaatatctacctccctacccaaatgtgaagaaaacatacacctgtttcccctggacctggctggacaccaattctacctaccgatgggaccattctgttctgacaattagcaagagattgagacccagaggacaaatacagcccttatttcagcaggaagcagccacagaggactgaccttcatccactagccccaaataattgagtctcacactcttgaggggggaatatgttagggtaggtagataggtggatatgagcagggcaggatagggccccaaggaatgtcaggagacagtcaaatgactgtcattgtgactgtcaggtggcctcttcaggaatgatagatggtcatggctggcaccagggagggggaaatttcctaacaggaaacatcttaagcttgtaggcaacaactttgcgataaaaccctaggaattgagcaggcatgcacagtaaggggcaaaatggcaaagtttgactggtatatgaccttcctctgggggcactagaccagtaaaggaaaattgcccaaagagtacatgtgcataactacaaccaccaaatggcgcatgcagcccctcccagattactggcaagtcactgagcacgcggcgattagccaacagctggcccaaaaggaagtatgatgggaggagatcaggaagaatcaggaaatagtaactttataagagtcctgagccaataatcaggcgggacactcaatctttccagttgcccacttggtcccttccaaatgtactttgcttcaataaacttttgcttctgtctgaaatctacatctgtctctcagctgaatttttttcttccaggaagacaaaaactgagggccgtagaccctgcctggactcacctcccgtaacatttagactctttatttcacttaaatacttgatcaagaggtacatgaagataacaagctatggggctttgcaataataaaggcagattgccagtctgagtttggaattggaatcggtatagacataagattcatgaaatttcaaaaatgacatatttctttacatgtttatgatcatgaaaactagtctttctgtttaaaagaaactacctgggttcctttagtctttgaacatagaactttttttttaatgttacattgatagctgaaacagttgataatcatgttctagagcaggtgagtgttgctatatactggggttgagatggggaaaatgaaataaatgtataaaggatcagaactacagcatcttaaagtgaaaacatcacaaagctcagagtaaatttccatcttgctgttgatttatatataaactgtactcacatgttcagaaggagaagtggaaatattatcttggcttacatggaagaggaaaagactatatctagttatttaaaactacctgttaacttacccacagacacagctctatgtaatgaactctagaatgtggttagtgtcaatgttccagttgtggacggaggaaacagttttcaccaaatgtagttgacaatggctgtgaaacatggcacagtgactagaatgaggtaaacagatgtcataataaccacgggacacctgccttcttcacctctatgaaaatattgctgccttacacatgggcagaggtggagaaatgagaaattctgtccttagacacttcactccaaaacctgccaggttcaagtgctgccttcctgtctcaatggagaatttccagttctactctagggatgaggctgtggtctctccagaggtgggtcatggcctcagtactataggcaggcactacatcctgcagctgtcaatccaggctgataatttgagacctagcagctgatgacattccttctctgcatggcagttgtctctaacaggccagtgcacatctgagccaaagatgacatttttggcatttgcctagacgttgagagcatccactggcttggtgggcaccagttggcaagaagggaaaaccccagccaaggaaagttttaagaaggccacgtgctggcccttcagaagcagctgcattcatagtacacactaggggaggcaaacgtgtgcctgtgtaatctgccttcttcactcagtgggagggaggccagttaacaatgatttcaactctttattaaaatcaactaacacattgctgcacttagatagtagtaaccaggcaggacaccagcaggcttccctaactgcctttttattacaagacctatttcaggcccatcccactttacatctctgcagcatgacttcccaaattacaggcataataaactaacaaaggccacaacccctgcaggcatacagagtcagattacgtctgactgaatctgctttctctattcataaacaacttaaaacagctctttccctcgcgtaagaacctgacttgccaggcacacagtgaaccagcagaagactacatgaggacaatggagatatgggtgagacaagggcaggagatgccttgttcataggaaatgaaaagctctaaagcccaaagaatttcccttaattttttccacgcagttcccttgaggttatgcagctggatgttctcagagctgagagtggactggcttactataaactattcattctaccttcagatactttcaggccctctgttacgatggttgactcaattgttcctcaaaccaaagcttatgcatgtctaagttctctgatcttaaccttttgaaaggcagtaaaatgaaagaccttatgaacttttgtttgtccgtgatcttacttcctccttttaagatagttttccttatgtaaaagaagcatggagtaattgactttggacaagtgacagagaaagggatggatttctaacttaactgttggcatataccttgagaatgaatacataatacacgttttagtataagccacagattcctctggtctgggtacactggaggcatttttataaatgtaacatggtttattgacaaattcagggaattgtttcacattggtcttttctgtcataccagaggaagttttagactaaaaataatattatccatgttttacagataagcaaattgaggtggagtacagttaaagagcttgcttaggtcacatagctagggacaaatccctattaaatggaaaggatatgagactgaattagtttgccatgcagtaattaaaatcacaaagttctgtacaatctccttgatttttaaaagaaaaagttgtctgtttcatgaaggacagctacttacagaatatatgcaatagggttaagttgaaattgtttcaaatacacaaaagaagccattttttaaaaaaagggttctgaaaggggtgaaaatattctgttagtcaacgaagcagaccacaatagtacatttatagacagattagaatttatggaaagagaaaataaattaaaaatatgaaaaatgttaaacataattgtgttacggtggtagaataataggcaagattttttttaacttcttttttcacaatctctggatgcatgctgtttttgtaattagcaactgtgtgttaaagaaataaactacgtaagcagcccctttctgcacaagatggctgctatgttatagaagtctagttcaatttatacacaggtgaatttttctaatcttttattttataaacaacgatttggaaaattcttttatcttaataaaaaaaagaccatagcccttctgttcattgcaggcagtctttagttaagacaatacacacaggaaaaggaacaggttatcaaacatgaaaggtatttagttaaaaaatcaagtccctgctttcaaaatgctcataatctaaggagattcaagttaagctcatcatagagctgtgtgcagtatccttaaactacatgctaatttcaaatatgagagagtacatatatatgtgtgtgtgtgtgtgtgtgtgtgtgtgtgtgtgttttcccaagacctttctccttccctatttaaaacaataacattttgtcaagggaaaataaacaaaataaaatagtttgaggttgacccaaaactctgaatatttgaattctaatttgattctaaagtcagaaaaaaagtctactctcctggtataatacttttaaagcaaatggaatccatcatgcatgaaaaactaatctctgacctttaatggtaattttactgattgaaaaaagtttcaaacactcagttgtgggaaggaaacagacatttgctcacagtctgcagactttggctcagctgacagtaattttccattgattgggagaaaatcatggaaattacatagctatggctggctttagactggtcttatgtaaatttcaaccttaattctgtgtttattcttttgtgtgagtgaaataacaacagagtctctataaaaagatgttactaatatatctgaggtgacctataactactatgcatgatatagttatgtcttttggattaactatatattttatgcatttataatacttatacatgcacagttaaaattcttttaggaaaagcaataaggtactctgttctgaaattgtttctacaaatgctgcagtatgagtttttcaatgacttaaaaatttccatatgaggagaagtgttagaaatgtatttttccaaatgcaggtgggaggacatcttctaagcctcaagccagttctacaggaaccaagacaaacaccgaaaagtgaaataagattaagtctctgcaccatttctaaagcagtgaagcaaaactaccttcaagggtcagtggagaagacacccagtccacagccatagatgctaggatagtcttggtcacatccccagccataccttattgagtcttggtggttgaccctgagctctcatgttctagagttccataatagccaggcttccaaatgcaaaaagtgtgtgtgtgtgcacgcgcatgcatgtgcgtgtgcaggtgtgtttaggcaaattcacttaataaaaatgggatgctgataaggtgagaaaaacactagccagacagcctaaatgaacagtaaaacacttagaatcgtgcctaacttagaatagtgcctggcacttagtctggaaacacaggctatacataatatcaggaaggacatcttcggtccgttaagatatataataactatgttttcagactttatagaaccctgtattttcataggtataagttaccatttatgagaaacccatacacaggaggaaaataaagtgaacaattttaatcataacaacttactgagttttaacttcaaagcgtgtacttatatttatacttatttgatgtaattcattacccatattttgtcagcagcaacttgtaaaaactttaaatgaactactatattgtcaatcattgctttaaaatctcaaaatcatttcatgaatacagcacattaatatatgacaagattgaaaaaagttatataaaatctgattgagggcataatttgttaataactctaggcttttaaaaattgtgaacttagagcaccgctatttccctttcaaatctccctctctcacctcctttcctcctctactccttcttttcttttcttccttctttccttctcattattcaccaacgaacccaccaaccaatcagcaacaattatttgttgaagctttttgttgttttctcattaagataaaccaattaagtaatctattttttctattgataaatttgtttatagaaaataattttaaagtattcaatttctaaagtcggttgctctaaagacccatccttggagaaatccaatgatttcctgcacttaacactgggatgaaacacagggcccagggacattcatattaaacttgaactgactccatctgtactttgttcagtctgtttattgtgcttctattgagttttcattctctcagtctgatttcctttctgctcctgttccaccaacatggcaccctgagggcttttctccatacatcagacatgttacctggcctatgtctttccctcgctccctgagatggcattcttggaacctggcattgaacagggccttcctcctataatgtgtaatgataatcctccaatctactgccctgcctagacaagatttttatgcttagggttggaatcaagtttttcaagcacaacccctgtgacagctaatatttaagggtctcagcagaatttaatttgtaaagaactaaatataaatatacttcttaaatctggcatcttgctcatcttcttgcctttgtgttctccctgttcttttttcctttctttcaaattatctcctgcaacattaagaaaagtgtggaatggaaaagtagtcataaaaagaaagctagagtttggctctgaaatgtctatgagatggtgtgaaaaggcgcctcaggactgaactgtgcctggaaaggcaactttttcttcactatatgcagccttcctgagtcactggtcactgctagcagcacagaagccacagaatgaaaggagagcaagtgctgagtgtaatatgggaattatagagaaacagggagtgagttcttctgttgtactgtatgaccatgtcaccggtccctcttaaaagataatctaaaaatagagtacacgcatgcgcacttgtgcacacacactataaggtctgctcaagtactaggattatttgggcttgaggatttttggattgattgaatacaactttatttatgtatccttgattcaggaataaaaaaatggctaaaatcttttgctacatagcaattagagatttagggataacataatctgaggatgtcttcaagtctcagatatgtaacttagctgtgcaatcttaggaaaattatgcctctttcatgggccacataaattctcaggactaattaagacacactattggcacaataaccagcaaaatgccttagtttggtttttataagtgtgctggatttttggaagaagtccaataactacatactaaggaaaatagttcaatcattttttattgctttagttcttatcattcactcagtattgctggtgattgagggaacataaacctctagaggaatgaactgataccactgcatgagaccaaaggcaactaatcatgaaatgagacagtcctgaagtaactggttctgattctgaccaagcaacccaatgagtagtttatgggctcatgtcatccctttgaaaagcacaaataaagagcaaagaaaggaggtcacacaaatggaggttactctcctgagtttgtcaagaagctcattgggcactccatagttgggaacactggtattctagaatctttatggcttatgggtcaaatccaatgctatctatatttacattatgttttaggcattgcagcatatattcaccatccttttcttcctcatgctctcctccctcagtgatattgggtttagtcacattatgtgctgtggctaacagaatgtgggcacaaatgatactgctttataaactgaggccttacaaagtattgaacatttctacttgccacattgggagttgtaaactgtgccacaaggacacgccctgggagatcactggtccaagaaggagaaacatgaagaacaagcatgaaggcaacctgcagcctgaagcagcactattctgacccattagtaggactatgagcaagaagcaaatgtcattggtattttgtagttgattgttcggtagcattactgtagcaatagctgactaatgcaccttgcaataatagatcaacacagaaaatgtgaattttgtttttctcttggaatctcaacagttctgactaattcaactaatccctaacctttctattttattttgcctattcaagcttgctagcaatctagactgttatcattccttaaatatgcttcatgtagtgtacagtgcctccaccctcgacaattcccatctgtctaatctttttatgcaagattcaactaaaatttttttctttcatgaagaacatcagattctcccactaattctttctgagagagaggcaatttcttctttaagctcttttatctctctctcttgctttattgatgaccatctgtgataaattatagtacccctagtattgttctataccacttattggttaatatatcccttggcatttgaaaatgctttaaggactggaatacttctcttgaatttcatacagaataagcccttcattagttacaatttaaattaattcactccccttgcccccagtctgcttcttctttggatatcctaactcagtaaatgtcattcccatcctcctagttgtccaagccagaaatgtgagtgattattaatccctatttctcttacctattaaccaagtcctgtttagtcaaaacccctaaacatcaatcaaacctattcacctctctccagccccactgacattatcttaaagcccttcaccactctttcctggaatattgtaattgattctcacatgttctacctacttttggtcttgaagatttgcaatccaatttcccacagcagccaaagacattttttttttgaagtgcatatttaattatgtcatttgctgcttaaaatatttcactggctccccactgcagcagaataaagtagaaatttctatgtgacttatcagatcttttatgatctacagtttacctctatagccctatttctgactgactccccaacttatgctctataccttaggccaactaatttttctgcatctccccaaacctaccacattttatcttattcccagtcatttgcacatgatactgtgtctacctgataccctctctctccttccaccaccctttccttggctatctcctcttgagctttatatctcagatcagataacattttcattaaaagcccactctggcattcctctctccctcttgctcaagcaagcatggccaggggcccttcttgcgtgttcctacagcatcctgcatttacatgtttccctgtagcacttatgatactatagtttctgatttacttgtagttgactctatgggtagcctacccaagagccattccttcctactaggcccccagtgaaattcaaatatccacctacccttgcagccacatacttacagggaggtgggcctcagccccagccaccatgagggaaacctgattgtctcagctaatcatgaaagtacgatttccaaggcagtgatttgttaagacatcggcatgtgaaaccattttggccaataagacattgaagggaagtgggacaaggggagaccatctggaaatgattttttttctttcttaaaagaagacgtaaaaagaagatcctcttttctgactggccatagttatctgcatgtaataggtggacctgtgacagacatctcgagtttacaggaacaaaccagaaaactcaccaacacttgaggctggcagaagagaaagatgaaaaagactcaggccgcctttgataatgtcactgagtgacttggagcctcccacctcaggatggctttggtttaagccagttaagttacaactttctggcagttacagctgcaagcattctcactgactgacacatgtctatcttcctcactgtactgattattaatgagaatttatgcttggagatggaactgcaaaggaactaagaactaaagaaaacatcttagaaggctgcatggcatcatggtaattaatagggaaaactttattaatgtggcatcatatagagaatcagaatcagcttttgaggaaaaggatgtagaagtcttctgatttattttctgggccagagaataaaatggaacagtaatagccttttgaaaagctaggtttaagatgatcacagaaatcctactgtaccaaattcagaagcctctagaaaagtgacctaattcagtttctgctgtgctctgccccttgctgttcactttcctatctcagctctggttttacttcaaaagctcaggaacttaaaagggggaaacctaacaacatatttacctaaactctgatcaaagatccaagaaaaggtcaaggtgatagctgaacccacaattatattaaccttttgtggaaacattgaacaatgcagtagtatctttgcttctgcagaatatcttgttagaaacaggaatttcaagaatagccagaaagataaatcttcttgctacctacgtttttacgctttaaatagtaaatgcatagcaaaaggacctacacagtagtgtattaaacagtgacacctttgtatttatcaataacagaactctcaatattcataaggaaatgtaagataatatggataaccaagattattgcttgagcatattctttaaaaattggcagacagttcaagctcctatagtgctgcaaatggaacttattgtatacttatagttacttgtaaaatgagataattcgtataaggtagaagttacccctcccttgaaagtttggtagaacttgtatgtagaattatttgagccagtactattgacagtctgcttattcactaatttctatgtgtggaggggtaggggtgtctaaaattgtaactattgatgcaatctgtcaaattgtataggtctactctagattttttttttaaatgtgttgagtcacaatgataaactagattaagaaaatgtggcacatatacaccatggaatgctatgcagccataaaaaatgatgagttcatgtcctttgtagggacatggatgaagctggaaactatcattctcagcaaactatcgcaaggacagaaaaccaaacaccgcatgttctcactcataggtgggaattgaacaatgagaacacatggacacaggaaggggaacatcacacaccggggactgttgtggggtgggaggagggggaagggatagcattaggagatatacctaatgctagatgacgagttaatgggtgcagcacaccaatatggcacatgtatacatatgtaacaaacctgcacgttgtgcacatgtaccctaaaacttaaagtataataataaaaaaaagaaaaaaaatgtgttgagtcagtttgtttcatttttgtacttttgtgttacaatcaaacttaaaaatataacccatggtaaaaatactgcagctttaaaaatacattattatttttccctctctgtgattctggagccatatagtctatagagtagccccccccaagacacatataactattaaatacttaaaatatggctagtccaaattgagatgtgtcaaaaatataatacacactctggattttgaagacttagtatgaaaaaaataatttcactgacttttaaacttttaaaaatctggctattaataaaaatctaaaattgtatatggggtgtgcattatatttccactgggtagcactgttctaaagcattcaacagctctcctcacattatgccctgcactacagacattgacatatgtgtaatctctaaaacacatgttacaatgaaaaaaagcatattatttcgaaatagatgtgtgatcttgcttggaaaagacacataactttcttgcatttccattgcttcatctttaaagtaaaagggctgcataagatgattcctaaattcctttccaattcgcatatatttaatgacttcatcatttccccaatagattccaaagccagagaatacaattcatgtaatagctcatttcagtttgataaatatttctgaagcatttgtcatgtgccaggtcctgtgagaggaggtaattttacacctaaccatcttccacctttttttagcactattctttattcttggcaactctttgagaaatatctatggaatgaatggacacattattattctgctgtctcatatgttaatacagaaacagaaatacacacacacacacacacacacacacacacacacacactccagactggctgtgaatgaaataccaaaaaaaaaaaaaattaaattgagttgtgattctttagcagaaactcaagtgcccatataactgaatggtctctggatctggtagctaaaagtgctttactctttctgaaaaatggaaaatgcattataagtctaagtaaagagcactccaattttagctgccttggccccttctgaggctttcctgggtcaataattagcaacagagcccaggagactgggggaaggaacaggatgatgaacaagtgcaaatgagctaccttaagaaagcgatagcacaaagcatgagagcactcagaattgtactgcaaagtgttcagattaggcaggcccaaaaatgaaaaaattgaaaattaataaaccagaacctagctgtatgcactgacttaatgagatccgttgttaatgtaacacatttttgcctactacttttgtgaagacttcttaaattattttaaatatttctcaagaaatgcctctccaattttactggggttcttaacgttcttctcaattttctttccaaaagcataagggagagaaatgaaaagatgatttgaaatactagaaagaatgtaggactaagagccaggaaatttggtttctagtcacagaactgctacaaactggtgatatggagttgaacaaattgtttagtcttctttggtccatttcttcgtctgaaaaatgaggataaagctctgtatattctagaggtggataagggggatcaaatgagataatggtaagaaaaattacatttacaagatacaaatgttctataagtgtattttatacaaaattatcagagaagtctcttatgagctaaaatatgataatagcacatgtggtccaagatccaaaagtgaagactaagaagaaaaatatataacaaaaattatatccttttattagaaatagcacaatatccattaaactaacctttaaaagcacagggagcagtggttaattatatagactctgaagacagactagtggaatttgaggtctgacactgccatttactagctgtgtgatttggggcctctcacttcaccttgtgtactgcagttttcacatctgtaaaaagggggtaataatactacatccctcctatgtttgttgtgaggattaaagcacttcacatatatgaaacactggcacaatgtaggtattatataagtatagctgttatatgggagtacattctagaatgctttaaactctaggcacacttcctagctagcatttgatttatcttgtttgaaaaacagcctgtatttaacatatacatatcagaggttggaagtgtcacaagtgtatgttgggagaacaaagaaaagcaacttcagtacacaatccacaaaataatagcctcgatggactctacacttcagagggctaaattagatggtgaaaccaagtacactcatgtagtgccttggtacatgtgtggctttgtgtttttacattttcctcaggtactgaaataatgactaaaaacaccctgtatttgcattgcatttaaaaaaatcactttcacatatattacctcattagaagttgagggtcattaaaagtggacaatgaacttgctttcaccctcacaaatctctctgaggaatcaagtcaattgaatacgtgtacttgagaaaaaaggtgggctttttgccaaatactttctggcagctcataagcctgagcttttcatctgagccaactgcaagcctggaagggtccagaaaagcgactcatctgctcagcagacctcactgcccctttgttgtggtgggcacggtgcctttcacacacagctgttggtcagtatgtggatcaccgactgcatcctccttgcaagaaggccattttggatgtttcgctaaggaatccaagagtgcaaggcagagaggggaggctgactagttggggacttcctccaggattttcccataggctccacccagttgcttcattccattgatggattcaagggtgattttccatgagactacacctaatggaaaaggaagtctcgggctgttcttatctaatttgccaactgttacatcagcattattgattcagagcccccaaatcagggaaatatagaacagatgggaattccctgcaaatgttttcatggaatcatttgctaggaaacccccaactagcaaaaagcataaacatatacctttttattgaagccctgtaaaatctaaccagaatgcttgctccaggaagagtctgttctcagaaatcatgttgtctgatcaagtttacttcttttgtctactcactgaagtccttaaatacattataagagaatatgctaaacatatgtcaaccttcaatcaataagcatagtgtaatgtctaaaggtcatgatttggattatcacaatactttaggtatcaaaatttataaaactgagcatatctatattatctgccaaatggaaccagattattttaaaaatttcttcatcatcttgtgttatttgaatgtaaaaaacctgaaggcaggctgtccttgtctacttattcaacacttagatcagtgcctgaaacatagtaggtattcaaaaatatttatagaataaatgaatatctgagaagctgagtcattctcaccacattgacattttacatttatctatagtcaaaacagtctcaaatttatgaagggaaattaatattagcaacataaaagtgttttcttttgcagatatatgacattaaattataattgtgcaaagtcaaaaagtaatttacaaattaattatggagcattattaagtgagtcaaagccattctataaataaacaatgcagtacttttctaaaggttgttactattatatgtaagcccttgggatgaaaactgggagtcctatctttaatatgttcatcacgttaattaatgaatgatataaacaattcatgcaaacacctcagtcaagcattactcttggggatcagggggctatttcagtaacaagagttaaaagcagggaacacaatcttggatttggtaaactcatctaaatttcttgatattctccaaagagtagcatttaagcaaaacctggtacagaagtgaaatatatagttgaagccaactttcccttggtaaggtaactatgatcctttcacattagtgagatcgtttggaccccatcgctaaactagccccaggcaacctgttcttggtggcattctccccacctcctcctgcacaattctctcctgcagagagaagggtaaaagtcttcatgctctcccactctccaatgatgctcatgaaaatttgttctcaggtaagattctaatctcacgtattcacactcacatacattcaaatcaccaagctaccttcccctgaagtatctgacttactggtttgcctctatgttaaaagagaaaaccattttttttatttctcaaaagaaattttaagacttagctgtcaggaaaataatgtcttttagtttatttcgttttgagattaaaggcctttctctgacattgaaatttcatatgtagactaaattgaacaatttggttatgttgtttcagctacttacaagaaactacacaactcattggctggttgtctcgctgtggcacttctctgtttatgttgccatggcttcctcgacagcctcattcctgccttcgtgtctgacacacatttctgacatcgtgatggatgcctctaccctgagcaccagcacctcctcaagggaaacgcagcctcaaccacactcatcattttctttcatcaaccgcctgtccttctggatcgcccagtttccagtcttgagagctccgttatcactgaccctctgtctcctgatcccattgtagtagttgatagtgtcaactatgttacacctatacaatgttttcagaaatgacctctttttctattttcccctccatgaatttagtttataatattatttcttaaaatacaaataatacttgctcattgtagtttttccctagggctgccattacaaaataccacagacttaggtggctttaacaatagaaacttatgttttaaaacagttccggaggccagaggactgaggtcaagatgtcagtggggttggtttcttcgggagacctctcctcttggcttgtagatggccatcttctcctcatctccacgtagtcttctctgcgtgtgcgcgtgcatcttaatctccttttcttataaagacaccagccttgttggattcgggtctaccctaatgatctcattttatcaaaatcacctatttacaggctcaatcttcaaataaagccacattctgaggtcctaggttaggacttcagcatatgactttgggtgtgacacaattcagcccataagcctcatgttttccctatggtatgtgctctcagtccagaatgacatttcttttccagaatcattttgataatctatagaaaaactgttccacagccacagagccatccttaaacaaagtccctctgttcagaatccaaggcctgttgccccatgttaaatttatgttttcaagttccctttcttgcaattctaataaaacacagtcactctgaatctctcaaacacaggcttctatttcctacttcttttgcttctacttaggttttctgtctccaagaatgaaattatccttcaacattctaatcaaatgctagcttactttagcgccagcttttctcagtctgagatatgttcttccaaacaatcatgattcctggttcttagatccatggcccatttacctggctctcctatttcatttacctttctctgtgggtttcccagttcaccaaatcataagtatctatgaatagagagctccttagagcatggctactgataaatcattcactgagttgactaaatccaggcagtatgacatcaatcatttcagaggcaatatgatgaaaatatttcaaacaattattatttattcttgtttttatcttgtaaacatggcataaatcagattttgatgaccaatggtcagtgatggttttttttggttatttttcttcccaaaacagcataaaatttttactttaaacaattacaatatgtatgtatatactttattgaatttttggtgacatttttaaaaactgagagaaacactgttatttttatccacattatgagatggaaagccctggggtccattatgagtgacatgcttgcctaatgttttgcaagatctggcttcaaggcactcttagataatgtctagtttattttccactctaattcaccctttccaagatttactctgtatttgatataaaaaatcttagttcttctccattttcctgtccttaagacaccttaacaaattgacattaggctttaaaaactatacattaatacaggccaaatgtggtcgacaatttgattggctagcccacagtcttttccaaacttcttcatccttgctatctttattaaaaagaccagaaaaccaaatgttaacttccatctttctgcactcaagatgaccatgtgtcatagttctggctaaagggctgtaagctctggggaagggctttgtgtttcttataagtggggtagatacaactttagctggccatcctctctcatccttcctccttccctctcactatctgtgacacagacatgatcatctggacgtgcagtagccatttgccatcaagaggaacaggccaagaaaattgtggagatgctgcctctttgcaaatggtgataacatcatgcaacagctgaaacacctccggtgccacctacttaaaagtaattcctatttgttcaagctattgtgagtccaggtttctgttatttacaattgaaagcattgaaaactgatataccaagcatatctgttggcagtttgagttttcctcaaaggaaaactcttttgtagccatagaacatactctataatcaaaatccagttacaaatccgcgaatccagttctctaggtcaaaaggaggcaaaagagaatgagttggctgttttcactataaatcactcaccactaaggggatctctgttatcttcttttttttaatatgaagggcagcatttttcttttccctcagggattgttattaactattttctggatatatcgagaagggggaagttacattaaaaattagacagaaaggggagacttttcacttaaagttgtgacaaccttcacttaaagttattgtaacatgcttcttgggaaggaagaaggcataggatggcatagcatgtcaaggtccatctgctttcttttgattttccctgtgcagaatacctcataactgtgatccatagttggcaagaatcccattcatttccaacagaaatccaggaagcttagtgtgtctctctccagttcattatcagagcaattaaaatcagcagttttaatgctgcttaaagggcttcagattttgtaatttatgtagcctaaggcaagattcattttttatggagagattttgattccatcctaaagagttctaattaaagactccttggggagtttttcttgatctgctggatttaagattctttagtaaataacctgctaagattatttctggtggggataatttatctttaattttcatatcctaattatatttcatacatatcttgaaacccaggtcagtaatctcattaagtaaatataaaatagtatataatatactataataaaaatgatgcattgttaaaagatgtatgcaaatctttaaacctgcaggtcttgtttatgaggatccaaagctgaaaagtctttactgctacttatttgaataatagctaccttcatatgcttaatgttaagttatagggttttcttttaggtactaagtttcctcataaaaggcatacaatcattatatctctgagtgtttttaaatttaatagtttttttaaattggagtctgatagcctttataggattggccacttgtttgataatatcagtgctaagggaagaaattaggggaaaaaagttggaagagaggatccagtggagttttttttttttttttttttttttttttggagatggagcctagctctgtcacccaggctggagtgcaatggcatgatcttggctcactgcaacctctgcctcctgagttcaagcaattttcctgcctcagcctccctagtagctgggactacaggaacctgccattatgcctggctaatttttgtatttttatagagatggggtttcaccaccttggtcaggctggtctcaaactcctgacctcaggtgatctgcccgcctcagcctcccaaagtgctaggattacaggtgtgaggcactgtgcccggttgatctagtgaattttatttgaagttgtgtttgtagtgtaagcatgttgattatacgtatttagcttttatgttagttgtgagtatgtacactgggaaaactagtgcctcccaaccaacccttggtaccaccattgttttacttaggtttgtagagaaagcaaaaccatattaatattggaacagaacttgaagcgggtcttctcctcacctccccattcctaaaaaaaaaaatcatttttatattctataaattaattacattctgtgtgtctcttccatggaagagatcaacctaataagaataacagaaatcatctaatccttcccatttcttcttgaaatgttactggtacatatgtttttccttttcctgaaacccatttgcctctgcttttcacttggctaattcctattcactcctcatttttcagcttatacactacttccttccagcagccttgatttcccatccatcatattaattggttctctcctttcctgggatctttacttcttcaatgcattttatctaattatgcatttaatcatgggctgatatgtttaatgtttttcttcgctattcctttggaaggctcatgacagcaggaaccatgtcggtatgtttaccactgtgacctcagagcacagtccagtcctggcatagtataggtgctcaataaatactagtagtgaagatctcagattgctttcctgtgcccagagcatgggaaccaactccaagaagcaatagcaataggagacttctgacagtaaaatctccattttgcagaggaaacagctatgaaggcagaaagtgcccataactcaggaaaagggaggatggcaaagaactgcatctatttcacagtcttgctcagggtcatggctgtggttatcaatctttgcctctaaaaatacatagtttttgcccctatgggtggtcactgcttagtcactgcaatggatttgaactacacaacctacatttatcacttttacccatttaagaccaacttaaaggcaaaaagaagtaaaagaatgatgaagactttttttttaagattctgcagtaccttcataagtgtctccctctcagggatgaagtaagaattgctcctttaaaaagtgtctttctgtgaaaggaccggaaaattcctaaagatagaaactaaaaagctagatggcagcagactgcctttcatgtccctatcaatgaatagattgctaactaacaatcaggggcattgttcatatcaataatataaatagttcaaaagactccagaaataagttcctaaggcactcccagccatttggaataactatggcttggaaattttcccatctttgtaattttgcaaaaaatgatctagactagaggtctataactatattcagatgattcctattcataaactgagaataaagaacagaccaacttcagtaacagtgacattgctgggagaataaattggctcaagaagtaacaacagcagcaaaacggttaaggcacttcaaggtaatcaatttagctctatcgctttttgctgtgactctgaaggaagttaattgaatctctgaaagtagtatcttgctgcctggaattggtacccacaagcttcaaataaactattccatgaagtttaagctgtccttgacagaaagaagggcacaatcagctccaagccattagggaaggtataatttcacaaggcaagacagccaaggaaagtgatcctcaaagggaaactttcgtagaaaaaattttgtactttcctgtccccatccatcagtaacctcaacagagctatttttggattgtttccctttattcctattgatgactattattatatttttgaaaatgtttttgttaatgttgttagaaactggtaggttaatgaaactttagccatggttgttgttgttagaagcaggtgtaattaataaaagtttagctgtgaaggccaggcatctcagggttcaaactttagcttattgactactttttaagctatgcaacccttagcaaactgcttactcacatgacctctgttctcacagctgctaacagaagtggtggcagtgataataatgttgagaattgttttgaggtataaccaaattaccatggaaaatgcctagcaaaagtccaggcttatagtatgagctaattaatatatcaaaatctcattcctttctttttttggctttcctttcttctacggccttctccatcttccaagacccagccttagtagcagatgatgacttgggtctcctgcctaccaagaagcccagtgcgctggcttcctgacacaagacatagccctgttagggagtcaggaatctatttactcaatgttcagttcatattagaatgcaaatgctcttgcaaataaaaaacattaactcatgtctaattgcttatctacactttcagcacttcttcatttttttaaaattttactgtgagcaggctctaaaaagagaatatagcaagaacaaaggttttggctttgatgaggaaaagtgtgtggagagaacacaaaaagaggagaaggatgaaggaagaagacaggaaggtctcaaaacctgagctcctgcagcagtcactccactgaactagcccattctgagcttgtccagttcttttgtaaaccaagcttgcatgcttcttaaattgtcaatggttagcttttcatggttcttaaaaaacttaaatttttaatgatgctggtataagtgaaaggcattcataagttcccccccccccaccttttttttttttttgacacggagtctcgctgtcgcccaggctggagggcagtggtgtgatctcggctcactgcaggctccgtcccccggggttcacgccattctcctgcgtcagcctaagttcccctttttaataatgaaggtcataaataggagcagtcaacagctaacatttttgcagtatttaccatgcagtagacactgtgctgggcactgtacatgattatctcacttaatccccacaaagccttatgagctattattattatttcaatttacagataaggacactaaacagagagagaatatacagctaccaagtggcagaatcagctaataggccatgtgttgatatgttctgattgcagagtttgatgcctctcctgggtgaactcaataggaccagaacacagttctactagaacatctggtatgatttcacaatgtcacgttgtttttgcctttgaagtgaattggggtattctgaatgggcatggggacattttaagaggtcatggggcacgagattaaacctacaaatgtcatgggagcctctccatcttgtgaaccctcttactaaccaccttcattcccatttaggcttttacaaaacacatgactgtaaactgattttctttggtagaagagaggaatgttgtggagaaaacacttgaaaaagttcataggttaaaaaaacacaagaactacttgtttcatacatggttttatgtaaatgtcaaagataacctctcaaatattctttaagtttccactaatatgtgatatcccaaaaatgttgcctcccgtgataatatcttgcattcttctgttattccatgaagcatatcttacttggttctcacagccaacaatcaactgaggtaataaggaaagataaccatagccctgctttatagaggcaaaagtgggatctcatgctatatggcacagcagaaacagaatctcaaactagtatttaggcccctagtcccagccaataacaagtttcattagcgcaaaagttctttacctacacacagtctatggctttcttggtgaaaatagtattcttggtgaactgaattttgcacaggaaacaatggactcagcatctcatattcttgtttagtgtatcttaggaatcatgtgcatgtccagtctaaagcagcaggttgtctaaagagtgttcggctaggcagtgccgaaagactgcacgtcattagcttttgaaagtcattaccattaagtccatgtccctaaattgtttctttctgtgaggaaggcagaggatcatatttgaatccaagatcatcgaagtatggtagacatgaaaggcgtgtggttagggcactagcagaactcaagagcaagtatgcactttccaagttcccagggggcaggctgatggcagaaatgtctaatttgaacaaaactgctaaataacttgcttttttacttaaattcctacaaaaatttcccactgctatagcaactattaatgaaagtctgtttttatgcttctcgatgacatttttagcataatttagagaaaaaacctcagaaaataaaaaaagtaattgtaagacatatgttatgaaaatatcttatgaaatatgttatgaaacttttgttcattatgtaaccagtgccaaatttgcaaccatttaggtctctgatggtgataacttatttatcttgtcattacttttccaaatcccaagtcctacagaactgtagcttcaactagaagccaagccctacctttgtcctacacaaaaagagacctagactgtgagcagcctcgctacagatttctttgactccctttggatcacacactatgaatataagaataaccaagacatgcatccaagtttatttttaaattctagttttgctttttctgatgtagcaaaaagtgagttatctgagcatcaaattacatattttcctgaaatattttatattttctcaaagccattttccttagtaactaataatgagagatgatagaaggcaatttaaggcatctcagcatttccaaatagcattctgtctaaggttagtttcagcatgcaactggtgataaatggcatatagatgcatgtgcaggggaggaggtgttctgtggcaaaagaagtttgagaaaaagattttaaaaagttaaacagttttttagcaattctcagtgcctttaatatgcaaatcaatgaatcatgtttaagacggtaacgatacatgcaacatttcttaaaatgatttaagtatagaaccattatttgcagagcagttgcagggaccagtgttccatgggcacacgttcggtcatgtgggctcaggagtcacacagacctgaattcctattacagctcagaggagctgtgcgtccttgagagaatgattgaagcacatggtaaatgttggtgtcttagcctcagtctcttgaggttaacaaaaggtcactgaattcaaaaatactaagaaaactacattatattcttgacattcaaatgcatcttcacaaatcccctaattcactaatatcactctagcatttacttttcccctagaaaaatttagtgggtttttttgttgttttgttttgttttgtttaaaaaaaaaaaagcaattctcattggtgcattaatccctgttgctttacaggaatgtgttcagtcttctcaccctctctggaatctcattttcatcaacagcccctatttgctaatgttttaattctctcttgatgagcacttttgcattgactggcacactctacagaaagttccaattttttttccctagaaacaagcacagagtgaactacgatggacttgctcataaaatttgatctcatttatcactttaaattttatccttttaaagaattaataattttcttagctgtttttgcgtagtgtctactgtctagatcaacgctgttcagtagaaacataatgtgaaccatgaatgatggccacaacatgtaattttaaatttttaaaaagccatattacaaaaagttatttttacaaccaggtgaaattaatgtatttactttttacttttgtgggtacatagtaggtatatttatggggtacatgagatattttgatataaggcatacaatgcctaataatcacatcagggtaaatgaggtatccatcacctcaataatttatcctttgtgttacaaacaatccaattatactctttaattaaaaaatgtacaataaattattgtgactgcaatcagtcttttgtgctatcaaatactagatcttaatcattctatctaaatatatttttgtacccattaaccatctccactcccacacccctgccactcactacccttcctaggttctgataaccatctttccactctatctccatgagatcaattgtcttcatttttacctcccacaaatgagaacatacaaagtttgtctttctgtgtgtggcttatttcacttaatataatgacctccagttccatccatattgttgcagatgacaggatctcattcctttttgtggctgaatagtactccattgtgtgtatgtaccatattttctttatccgttaattggctgatggacacttagatacaaccaggtgaaattaatttaaatatgttttatttaaccctatacacagtattagtatttaaacatgtaatcattatgaaaattacaaatgagaaaatttttactttttttcacactattatttgaaatcctttgtgcatgttacattaccagcacatctgatttggattagccacagctcaagtgctctatggctactagctctcttgttggacagcacaggcctagattagcagtcagcttccttctgggtggcatttttctacacaggtacaatgtgtttatcagttcagagttattacatttgcaagggagggtagagaataatgaaattatattgtgatttgaatacttggtggtgcatgggtcccttcaatagtttggtaacttaaatccacacgagagctccgttgtactttggatcaaattactccctgtcatgaagcatcagagtcccttataatagtccacaccacaaaagccaagggatttttgtaattgttttacaagtaggaaaagcaataacagtgatttgaaatttttacaaagttaaattctgtaaatatatgttgaatacaaattgtgtacttgacacttggctagttcttaacactgaaagttttttagatatgagacatccaattttcttggcaaaggtatgtatgtatatataatgcgtatgcaaacacacacataatatatccatatatatccaaaatacatatatatgcatgtatgtatgcatggcgtaactcctatctattttacagggtcacttggttggtgattatttccttcttttcctttgaatcatgggcactatagaaaagcataaaatcagtcttgtttcataaattaatttttctattcaaacttgcacttatctttgatggaaagaaatgtatagcctattcttgtgaataacgctagctgatgtgagctgactgtttactctatgccaggcgctagtttaacggctatatatgtattatctcatttaatacttgaataactctaatgatgtaggcgcagaggcacctgaaacagagcacacttaaggaatttcataaatgtcatacaagctgcaagtggaagagccatgatttgaactcaggaatttctgctcaatcatgaagtgaactactcactttaaatgcatagtattctaacactctctttttagataatgatttgttagctaacctgaattaggtccttaaaagcaattctcaaattatgattttacatatctttgaaggtcttaacggaaaggaactttgtaaagatagttttatacttagcataacctctcattttattttccttcaagacaaatccatgaaaaaattcagcttcattccttatctctgacaaataccagaatgcacaacacatggtgcctctgatctgtatcgtttcccctagcgcttgcattcatctttgatgttgatattttgtggtctagtggctcttgagagaagacaattacctatctcctttgaaccataaattaccatatttggagttgcttcttcatataatttttactagtcctttttatttctctcatatataaattgaaatgttgaaatgatgagatctatttttaaagtacataaattttggggaggaatgggacagagtttaaattgttgacaattatacataaaccagctgaatcaactgggcaagtaaacatgggcaagtaaactgggcaagtaaaccttcagtttcacattaatccatttgtgtgtaggcatcagggaggtctcattcttgtaaccccagaatataaaatataaagtcagaagtagtcttcattttcacacccctcctcttttcaaaaaattcatttaaaaatatttaactgacaaacattgcatacatttatagtgcgcaagatgatgttctgaaatacgtacacattacggaagagctaaatcaagctaattaacatatgcattaactcacatacttttttgtggtgagaacatttaaaatctactctcttagaaattttcttttttttttttggttttgttattatttaaagttcagggatatatgtgcaggtttgttacaatggtaaattcgtgtcatgggggtattaagcctagtatccattagttatttttcctgattctctcccttctcccaccctcccctctctggtatgctcctgtgtctgttgttcccccctatgtatccatgtggtctcattatttaggtcacacttataagtgaccacatataatatttggtttacaatacattgttcttaatgatagtcaccatgttgtacagtagatctcttgaacttattcctcttgtctaactgaaattttatatcctctgaccaccatttccccaatccctcctgttcccatcaccccctggtaacccccttctattatctgcctctgtgagtttgacttttttagattccacatagaagtgagatcatatacatctctccttttgcttatacttactagctttcagccagaagaacaatgttagcaaaagggtcacttttgaaagctgaccaacccctggttaaaacaacatatatcagaatgtacagcataaagtttaaggcttcataagtctagcagattatatactcaatatacatttgttggatgaattattgaattggatataagttcacagggacattgagctattctttgatatttcctgggcttggtgttgatttcatgaatgcatgcttgatgtatgaagaaatatttaggcacatatcttggatcatttacaattttctcatacctccataatgttatttctgtaagcttaaaaggatattgtaatatacagtccatacactcaatttcgaatgagaaggttgaggacccatgaagttaaggtaacttgtccattgttgtttaatgagccaagacaaaagtggaaatctagttcagccggctgctgcccttccatgcaaaaactggtataggtcatattatgattaccatttgaatgcaacctaacaaaatgttgtggtctgagacttcatttatgataataatgaaaatttatattaaaagcaagaaattacattttgcgtggtggattacacagtacatagcacataaatgaaatctggaattggatttgaatatttaaaagtacattatgccttcatacaagatactaaacgttttatgggggaagaggtttttcacaagggttataataaaaatactttttatctatgtagttgttccttagcagttcctcagtagttcttagtataaccaagaaatactaaaagatgtattggcccatgccttcccctttccccaaagtttactgtcataatggtaaagggtgagcgaaaaatgcttgaaaagcagcccatgatcactgaatgattccatttttagcacaagcttcatgatatgaatcgagtgactcttacgtaaaaattacatactttttctttttttcagagatgaggtctcactctgttgcccaggctggagtacactcctgtgatcacattcactgcagccttgacctcccaggctcaagcaatcctccctcagcccccagagtagctgagactacaggcaggcaccatcacaccctactaatttttaaattttttgtagaaatggggtctcactctgtagcacaggctggtgtcaaactcttggactcaggcgatcctcccacctcaccctcccaaagcactaggattatagggtaaaccactgtgccccacctcgtatgctttttcaaatttcacgatgtgaagtatctgtctggtaataaagtgatatattgtttcacatcatgaaacccttagaatacgtttgatattgctctaatgtttacttatgttccctcatatgccacaaagtagagagccttaagattggattttgaaagctttaagaaatgggacccacagttatcacacatactaaatttttcctgacatcatctaataattaatgatcacattttgacatggtacaaactgaaccaggtcaacaaactttatatgccagaagccggattgatatcatcaatcagttatggggagctttggagatgacataaaaatgaggaatatatattaccggaatcttaacattaaaaagacataatgactataatgacaaaaaagaaagaaaataaagggaaaaaaaccttctttaaatgcatgggtaaacaaaatcttgaaaaagcaatacacatttattttagcgtgacttacactgcctatgcatttactagtgtttttcaacaggttaaggtggtttaggaaaagtccaaaacatattttccaagaaataatgtacgggaaggaaaacctgatttaaagtgagcacgggatatatagcaagaactcaaagtacgacatggaaattttaaaacagaataaaagattatttattggtttttgctaacaatgattactattggtttgaaaaatgaatctggataaaatgtagaataacatcacatatttaagctgcatatggatcaaacagggaaaactctatttctgcatatcagatcgtttcttattttagtcacttaattcacagttacatagtattcatcatgaggagaaacagacagagtgtgaatggctcactgttacccacactattcctggaaaaacaggtcctaaagattaaaagactcaactgcataaataaaaggcatgatgacattgttattacaggcaaacattttttaagatgccatcactgaaaatggatgacctatactttggtaagaatgcagagaactgaaacatcactttgggggcgacataaatgtggcaaccagtatagaaacacatttggcaatatctaaagacaaaggcataacctatgacccagaaatcctacctcttgggatatacccaacctacgtgtatgcacaaaacactgcaacactacatgtacatttgtttactaagtgatatatccaataatgttcataatggctctaattcataatggcctaaaactggaatacttaactatccatcaacactagaataagtaaattgtagcatattcatttggtgcaatactaacaaaatgagaataaagaatgcacaaaacactatgaatgaatcccataaacacaatattgactgaaataaaataagagtttatattgtataatttcattcatataaaattcaaaagtagtcaaatctatgctattggaagtcagttagtggttatcttcgggtgcatagtgactggaaagaagaataaaggggtccccttgggagctggtaatattttgattttgacctagatgttggttatatgagtaaatatggctaagcatttttttctctcttactggcacattcacacccatcattttataccaaatagatccttgcagagtgctaagggttatctataaatagcaaagaaagagaatcctttccattttaaccaacatgaggaaggcaagactgcgagacttttttttttaagtcatgtagtgctaaaacaaacaataagccttttaaattcactccaaaatacaggataatttgtttcccccaccgataataatttcttctttccctttcttggcattttggtgtgtcagatctccctaaggtttatgttgtctcagtttacacggatttgctttaggaaaaaaacctgacgttccttgtatgagtatctcatccaaggggttgaaaagcagcgcatacaacagaagttgcacaaagccgtccttgtcatcttccacacaggaggacagagaacaaaaacgtcccaaccagtgagtggcagtgccactgaggacctcctgaacaactctactcaaagcattttgaactttataccaagaaactgaggaaagttaggagggaaaatatatagtccttttctagaaccagtaagatgtgagataaacaattatttgagcgatgaaatgttttcatcttttagttcatctgagatcagggcagtgatacttcatagaacccacaaataaaagcttttcgtcaggtacaacctgaagatggcagaaggagttttgttgcttgtttttttcctccactaaagtggccactctttcactagagaatgtactaacgtcatcaaattaatgtgattcttaaacaggacataaatcttccctttggatgggaacacaaatctgattcattaactttccattctttatctaaacactgccattatgtgaaaagaaaaattcctgaaaatcaaggatattttgcagttaaatccctcctcccagccagtctattttgttaccctatataaacaaactctgccattacattcctttatccatagcaacttccagtgggtaatccacaaatcaattaaaggcaagttaattgccaaaaagggatcaagtgacaagcattggaagcatatttatgggtgctattctcaaaatctgtgtgtcagaaaagtttcgtccagctagctttccttttaatgcaagatttaaaatttgtattatttctttgaaaataaaaaattaatctcacagttattcttagcttaaggtgtttatgttttgtaggcagacacagacacatatttcaaacaaaacaaggttcctactataggactattactactgctaccgatttttaacttccatttttctttgctttagtattttctacgtataaaaagttttgagatagtgtgaaacaatgtaatagaaagtatattgtaaactgctcctcttccccctacatcttcttttcatcttcctccttgttttactttccctcactgtatttttataataacaaagaagcaaaggtaaattcactcaagagactggagactgaaaacaagtcagtaatgaggtcaatatttatatggttccattgaccttgtgcagttctgagtttcaggcctagaactacaaatgtactcacagatgtatggaatggatatgcttgaacttatatgcaaataaattatcaatttctttgtaaaggtttccctggcttccccaagcagaacctctcatctcagtctctatttattttatttattgttaacttgtttattttctgtctttctctaccagaatgtaaacttgatgaaagcagagaccgcatccattttgtccctcactacattctgttacatttttaggagtatttataagtcagttgttaatacccaacagttattaaaaattaaattacataaaaatttttaactataattaaacaaattatattaaaaacaatggaaataagtattcaaaactcataacttctgaatgatttggctacattttgtattattatgtttttggggcaacttatatctactgtatctatatgatagaaacactgtatagagtactatgtctatgtatctcttgccaactccacatttagtgacctctgctgtttgaaatgggcaggtgagagaattttttggcacagaaatcagcaaatactacaaatagtgcccttcccctcccccatagagagctggttgtgaacatttaccacctgaaggaataatcttttacattctgttctgttcatttttgaatgtttaattcattgtcataacaattttagggttttgtttttatagagtttatttctttagctcaacacaaagcttatctttttaaagcttcacttcaaagctttttttttttttttggaatgtggcttacatacttgtcccctttgaactgtcctttgcatttgattggcttaacataattacagtaatatatatttactctattcacaatccatctttcctctttatcattttagtttttctcttccaaatttacactattaccagctaatgaattatataatttgagccatgtgccatggctcatgcctgtaatcccagcactttaggaggctgaggtgggaggataacttgaggccaagtatttgagacaaacccgggcaaaacagactctaaaatatatattttttaagccaggaatggtagggtgcacctgtagtcctagctacccaggaggctgtggctggaggatcccttgagcctaggagtttgaggctgcaatgagtgatgatcatgccactgtactccagcctagatgacagagtgagaccctgcctctaaaataagtaaataaaataatacattcagacaagttttaaagtagcatatagtattcttcctttgccaatggatttttcctttgctctgattcaactctgtgtgcttatataacccagccttacggaaaatcagacacctctcttcagacccttgttgaaattaaaaaggcttgtcaattatagtttgaaagtagaaaaaataatggaagttaggaggagggagagccaaggtagaaggtgggtatatgactgtggcaaagaacatgatagaagctgaggcctccagaacaaggagtaccaaggtaaagtgtatagaattgaatgcttcctcttttgtaagaagtattccttatttgctctgcccagatcagacaggctttgatccagctgctcagtcaaggtactgtctcttaaaatcacttgatgggggctcatccacttcatgacttaaggacaaatggcactcgttgaaaatcataaaatcaacattatgaaaataaatagtataaattttataaactactaattaagcataaatattcatacctattacccattcaaaaatggtatagttttaactatagtgaaaaccattaacacactgatgatcagaaatatccacagcatgattataaacccttggcagtttggagtgtcttttcttcttttgtcaccttgatttttttgtacatctcctggcattccacatttgccagagctctgtgctggtccgtagcctgcaggccaccttataaaaccaatacctttatatttattgcagagtttgtaatctttctgcctgtggttgttccatgtgctgtcatgataatacagaaaacactcaaactgtatctcccctctctatctctgtttctagtctacattgataattgagcagattcttttgaatgtttgagatggggctttccttcaattttgaaaaaaatgcatataatgcattctacaaaaatgttgtttacaaagtggtacttccttacaaaaaccctattgtagctgttgtagcaagtgatttttagacttgtaagtaaaatgtctgaacataattttacttggataagtctttctcttattcagaaacctgtccttccatggtcattgcccaattatggctcttatacactctcctgtctgcaagaagtgtgctctgaatcattcattcattttgctgccttactgaaagcactgaattagatggcatatgtattgaagtgaggggtgggacattggaacaaagattttcacagaagcacacagagccagggttctagctctgaccaggccgctatcaagttgcatgaccctggggcctttcaaggtcttcaagctcttcaatgtaagacaaatgagtttgaacaaatgaaccatcaggttccttcagctctaaccccctcttcccatgaatgtggcaaaaggaagcagagtatcctcacacttgccatgaatcggaacacatttgctaataggttcattcattcaatacacaaacgccaagcacctaatatgtaccacacactcttccaggcactggccatacaaaggtggaaaaaaggacaaaaattgctgccatgtggagcttacattctattattaataatagctgacatttattttagtgttgtctatgtgccaggcactttacatggctaacacacttaatcctcataatactccattttacaaatgaggaaactgaggcacatgaagtaacttgcccaaagtctcatagctataagtgataatgtgaaaatgtgaacctcagcagcagtgtggctgtagagctagccagctgtcaatcattcctgcacactacatttccaaggtgagcctgggttgtatgtgcaagttgcttataaggtaaccatttataagccagctctattgtactattctgtgaccaagagtggtaccaatgatgatagtttatctgaaaatgtatttcacaaaagaagcttcacaaaatttgtgaaatgttagtgaagacttggaaaatgctatgaaagagttggcaggtagtcctgcattcacgtacatgctttcatctaatctgcacaacgaccttatgaagtagatattttaattttctatttatgtacatggaaatggctcagagaggttaggaaacctgcccaatcaagaaagcagcagagttggcactgaagctgggtctgtttggctctagagccaaagttctcctcctataccatgctacctcttcctacaatgtgcaatggttgttagtagtattgttattcttagatataaatgttgtctataatttctttttgtcaatttagccaacattactcacaatttgaaatatcattaagaaacctagtttaatagtcaagactatgccagtagaataaatagacatgacacaggatggagttgacctctcgagctcagagaatcttctggctcctctgaacagctggccaaggagtaatatttggcagtaaaatacaaccacatgaccaatgtttttggccagatgaaatgagccagatggaagcccatgaagcaaaagccaggagggggcagaagcagacaatataaaataacggattcattttcctttttcttctttttaatataaaaatacctctattttgatgcttttgcttagcatttctttaaaccaacatcaattaggttagaggacagtttagatattatttaacaagtttatattttaactgattactaagccctattctataacaaattacgtggtgttctgtcttcagagaaaaattcagagttaagtagaggaagatagtacatctgttagaacaatacctctcattatggaatttttttccttgtgtgctgataataggatctggtgaggaagctggaggtgggagagggaccaggagtcctggttctaacacagacttccagaattcacacctgtgcaggtttcttaaacttgctctgcctggtttcctcatttgtaagataaaggtaatgctagatccacctcccgaggctgttttggaggatgacatgcatgagctaatgcatgtatgggattgggaatggttcctggtgcatagtaagtgtccaatacaaactagctctactgttcttactttggactttctaaccacatatatgtgtggtctctagtccctgaaccttcaattcttcttctcttatttgatactaattacactcatctttttcacttaccctaaagaattaagtgagatgagctgtggcacactaaaaacaacagctgtcacatctgttacatctgaaaagctttgaaaactaaaaagtgctatgcaacaggaggtattcttggggtatgcagaaagttacatcccagtgtattgattcactggtggcattcacttcctttctaagatgtgggtttgagacagctttttctaatgggaattgtgcagtttggttgggcaatcactgatgtgctaccactcaggttttggtagtagcaaagagtagctatgagaccacactctcctatgatccctgttcatatcagctactatacaatttccagatcaaagttgtagatttggtctttacttcctaataatataggaggtaatttagggatatctagatcttcttgtttgggcaaatattgctttatcttttcatagcccagataccatttgtacttttgtttgttgatctgactgtcattaatccttccttctactgttcagtctatgtcatatcaaataaatttactcattagaccttctacacgaggtacaagcatgcacatatgtatttaattaatcacctgtttggcagctctgctaaaatgctgggaaggaaaagatgttgaaacaattggcaaaaatgagatttggagattttctgagaatttctatcccatgacccctattactataaagggcaagaaaactagaagacactttctgtttctggcctgtggaatgctatggaataatctctgccctacattcaaatgtaccttgagtgactttctcttctatttacatagtacctaccccaaacttgtcacataaaatgttccttttaacatccttgtgatttgttctctttggaagacagaatcatctcaagaagagtaattttctatttaaagtttccttgaacactactgtagttttaagcaataatatattttaaatcacaaaattccctagtgttctcttattggagttgtcagggtccacaggcttgctaaatctttgctccttgattctttctttacttcccagatcgtttttccccatttttttttttttaggtactatgtttaaacaaccaatataaacttctccacattgttttcttgagcacatcattctcctctttcttctctataatacttgggaggggcgttgctctaaagtaattaggtgaatctttaaacatgtgtgccagaacctaggcagataaatcagcaccttgccctcaaaattagtactcatctttgtaagtggtgccctaatgctaacactgatcccattactgaaaacatggttggcaatctcttctgggctcacagagaaaaagtaccttccttattatgtaaccctctgctttctctctttttctcttcctcactcctccttccacggccctgctcccctcctctcccctgcctttccttccctctccctcttcttttctctttcaatccttctttctgcctcaatcaaacttaataagctatatattaatcttttcttataaaaatgtattttacccacataagataaaaaattgtcacagctgaaaaactttcacatctattttgagcattgtaaaactgtttcagattgtatttctcaagagtcaacactcattaaatgtatatgatttgctattactttaacaaatcagacactaattgaatttcatatcttgtacacctggctttcctttagcctgaatattaccaggcagcaaaagccatgccaaggaaaaatattccagttaaagctaagtgtacccccagtagcatgcattattatccattcaatagccaaagaaaaatgacactacaataggcacatttgaagattttacaagataaaaaatattgctcataaaaaaaattataagggagaaattcaatgaagaaatgttgtccaatgtccagttctttcagttgcttcaataatggaatcagatccaaagcctcttaaaggtcaagataagcttaagttactttcaccgcgtaaggattttgtatattttttaaaaaataagaaatgcaaaaacaaggctgtgacattatgagatattttacatgtttacatcaaatagtttaacacctttaattccaagaatgctatgcaataaaactatgctcttcagaagataattatagcatttaactgtgcgtgcatgtgcctgtgtgtggtgtgtatatgtgtctgtatatatatagagtgactcatggtgcatttgaggtattatggtatgataaaaattttaagttatatgatatgtaccttttttcattattgtcagtacattgtcgtggctgaatgcgtaatctcctttggatacatgagggacctgcagaaatgcaagagccagtggccaactgccttcctacctccctaacccttccactcaattcaacttatgatagatatgatcatatcaagttggctatgccaataaaacattatcgggtgatgccaaataagaaagggtaacagaatactttatcaaataggcattactggcatttttgctgtatgtaaggaaacttctaacctcaaagagtttgcagtgcaactggaaagataaactagaacctccaaacagtgaaagcagcacatataaaaaaattaattattctgtgggaaattgtatattcaaattaagaggaagtaaaggaaggactgagcctctcaagcttccgaaggaaactgactcatgatggatatttgagatgtcattctcacctcttaaacttgttacaaatgaaacttgttaaaattacagatgtgaggtattcaaatacatgaaaaagtcattcttagctgctaatgcttatattttggaaagggtcagaacttgaccaaaggaaccttgaaaaaatatatttatcatatagctttaaattgttacaataccataacacctcaaaataaaaatatctttgccaaattgagaaggcaaggtttataatatatttgcaaactacacagaagagcttaaactctgcatttcgtgagatttctcaaattcattagtcaatcaagctattgcttttactttattcagcagctggagatttatgatattaaggagcttgttatcagatctagtgatgaagagagcctagaagccaccatatgttggaaatatgcacagtaatgttagcaaatcattgatgttaagttctaaatgtacaatttagcatacaataagcatgagaatcacatttaacaaaatgcaaagcacataggaagcatataatttaaaattttcaactaaattttatagctgtaacaaacataacaaataaatcattattttattttgaaataaaaataaatggagttaatacctatacctttagctggcaaattatatttacctcttgccaaagtttgcttatgcattgttatacaaaatttttaaatttgatttctctgattttatagttccctaaaaattccaaggacattatcttctttagtgtctaaagcaaataattaatccttataaattattttaattcaaactttgaatgttttatatgcaggcaaatcagaacacattttaattcagtgttaatatatatttctacataggcttggcagcttccagatgtgctgcatttggtctaaataagaaagaccttatatccaaaattttgcaaacaatgtcacttctatttactattgattaaatagatacctttcagtgctatagattgtaatcaatcaaaaacagaaaaggttttctttctaaacaataataaagaataatcaatcttctctttattaacacctagaatactcaaatgaagaaggaaatccaatattttttaagtgttttctttctttccagttatttggttaaaataagctgattttgttgtaaaacagtcattgacagtttagtgaagtcatgaggtcaagatttttaatatgacttccagaaacaaaagattattaaaatatttagtttgaattcatgacatgtaattctgctgggcaagatgaacactgaattactacctgaaacagcattagtttccattttttcatgtgcatgtgccctgaaacacttatgaagaataatgtagtgttttttttgttggtcaaacaagaacccttccctaacatttagagttgactgtattaagccattagacaagttaatacactgtttttcaggtggcagtaatatgaatgctttgttaagtttgccatttaactctcagaattagcttttaaagttagtcaacttccttcaacttctgcacgtacctacatacccctatttcaaggtttacatcatcttcttggctcttatttaatatattgtcaatttaacaagcattaggagttagaaggtcaacatagggcaaaggcttatttgcaaggggcctaaggcagttaaacaattcttcctagctacaaaaggaaaagagtaatacctgtaggactttgagaaacgcaatcttgatttggctcttgtagatggtcctggcaccgtggctcccagaggatcccaaacaaaagccatttttaaggacgatgccaagatccccaggaaccacgagaagtcagagctggtgcggggctctggggccctgaggccccgcacggagcaggaggcacttgtagctgagtgagggcatttcctttgtgcagtggtatgcgctgacagagagatggcaggctggctgaggcagggctggaagggatggccaggacttcctgctgcatgacacttggcctttgcgacagagtttgcttcactcaggccttatctcataattaacgtgagaaacactccctcgaaaatttgtttttaaatatagccctgattaaacagcatagtcacatgccactcctgaaaagcacaacacacacacacgcatgcacacacaacaaaaggtgtgattgaagtgggtaaacctttatatcagtgtgaactttaaaaaatgtaaacccacagggcttcgttaaaaaattttaaaaaatacatgcctatgactgggtcatctgacaaagattactaaatttcacacagctaactgccaactataattttccttatttcaacttctcttaaaaagagatggatataattcttagccaaccttccacaggatgtaaacaggatttactcgtcttgaaaataccagcgcctctctaaaagtcagtgtgagaaaaaaaaacaggcagatcactttcagaacttttggcagctttgccctcaaggagatgctgcgtcaccttagagagtgaattacaatgcatgactctgacaacaaagatcaattatcttgtccattttctattccctagaaacatttcttaactctgataaatctgttaaaacaactttctttcaaattaaataaatgatgaaagccaaatagaatccttcatatattttatgagtccaggacattttgggaaagcatctatttcaagaaattgtacccaaggagtcaaaggaccctagtgccgtcatcggtcctcaccactgagtggtattcaatgttaacaatgcagcataatttcatcagtctgtatccaaacactgccccgcgggtgacctcaactgtaaaccaagggagagcgccacttcttcaggataagattagagaggcttcaagtgcccaagagtgaatttaaccctctctgaactggacaaaattgaccaagagttgagctcagtgaacatcaccatatctgcaaattttgagacctctaaagctcaatctgtctcttgtacaccaagggagtcttgaatattcatataatttcaataaaagctcaagacattaaacattatgcttgttttcacaacagcatccaggacaccaggggttcttaagaatgctacaggtttcatatcagctttggagacgagtaatagaaaaggtttttacagtttcacctctttcttatcagacatgagctcaaagaaagtgggtgagtgagaactgccctgaacagcagcaaccttggaggagcagagagttcaaaaataaacacaacacattctccctgaatcaacttgcaatattgtaacgcttcacaaactgtctttttgcttttgtatagagatccaaatttcgcatgagcaaaacaggtagccactttcctggtgttctcaaagaaggactgaaaaggtgcttacactgatgccaatctgcccttctggtgtatgaaatgccaccattatcatttaattctttcaaactatttaatttccattttcggcagctcttaggaaatgcacacattcctggcagagttagcactgagctgaacaacttggtgcttattagaatgtcttcatctgagactaaagccagacagtgtaagataactggtgatctgcgtaaagaggggaggagtccctaacagctggtggggtgaggtggcttggtgtgaaagggagggggagggaggccacaaagacaagcagaagagtagaagggatgttgctggcaaagatggacttttttcaccctccaggcaacacaaagctctcattttgtccagtggtgtttaaatttttgtaggtgaaacagcatcactgatttctaataaaagctacagtttatgtatacgactttggaagcagaaaaatattttcattgttatcccaattttactgatagcaagataaaccctatctttgtattcaggctaaagccagcagtatacattttcacaaataattaactgcctttgcttacaaatttacctttttaaagggatattcaaatttaatggatatctaattgataagctacaaggacatacgaataatctagaatgaatctgctagggaatgtccaactttttctaaaaatgtgcaaggaaggagaactaatcttgtctttttcattactgtcaaaaacatttcttccttcttttccccctgctttgtaaaggcagtcatctagaacagttaagcaagataaaacaatggaactgtaaatgtgaaattatgaacaagaaaattgaaactctgcttcattttcctagtgtgaaatcagttacagacacaagaagtgtctgtcaatattaatattattttttcttaaataattacttaccgcctccttttcatttcttccacacagttacacataatccttcttaggttaccaggtctcagtaaggtcatagaaataagctacttatttctgagattaatcatgagcaaaattaagccttgatttcaaatagaaatatcaatattgtttttgaagaactggctaatatttcacagacatgagaatttagacatttggaaaaaataagaaattaaataaaatgattttctaggatgaatctttactagcatttataatacaacaagctgtttataatttttacttcatgggtatcaaagagtataaaagaacaaagaagacatcttttgaacattctaattactgtcatttattaagcgtttatttttccagatgaattttagtaaaagcatgattcaatagcaaggagagatgttccatccctgagacaaattattatgtttacaagttgtgcacactaattttatatgtcctagggaaaaccagattcggaaatctaaacattgctccaatccaattgttatccatgtaagtcctaaccccactaaagtatcagcaaagtgcccgtctcctgccaataacttagctcttatgttctgcagagctctaaataaggcatcgtttttgcctcttgaatatttctgggattttggttccaagattccagatgttacaaatggcaaatttgggtttcggtgtctgacacagaaactcagaatttcctttataggagatagctactatgaataaaaatgaaactcccaaatttgagagtgggataagttaaacgtaatccacataggcattcaattacttgcgcatcaagtctctagttaacaggcatacggaagagacgagggttgagctgaacttcagagaaataagcagttacatcagtggggttgcgttaggttgaaagacattgcttcaggaaaccagagcaggcagatagtgggtttcaggatagtgctgtattttgaaatagtctctggttacagactcaaagccagcagaagttaatgtggaagcaaataacagactgttatttaccatctacttctgatgagggtgtcgttgtaattctatcttcagaatgatacattgcaaaagagtgtgacaaaaggcagtttgataacggggcttgtgtactccttaaaactaatatccattcagtacaagtaaatgtaaaaaatgatttttattacattacttatcaaaatcaactataagttatttctcaaaatggaagtgttgcaaaataataccaaaattttctttgaattgctttcaaatattcattctaaaccttatatgagtctacttgattgaaaggtcaattattccatgttctgaaatgggagacaattattttaagacttggcaacagtaaaacattaacagaattgaaggtaccccatggtcttaagaacactgggaaagcatgctctgtgttttaagcttctacaattgcatccattactcatatatgacccaggacacaaacagacacaaactgtaattaaagagctaaaatcaggatatagactaaaacaatcaataagaggcatgcttaaatataatgataaaaaatcaatatgactatgattgtgaatcaaaatgttttactagacacttaaggtttccatctacattaattttaggattttttttagcaatttggaaaacaactaagtcaagcttttctattcactaaactaacaaagctccttctaaagctttgttggataaagcctacttggataaatgggattgaaggaaagaaatcatggaggaagaaatggaaggaaaagaaaataaattttatgtttattgaatatctactaaatgactgacaagttcctaagagatttttctaactattcaaaaaatatttctagactcaaattctttaaaaatcttgaaatcaatgtagactaatcatttgaaataaataatttgacacaattttctaacaagtgtgtaaaagtcttctggtgtcactgattgtcttgttcaattctctgtatatgaagattttaaaagtcataaaaattctttctatttaatattctactcatgaatacagtcttaaataaaaatcctacttagctattgactggtgagtgaaggagtggtggatataggattacatcttgaaattcacttcctccggaagtcttccctgcctccccataccaggtgaggtctccactgcactttgtacttcctctttgtcaatgtcatcacattagtaatgacttatttggtatctggctcccctgatagacctaaacactatgagaacatggataacatctgctttccctctgggtactcagtgcttagcaaacagtctagagacataaaaaccacaattatgtttgtttaataaatggacaaaccaatattttcagggcatcttaaaaataagatggagcatttacattatattcttatatgtgcctaaataggggcagaaatttcagaacaggtaatttaggtagggcttatttagtttctttttcctatttgattgattaattaatttttttaatcaaaataccattgggcaagttttcagggcagcactgtataggggattagagattagagtcacagttatgccatgaacttgccatgtgaccttgaagattgttgcctgaccttgctgagtttcagtgtcttacccatttggttctcatttgagagccattgcaaagagttttggagagggctgaataaggcaatttatataaaaacattctgaaaactggacaaaattttaggcacacactactgatgtttgtaagcttttgggagaggtaggaaaactatttttatactgttagaaacatctttaagttctaaaaattgccaattggttacttcatgagcatggtaaataggcataccactttatcagtttcaaaaagaatatcagtcctcagttttgatagataacacttttctctatttgaaatctttatatcccatgtgtgtaagaataaaatattagctgttatatcttgaaggttaatcatatgaagaaatgttaatgttttatttgcagcattaaaaccctctaagaactttgtttacaagatctaaaaaaaattaggtggcaagaaattttacaaaaattaggtgatagaatttctcgattgctcaaaaccctaagcttctcctaaatatagaaatgtttctacttattttttgaaaacttatgggatcctagagacaggttgtttaattgggaaaccagttgcaacactgactccaactcatgctacccttattgttggccacgtaccaaataaggacagaaatggcttcttacaactttttagaattatgcttacaaataagcaaaagcagtgatgaaattgctaggctgagaaacaaaatcactcccttgggagaaagaaaaaagacccccaataccaagaatccctaaataaaaatctcatgtgctaaattttggtgctgtggattttttccgtgactgttcaatatcttgctaaatctggttatccatttgttggagccaacagtcataaactttcccattcctgagtacctgtcatcctcagaccccttccttacttggacacttcctgtgcactgaatgagtttgtgaaccaaacatcaccataatgtcgggttaacttttctaattcctcattttactatgatgatatcaaccacttatttggtgtttattctgtggtgtttattgaccttgctgagttataatgtcttatccatttggttctcatttgagagagagccattgcaaagagcttttgagaggactgaatagggtaactaacatgaaagtgttctgaagactctgcacagaattttagggtatactatatattatcctcataataatttatctgtgtgctttgtgttatttttattctgtatcaccactgaggaaacgaagacttacgaagttgaagtaacttgcccctatgatcatacagccaatgagtagcagatctgaggttaaaattgaggtccctcttaattgcaaaatgtatatcttaaccaatacatgcctggaatataagtaaatacaggaatgaaaaaggtcaggtcaccttccttgaagaattaaatcataagagaagttttgaactttcacaggaaaaacaattggtgtcaggtataagatctacatgttacttaatcttccaactcacgagcagacattattatcaccactttatagatgagaaatctgagactcatagaggttaaggaacttggctaacaccacagaggtaatatatgacagacatgtgagtccaagtcagttttgcttatctctaaatcttgtctccattgtggctggcttacctgagatctttcaattcctaattccaggacaaaattggcctgtgagcctggggtgggactgaggctgcaagtaggggctgagtgggttcaactgtggtaactagagagagaggaggcctagagtatagttcagcttgaggaaaagtgatcctgtcaatgtttgtatgcattgtgcactgccctgcactttccctctgaatattctacataggagaaaaatcacaacacttttcagtccatccaaccaaaggtaacaatgtgctaggggctacaatagaaatccagatgtttgagtaacagcaaaagaaaacagcttattgttgttatttgtttttgttttgtaacagaatatataaaacttagggtgccatttactagctatctctcagaaccagctaagaaatttataacagacatttacacaattaggctattattaataagacaattggactggttctggtttttgctttcagtgttaccactaattttatttctactggttcagtggagttaagtgaccttcccaagtttggaaagtgctaaataatggggccttgatgaaaactttagcttacctctaaattttagagaataagccatttttatattagagatttttaattaaacttactaccttaaaaatgtagaagtaaatttgagaacacacaattgttatttcattggtcagatgatatccagtaaaatcatttatccagcaaaattctgagttaaatttgacgtgtttttgtttgatatatatgctataggtgagtcttaagggattgaatttatatttgaaaataaaacaaactttggtcaaagaaacaaaattataactatgggcttttaggtctcaccaggcactggatggtgaaatgcatgaggcagcaagtatttttctaaatattctataagtgaccctaacaaaaacacacaaagctttgaaataaacagagctaaaagatatagactagtaagctactttctatatggaattttgttcaacagctaatcaaaccaaccagcctcccttcctttttttcttcctccctctctcttgcccacccacctaccttccttccttccttcctacctaccttccttccttccttccctcctttcttccttccttctactcacaaatgcatgtttagcatcacctcacatgtcccaggctatgccagctgcctgctagtagtcaatggtgaaaacaattcatgcccaaagagaacttagggctgaatgaaccaaaaactgaaactcaagggtaatacaaaatttgactgggcttaggtttatttaaagtatcagggcaataagaagagaaggaatataaaatatttatagaaataaaaaataacatgagctcttatttaagaaaaaatgtatataattaagaagaaggtagccaggtatgaagctcatgcctgtaatcccagcactttgggaggccaaggcggacagatctcttgagcccaggagttggagaccagcctgggaaacatggctagatcccatctctacaaaaaagagaaaagttagccaggcatggtggtgcatgcctggggtcctagctacttgggaggccgaggtgggagaatcacctgaacctgggaatcgaggctgcagtgagttgtgagtgtgccactgaactccagcactccagcctggctgacagagtaagaccctatctctaaaaacaaacaaacaaacaaaaacaagaagatgatttttcagatcatcaacattaaaaacatatcaaatgagttatttttggtgaaacgccagtttgtaacactggcctgggggaaatatttgggctcaaccagtcaattctttctattctgttaaagtggaaagagcacaggagagatacatttgtacagaagtttctatttcagcccagtgtgggtctaaataagggctccgtggctgggggtacagagatgggtcctggtgcctccttacaaaacttgcaaaccagcaagaatcttacctcggaaaaatatctctgtgatctgtggcagtaagctttttctcaataaaacatatcagtagtgctcacacattaaaactgacaaacggtccctttgaatccttcttatacacataaagaaaaaaataagcatgccttagtagggcaatcagtcctggaatagtccagaatgagctgaattagggatgtctaaaatataaacttgatagagcatataagatctgtttcagtagaatatggttcttgccatgtcaaaaagaggctttttccccccaagatggtattatgaacattttcaaaaatacagaaaaattgaaacaagtttacagtgaacacctgtgtatctactgtttagattccaacagtgacatttaagaaactgcttcttaacaggtgattatcatattaggtgagcaattattcaggtaagactcatctgaatactatttaggattgtgcctatgtttaacctaagttataagtctctatgttttcttctggagtctattttgaagggtggactttgtacaggaaagacaatttgtttttttctatgtcatataaagcacaaaataaatctgaatttctaaatcttactaacaaaaataaattcaggataaaaagtaaatctaaagatatgctcaagattatgagttatccaaatcaatacccatttaattgataaaagctatcaaccatgaagttttattccaggttagtcctaggtaatatgtttttgggattctctgaaataagaaaattgttggtaagttatgagtcagtcaagcacttgggaatgagataattgggagctttccacagttactgatattgtacaaactaaactataatatttataaatcaagagatgttttaataggtgagttgtttttgggttttctgtgggttttattattttgttttcttttgatatattttaaatgaacattatataaatgttaggccttgtttgtcatgaacaagacattgtacttttctataaatgaaaaaaattcaacttcaataactctatttttaatcaattatttctgatgtgcctagtgtaaaagtcagcttgctaacttctcagcaatttgaaatgcaggtcaaggtcagatgacattacaagagtgacagagaaaacctaattttagtctccatgaaactgaagaactcaacacaaatgattactgaacactcagcccatgtttggagttgtacgcttacaaaggcatcctatcaggaaggagcaagtactgcagaatcgtggaagaagctagtgtgttctcaggtgctccaagagctgtggaaaatctcagattcagactatcgactcctcaagtacattcaaagaacgtgtatttgcaactctagtataaactcattacagcagaagttctgagaaaatagccaatacagctataagtagcagaaagtggcattttccaaaaaagttaatgttaatactttgtttaaaagcatattataaaattgtcaatactaagtagaatctaattactcctgaaaagcatttctcatttaaaaatctattcattaaaatatgcaccaaaatgttgatcaagttatttctgggtaatagaatgatagatgtttttaaattttattttccataatgtttatattttctacaataaataaagatgacttttataatcagaataaatgaaatacatgttattaaaaaactagagtagtcaagtttctttttttcccaccaggaattttaggtttttagttgattagacttcaaacaaaggtcaagagtaaagacttttgaatcatattaaattaaagatgtctcatagatattttacacattggtgagatgtaaagtagtgagagagaagtcctgagaagccagataggcatacacatcatttaacacctatgatggtattatttaaaatcaaatcattaatagaatcagcatgatgcagtttgcagaagcataactagagaagacaagaagtctgccttacagagcctaagaagaggcatggcaaggaaaaagcaagagagagagaaagaagcagagctcttagtagatgtaaagaaatccacttcgtgccagtttgcaaggaaattttcctttatgaagagcagagcacttaatagatgtaaagaaatccacttcgtgccagtctgcaaggcaattttccttcacgaggagctagctgtttgcacagcgccctcttgtgaagagaggttttcgtgactgtaccttcaccccaagagccaaaaacttcaagtatccttccagagcaattgcttagctttcatcagctgaggattaacttccaaggctttttgaggatgcatgtatgggtatgagtaacacacagacttgacatccgaattctctattattaaatgtgcacataaatattccacagagttgtgcttcttaatgataatactttaaaaagaacttcctaaaataggaaattagcatctatgtttgttcccatgacttgtgaaacttgctcttttgctctgatgaatgctgtttctccattcggtaaatgaaaattgaaaaattgaaaattggggactacattaaaaatcaaaaattgtccattcatcttaaaaatatggagacatttatttataaaacgttagtatgcttatgagtgccatttgaaaatgcattaggcacctgaaatttcatatgatagtcactgacaaaaatattgccatttgagtaatataagaattagagacatttggtgtgcttgatttagcacgttaattagaataaaaatctttattcatgtaaatgattccactgatttgcaattatctggataactgctcagcaggaaaaaccaaattttggatacttcttgcaaaaaagtaaattactgtggaatatgatacaatgtatgcaggaagagttgtgctttatgtgatattctgactcaaaacaggagagaaaatgatttcttctcacattcagttgaacaattgattgggaagtgattacaaacttcactttgcctgtcagtgtctgtgctatgtatttattgaggagctcattcattgctactcactttcctaaccaaaccatcatgaaaaacatgcttagaaccctgagctaggtaaaatgagaatgtgtggcttagcacaaatcataattaaaaagcaatggcaacaccaaaggatgggttggggtgcccctccataaccgctacaaggttttccaaacccaccacaaataaatatgtgtcaaacataaaaacgatgtgctttctatgtaaatgcaaattcaagacaagtccccaagatcccttagcttccaatcaaattgtcatcacttctcaatctactactatctagaaattctactgtggcctttgctgaaagttcagagcattcattgatgagtatcattgtattcatgtggaagagatgacatgaggcagacaaggacggtaacaagtctgtgtaggaatctacacatatctagtgcttgtgcaatgggcttttgaataggcttgtgaaaaagactaacgcctcccaactgtatctccatccctgacattttgcctggttttcagaatagtatatcaatctccttcttggagattgacatatgggtatttaatagtcttaggtttaattccttccagggagactgcaaaatattggagtgcgtagtttatttggagaagaggcaggaaggcgattctaggaaatcaaagttaggtgatggagaagtgggatagcaaaggaagaaaagttaatacagtgtgtattaataagcaggggcagatggggcccaatctccccagggaccttttgtgggaccatatatacacatgcctcaggactgtcccactggagaatgtggaacctggggtatatgagcaccaactctggaccctcaatgttggagtgttgccactgggaatgttaaaaaattctgtaaacggtctcagcaggctcctttgtactgcagaaagcccccaggtgcctgagatgggaaactgactgagtctgccatagcctcaggtgaactctatagtgggtggagggaaatggggcagcactccaagcattttccacaaacaggactatcaaactcaaaatgctcaaacagaaccaccccaccactaaacctactcctcccttgaactcctcaagctcaataaataaaaacacacatttccaatttgttcaggccaaaaacccttgaattatctttgactcatctctttttctctcactctatgtaaaaatccgtcatcaaacacaattagctctggtttcaaaacattgccagaatctgatcacttctcgccatctccactgccatcacccgggtccaagtcactactgtctccttccaaggctattgcagtggcgtcataaccattttccctgcttctactcttgctcctactctattcttcacagagcacccagagtgatcctttgaaaatgtatgccatttctctgctcaaaaccctttactagtttccctctccatttgggataaaatccaaactcttttccatggttttcaaaagccctctcctctctttatggcctccttttctattctctttcttgcttactcagttcccacaatactcaacttcttcctgttccttaaacacaatgtgcctcctcctaaggagctttgcacttgctatttctttttcttgaaacactcttcctttggaaaaatgcataattcactcattttgttaagatttaaatgtcagtttaacagacagggatacctattctgactttttaatctaaaatcacactcgtattactatttctttactctgcactaatttttttcatagaactaaccatcacgacacacattttgaatgtgtttatgtatttcatatattttgtactatcctccccacaaaaaattaaattctttcagaggagagacatgttgattcactgctgtttggccaacaactagaatagggccagatagtggtaatggttcaatatatatttgctaagtgaattaattcactgttctgagagccatatgagataaatattgatacttattaaacacttaaacgttatgattgatattggcctataaaaagtgtaagcagcctctgctcaccagaagtatgaatatccaaggtgtagtgaaattatcagagtttagacctgtaagcttgtccaacccgtggcttgtgggctacatggcccaggatggctttgaatgtggcccaacacaaattcataaactatcttaaaacatcatgagactttttgttttgtttttgctcatcagctatcatattggtgtattttatatggggcccaagacaattcttccaatgtggcccagggaagccaaaagattgaatactcctgggagggtatattactgtattatgaacaatgatagttaggaaaagaaaggaaagaaaggttgagactggactgtgaaggaacttgaatgatacgttaggagtgggacctttgttccatttagaagtgaaaacttaccaagtttctctgaacaagggagtgaaataataaaagcagaattaatttcagaacaattgatattttgattctacttgcaaggacttgagcaggaaagattagaggcagagagacaatgtcgtgaactttcccccactcgaatcctcctttttcccagtattcaagacactggcatatgtactggcatatatgtactatttgcatcttttaaacttagtttgaagactactgtatcatcaaatatttttcatactcagttaaggtggtttttgatcttactgcgatgttaaactaccacactttgtttagctgaaaaaaaggtctgtccatggtttctctggattggaagtgaacctactatagatatgaaaagctcatattcattcttcttcaggttacctaaaaactaataactaaagtattagaaaaagataagtttcggtatgaatatactataggttatctggtgagacacagttatgagtcaacgggaataaacacgtcaaaggcatctgtagtgcttagcaaagtttctttacatctctaatttgtttcttacccagggcaaaatgcaaactgcagtcttcttttctctaaaggagtattgtaaagaaaaagagtggtatatgctcatgttctactggactctgaacctcctggggctgtataaccctgggactgcccagcacagtaggagtgaaataaatgtatgttaaatgaatccatcaaacctcttagaagacagactccagggaaatttcattattttgttctaaattatgctttccctcatgtaatgaatatttaattctgttttgttccagaaaggactcaaggcttctctatttcctttagtaattagcttaaataagccaagtcatccatttctctacctacccaatggacaacagaagaagcttacgtgtctcatagctttatctgtaccttgatatgtttgagaatatttcatatacataaaccagcaatgatcatttgaggaaataaaccagtaaactttacaagcaattgtaatttgaggatataaactttaaactctagaatgttggacacatctttgaaaataattccaaataactaattgaatctattagtttatgttacaagccaatttggttcaaagttttaaaatgaagaaaaaaattgtataaattgaagttttaagcatagtttaatgaaatcagctagtctaaattcaatattttcactcagttcatcaaattatttgaaaagtaaacacgtgggctgtacagagaacagtgaatcctcccctaccctgagctatcactcctgcttgtggggcacagagaaggcattcagacctgtgcctgccaccaccctacccccagccaacaccacctccagtgtgactgtgcacacaggctccagcaagggcctcctgcccacctctgtaagctgcattgcctctgccactctggtgaacatctgcaaggaggcaggcacccccacacccactagcacttcactgcagctgtcccatctcagcacccctagctgagtggattccaaaacttgaagaatgagaagacaaagtttgggcctcatacaagtcccccagagttagtgcacacagtccagaagttgggagctgagtgttggacccctaaaatcttccagaaatgaagccaatcagctgaatccacctaataccacaatcaaaccctcaaggtcatcaaataggataaaaggaaaaaaaaaacattcaaatgtcagcaacctcaaacattaaaggtagaaaagtccacaaagatgagaaagaatcagcacaagaaccctgaaaactcaaaaggccagagtgccttttttcctccaaacaaccgtgtcccttctaaagcaagcttctaaaccaggctgagatggctgaaatgacagaaatagaattcaaaatatggattggaatgaagatcattgaagtacaggagtatgttgaaacccaacggaaggaagctaaaaatcatgataaaacaatgcaggaactgacagacaaacagccagtatagacaagaatgtcaccaacctgatagaactgaaaacattattagaatttcataatgtaattacaagtactaataacagaacagcctaagtggaggaaaaaatctcagaaatctcagagcttgaaaactggctttctaaaataagacagtcagacaagaatagagaaaacagaatgaaaaggaatgaacaaaaccgagaaatatgagattatgtaaagagactgaatctacgactcattggtgtccctgaaatacatgaggagaatgaagccaacttggaaaacatatttcagagtgttatccatgagaacttccctaacctagttagagaggccaacatttaaattcaggaaatgcagaaactcctggtaaggtacttcacaagaaggtcatccccaagacacacaatcattagattctccaaggttgaaatcaaagaaaacatgttaaaggcagctagaaaggtaaggtcacctacaaaaggaagcccatcagactaactgtggacctctcagcagaaactctacaagccagaaaagattgagggccaatattcacaattcttaaaaagaaattccaaccaacaatttcatatctggccaaactaagcatcataagtgaaggggaaataatatcctgttcagacaagcaaatactgagggaatttgttaccaccagacatgccttacaagaactcctgaaagaaacactaaatatagaaaggaaagaccattaccagacactacaaaaacacactgaagtgtacagaccaatgactctataaaacaaccatataaacaagtctgcaaaataaccagctaacatcatgatgacagaatcaaattcacacataacaatattaaccttaaatgtaaatggactaaatgcctcaattaaaagacacagagtggcaagctggataaagaatcgagactcactggtatgctgtcttcaagagacccatctcacatgcaatgatacacataggctcaaaataaagggatggaggaaaatctaccaagcaaatgaaaaacagaaaaaagcaggggttgcaatcctagtttctgacaaaaaagactttaaaccaacaaagataaaaaagacaaagaagggcattacatcatggtaaagggttcaattcaacaagaagatctaattatcctaaatatatacacacccaacagagagaaacactcagattcataaagcaagttcttagagacctccaaagagacctagactcccacacaataatagcaggagactttaacatatcactgaaaatattagatatatcatcaagacaggaaattaagatattcaggacttgaacttagcactggaacaaatggatctgatagatatctacagaagtctccaccccaaaacaacagaatatacattcttctcattgccacatgccacatactctaaaattgatcacataatcagaagtaaaacactactcagcaaatgcaaaagaactgaaataataatgaacaatctctcagaccagagtgcaatcaaattagaagctaaggctaagaaattcactcaaaaccatgcaattacatggaaattgaatgccttttctcctgaaatcctgaatgccttttgggtaaataatgaaataaaagcagaaatcaataaggtttttgaaacaaatgagaacaaagatacaacataccagaacctctggaaaatagctaaggcagtgttaggacagacatttatagcatgaaatgcccaaatcaaaaagttagaaagatctcaagtcaacagcctaacatcacaactaaaagaactagagaaccaagagcaaataaattccaaagccagcagatgacaagaaataaccaaaatcagagctgaactgaagaatattgagacacagaaaaccattcaaaagatcagtgaatccaggagttgttctttttttgaaaaaattaataaactacatagaccaccagctagattaataaagaagaaaagagagaagattcaaataaacacaatcagaaatgataagggggatattaccactgaccccacagaaatacaaacaaccatcagagagtattatgaacacctttatgcacataaactagaaaaactagaagaaatggataaattcctggacatacatactctcccaagactgaatcaggaagaagctgaatccctgaatggactaataaaaagcactgaaattgagtcagtaataaatagcctaccaaccaaaaaaaccccaggaccagactgattcacagctgaattctaccagatgtacaaagaagagatggtaccattcctgctgaaactattccccaaaactgagaaggatggactcctccctaactcattctacaaggccagcatcttcctgagacaaatacctggtagaaatataacaaaaatttaaaactcagaccaatattcttgatgaacattgatgcaagaatcctccataaaatactggcaaaccaaatccagtatcacatcaaaaagcttatccaccacaatcaagtaggcttcatccttgagatgcaaggttggttcaacatatgcaaatcaataaatgtgattcatcacataaacagaactaaagacaaaaaacacatgattatctcaaaagatgtggaaaatgcctttgataaaattcaagatcgcttcatgttaaaaactctcaataaactaggtattgaaggaacagccctcaaaaaataagagccatcaatgatatacccacagtcaacatcatactgaatgggcagaagctggaagtattaccattgaaaatgggcacaagacaaggatgccctctctcgcctttcctattcaacattttggaagtcctggctagggcagttagataagagaaagaaataaagcacattcaaacaggaagagaggaagtcaaactatcccagtttgcagattacacgatcctatatctagaaaaccacataatctcagcccaaaagcttcttaaactgataaacaacttcagcaaagtttcaggatatgaaattaatgtgcaaaaataactagcattcctacacaccaacaatagtcaagctgagagccaaatcaggaatgcaatcccattcacaatcaccacaaaaagaataaaatacctaggaatacagataaccagggaggtgaaaaatctctacaaggagaactacataacactgctcaaacaaatgagagacgacacaaaaaaatagaaaaacattccatgatcatggacagaaagaatccatattgttaaaatggccatactgcctgaagcaatttatagattcagtgctatttttaataaattaccactgagattcttcacagaactagaaaaaactattttaaaattcatatggaaccaaaaaagagcccgaatagctaaggcaatcctcagcaaaaagaacaaagctagaggcatcatgccacccaacttcaaactatactacagggccacagtaaccaaaacggcatggtactggtacaaaaacagacacatagacaaatggaacaggatagagaacctaggaataagaccatatacctacaactatctgatctgtgacaaacctaacaaaaacaagcattggagaaaagattccctattcaataaatgatgctgagatagctggctaactatatgcagaagattggaccccttctttataccatatacaaaacttaactcaagatgtattaaatagttaaatgtaaaacccaaagctataaaaatcccagaagacaacctaggcaataccatcttggacacaggaacaggtgaagatgtcctgacaggccaggtgtggtggctcacacctgtaatcccagcactttgggaggctgaggcaggcagatcacgaggtcaggagatcgagaccatcatggctaacacagtgaaaccctgtctctactaaaaatacaaaaaatcagctgggcgtggtggcgggcgcctgtagtcccagctactcaggagactgaggtaggagaacggcgtgaacccaggaggaggaggttgcagtgagctgagatcatgccactgcactccagcctgggtgacagagtgagacacccatctcaaaaaaaaaaaaaaaatatgtcatgacaaagacaccaaaaccaattgcaacaaaggcaaaaattgacaaatgagatctaattaaactaaagagctcttgcacaggaaaggaagctgtcaacagagtgagcctataaaatgggagaaaatttttgcaaactattcaacaaaggtctaatatctagcatctataaggaacttaaacaaatttacaagaaaaaacaaccccattaaaaagtgggcaaaggacatgaacaggcacttttcaaaagacatacatgcagccaacaatcatatgaaaaagtcttcaacatcactcatcattagagaaatgcaaatcaaaaccacaatgaaataccatctcacaccagtcagaatggctagtattaaaaagtcaacttatacactgttggtgggagtgtaaattagttcaacaattgtagaagacagtgtggcaattcctcaaagacctaaaaaagaaataccatttgacccagcaatcccattactgggtgtatacccaaaggaatagaaattattctattataatgacacaggcatgtgtatgatcattgcagcactattcacaatagcaaagacatagaattaacctaaacgcccatcaatgatagactggataaaaaaaaatgtggtgcatacacaccatggaatactctgcagccataaaaaagaatgagatcatgtcctttgcaggaacatggatacagctggaggccattatctttagcaaactaatgcaagaacagaaaaccaaataccatatgttctcacttattagtgggagctaattgatgtgaacacatggacacaaagaggggaacaacacacactagggcctaccagagggtagaaggtgggaggagggagaggatcaggaaaactaataggtagtaggcttaatacttgggtgacaaaataatgtgtacaagaagcccctgtgacccaagtttacctatataacaaacctgcacatgtacccctgaacttaaaagttaaaaaaaagaattcagaagaagaaaatgaaagaaaagtaaacccgagtgtatagtcctccatctcctaggttctaaggattaaaagctccaagaaaagtgttagaaaaatacatagtgaattaagaaaaaattattccttatagttccaacgttgtgtctttgcttatactatgttcacccttttaggtatgtttgtacaaaatgaaaaaggaataaaaaccaacattttagaggataattcatgctactcaaaacaatcacgaggaaaagctgggctgaaactagtgacaagcttttgcattgtgccacattgctgtcacatttttgcccatattatttatgagatttcttcaaaatttttataccaggtcattcttaaggaattctttgctcaggaaaaagtccaagttagcatccttcagacccctgctgtctctccagctcctctccacacacatccatttatagggaaaggcaagggcagaaagcagatttagaagagaaaaaggatagaggagcatgagtgtgtgtgtccacgtgtgtgtgtttgtgtgtgtgtgtgtgtgtgtgtgatgtgtcctgctttaccacagtccagggagcttacagggaagtccatgttcaatatcagcactgcaggcctctccagcaggcccttgttccttcctggtcttcactgcctagtgcacggcaactaagccacaacacccaaacctgagacaaatcatcccatcccagggctaaaaaagtgactctaatgatgtgtctgcgtaacaatcaataattcatttaaattgattgcctgatacataaataatttccttataaccttctgacttttagcaccactgatctaagaatcacacctaaaaaagtgctgtcagaatgcaaaaatagttttctgtttgaataatacttattttttatgaccatatgaatgatgaatattcatgatagaaatttggaaaattcagaaaattaaatttttttaaaaatcatctataccgagaggcaacttgtaaatctggctcattttctttatttttatatgtatatacatatatttacgcatctaattttaacattcaattgagatttgatgtacataatttttggattctgctttgcattcatggtttactataagccattttctctatcacttaatgtcatttgaaaatatatttaatggttgacaagattctattggctgggtctaatatgaaaatttatttaaacattagttcatgtgaaatacatagaatatacctaggttctcaatattataggtatttttacggtgaatatctttgaatataaatattttaatatcccaaattacttccacaatccaaatatctacaagcagaattactaaattaagaggtaggattttaaaaatatcaatgtttattttagatttaggggctacatgtacaggtttgttacatgagtatattgcgtgatgctgaggtttggggcagtgctgatcccatcacccaggtggtcagcattgtacccagtaggtagagtttcctcccttattcccctttcccctcctggcttttggaatcctcagtgtctactgttaccatctttgtgtccatgtgttaaagggtaggagtaattttgaggcttcaagcttctgctgatttttaagcatttttctgaaataaaactttcaaattagttcataaatcaatgtaacagatgacatctgtcaatatacattattatatgcataaatcatatgcataaataacatgcattattttattatgattttataaaagattgacacaacataattcaaaataacttatttactacaaataggactcaccacatgaaaattagaatctaaagcaattaaaaaaactattaggaaatgaaaaaaaatcccatcatataaatcctcaattttggccatattttatgaaagggccaaaagcaatcaaaaaaaaaaaaaaaaaagagagagaaagaagtgagaaagaagtaggaaaaaaagaagaaagacatgtggctattattacagcaacatgaaggtggtcaaccacttcaagtttttgtggtcagtgaggtcacaagagctacaggctgacatttcaaacaaattatgcacattgaggtcacatcgctctacttcaggcagtttctcataattgtagtgttctgtttacaagaggtccttgacttaaaaatgtccttttgtgccctctagtgtttaaattcatcaaagcttttgagaagttcatatcttgtttctgaactccagttgaacaacatttcattcttagaccaagtgtttatctgtatctgaagggggccaacatacatcttgttccaaaatctctaaagtttacttaattttttttttatttcaaagggagctaggtaggggttggaaaactaccacagagcaaatcctgcccactactttttttcattttgtaaataaagtttattggaacatattatgctcattcattacagattgtctacagataactgcatttgctctgcaacagcagagttgagtagttactacagagttcttgtggccccaaaaggctaaaatatttactatctggcttgtcacagaaaaagtttgctgaccctggagctagagctctgataattagattggatgccatgacattttacaatgccctttaattccactccctttccatcaacccccggaatactagttaaaacaaagaccattgtaggccagtccattagctttgtggtccaggtacaaactttgcagttttagtgaaaccatttgttaatttttatttttctaatatttacttagcttgataatatcaactccgttctgatgacttcgatattaatatgattatattggagagaatataatgagatcaaatcgctttacccatcaagaccaggaactgaagaacttcttcctcctttgctacctcatctcttagctagaacttaggtgagtagattagtatcctcattcctctttatttttatataattaataataatatttgcaattattttgagaaacatatatctttttttgaataaagtaaacataccgtttataattaatatggaatttagtttaagttcatgcttgatttaaatctcacacaatcacctcttttatatactaatgaaagcacggtgcacaataataaagccgtggtcctatgtggtcaacttacaggctaccttctttcctcagtgcaaatatcacgtctttctaagtccctctaatattttatcctctcttttgtgtatctagaagctttactgaaacttcctactccttatctgaaatagttgacatatagttaataagagcttttttccaggaagtggatctattttattgctttctaacttaacatgtttcagaatagttacagccattttttttattcaaaggtacatgtcagcaatagtctggccagaaattttgcacaataataggagaaaacaaaaaactaggggcttagaaaagtgaatgaaaacagttttcagttgattattttgttcctgaaaaggcatcttttcctcatgacatgcattcatggccattgtagattacatgcctggagctgcccttctcagcctttcaacctctcattacatgcatattctttcctctgttctttacagtcccccatttccctgacacagaccccgcactacaatcctcttccttatacttgacacagaaataatttaaacacaaacccaaatacaaacactgcatagatttaccatatggaatcacatatgtaaaatttctgaatcaaataacgcaaacccacaatgttactttccaaatatatacaacaacaacaaccgaatgggtggtgaaacatattacttatgaaaggtgctcaatgttaaaagcaattaaaataaaattcagaaaaaagtgataccatacctctattccacaagcaaaaaaaatttccaaacttacctgcaaaagaaaagaacaataaatctcaaatcagaggatattttatttttttctagtaaatttggcaaaattgtcatcataaatatagttatttcttaattatcactgtgtatatcactctctgtaaataatgcttattggttcttatagataccaacagggctggcagtgacattctctaaaggccaattctcatagtccatagggtcattttccatatgtaatctgcttcataagaaagtttttagaacaaaaacttaaacaattccctggacccaggaaatctgcattacaagacatttttgggggtgctaaatccaaacaatgaaaaaagaaaaggttttggggtcagactgacctggactgaaatcctagttctactgtagcctggtaactcaagccattttatgtctgttgagcctcagtattttcgcctataaaatggggacattatatttatgtaattcaattattctaagcattgaagtcattttgtggcatgctgtagacactcaaaaaatattgccttcacaccatcctgtaagctttattttatgccaatactttgctgaaacataaatgcttagtgcggtatctaaagcatggaagagctttaagcaattaataatggatagaaaagtaacaagttttacatttccatcttcatagtgtgaccaagttggtttacatgaaatattaatcatcttctagatgctgggcaatttatttcccggtgtaaattcaagtgtttcactcagagttcaatcaattaactgagagtatggcagtctttagcacggtctctacatcccatatattcacatgatgccccctattatgtccccattcacgatctcacttatgtcccctcactgcagcctcactagccttccagccattcctggaaaaatcgcaagcctgctccagtctcaggatatttgcattccctgcccatttgcccacgaatctatccccactccccttcaatccttgcctcaaagggccctttctaacctgatttccctattgcaaattctaaccatattctcagcctctgtattgaactcccctgctattgcactatttgttccctagcactgagagccttctaagacgctacacaatgtatttatttactatgcttactgagtctctctgtccctaccactccatataagctacacagaaataggggtgtctgttttgttcactattgaatacccagaacctggaacaatgcctggtaaatagaagctattcaaaaaacatttgtttaaggactcaataatacacatatgaaaaaaccaaatataaaaatataaattatacatatataatccatatgtatatttgtttatatacatattttgcttatatacctacatatttatcacacaaatatttacatgctgattatccataggaatttttaatttttaattaaatttttagctagaagtaaaccatttttgtttttgtttttgtatttgttttgagatagggtctccctctgtcacccaaactgaagagcgagtggtgcaaacacggctcactgcagtctcaacttcctggactcaagcaatcctcctgcctcagctttccaagtagctgagactacaggcccatgccaccacacctggctatttttttatttttttagttttttttattttttgaggagacggtgtcttgccaagttacccaggctggtcatgaactcctggactcgagcaatcctcccacctgggcctcccaaagtgctaggattataggcgtgagccactgcgccaagccctattttatttttacttaacaattattatgagagaaattgaggcaaccattagcgatactggctctctctttgtagctctccaccctcaggacacatgtagatgcacttaataaccctcttgtagttgaatggagccacgtgactaattctggccaatcagcagccaagcgttgattcgctggtgtgagactctccatctcttcccctttctccttctgccagaaggatcaacaaagtccatgatggtaactctgtcagtttctgtaccagagtgaggaggctgtgcagcagagctccctgtcgatgatatgtagtatgggaaacaacaatcactatcatctttgttgttacaagatttagaggttgtcagggcaatttaactcacccatcaggataaatagagaaattatgcacatataattttaaaattatactgaaaaccttattcaaaaaacagtctgcaaaactatactatatatattcattgtgaatgctctttctcaagtcattttgtttctgctggtaattaactctataattctaagtaatatgcttatactgggtttttttttcttgattttcatttttttagccattatctattcatttcttatcataataaacatttaattatcttatactgatctccagttcccttttttcacctagttacatcacaatttttagttaaattaacaatcactgtttacatatttttactatatataaatcttatttactatgtatgtaatatatacatatttgctttacggctcaacttctgttttgctagtagttaataattgctttggttcttttccaaatggtactcatatctgccacccctctcagatgctctagcaaattggataatctatcaatttcattttctcttttcagcctcctcctcaacaccttgtactcttgcttcaatctgtacttctcagctagttgctttctaggcccgctagaaatctgacatcctaagcattctttctgttatttcccgtgttgattattggatctcatgatttcctttttgatagcttcctgctttttgtgggtcacattttatagaagctcaagtggcaaatgaagtgaatagtattaatattttacattttttggatcttgcatcactaaagatggctttattctgtctttacactagttcatagtttgacttgctaaaggagtctatgttgaaatgtaaattccttcaaaatattgaagccattactctattgtactccagcatctatttttttaagtaatttatcattaatctgattactttcattttaggtagagggtggggtaggaggcaaggtttcagcattcatgatgctgactcttctggatgttgaaatgcactgcccagaatcccctcagcatgtgtttctccagtagagggtatactgctcttgcccaagattatacccatttatacagagcagtctgcagacaatggctatttgataaacgggaaggagatagtatagagtcctaaccccttcctctaagttttagaaaccccaactgaaccagaagaggcctccattgagcctttaaccctgttcctactcttcttcctgtggtgctcacactgagaacatttccccacaaacaccctgcatcccaatctctatctatctcggagtatctcagggaaccagatctgcaccacagacattcccttcattccttgtttcagccccacacctcatccctgcagggtgctacatcttctctctcagagtcctgaccctttctgagaacatttctctagaaaataaatcttgggtatttctgtggtagggtgtgcgggtagaaacaggagccttggataggatgtggggaggcagccttctcttccattctcacacctttccttttaaattcctccatttaattacagataatatgaacatatggtccattcactacaattgattaggagtccattcttttagattgttggttcatctctgttggcatgaattaaaaacaattttatctattaaaagtagaaaaggtataagaacattttccaaactgttacattgaatactagtttttgagatgttaagagtccagttgaataataaaaacaagaaaaagactagagagtcaaataatttgtaaatatggcttcaaaatcttaaagaaaatatttctttttattacgtgacttctaagagctttaaatatactaattggaatgtgactattctagaaggtggagagcatttgcagagtaattagaccattcccctgtagacggcagttaatatcagagtaagccatgttttagaatatgacttgggcctgggcatggtggctcatgtctgcaatcccaggatttctgggaggctgaggtgggaggatagcttgagcccaggtactccagcctggggcacaaagcaggaccttgtcaagaaagaaagaaagaaaaagaaaagaagggcagggcagcgcaggaggaagggagggagggagggagggagggaaagaaagagaaagagaaaagacaaaaagaaatatgccatgggaattgctgcacaaagcatcttaatctaagttttatactaatcacagggcttctattactcctacaagaattcctttaccttagctggagaggtaaaatgaattgctaaacacttaaaaaccagcatgactgtaccaaggaataaaacatgttaactctgtttcaggtgagtgctttctccattacatcaaattgcctgcttacttaaaattaatcataatatttgaattaggatcacgtaatgtaaaaaaatctcatttcccagaatattctacactagaaatcaatttctcactatcctgctgaaatttgtccaagcaatctgcatatatttttaaatctatcttttttatctctagttcagcatgtgccataatgttctctgtggagcacccaaccccattactctgtaagcaaacaaaaagttaactatttaataaagtttggaatattttgcctatgtatctccttcctggatatttacaatatttatttagcttccagtaatatatcagtttaattttatgaagctcagcttatttgaccatgcaaccattttgcaggtagtacctgttgatattagcattccacaaaacctactttgggaaatactaacctaggttactaaggttcatactagcaagagatgaataagactaactattataaataataatggagaaaaaaagagctccaatgatctgacacagagaaatggattttatgaagggacatgatttctcaatgagaaagaaagaggaaacagaaaactaatagttccattgtatttccatagttagggtggcgtatggttaggattctttgttcagttttataaacctcgtactgtcatgacttcattaacccaaggctaagctgtaattctaaaaggtatatatatatttaaaaattgacaaataagaatgtatatatttatgatgtaaaacattttatttacatagatgtatacattgtgaagtggctaaatcaagctaattaatatatacattacctcacaaacttatctttttttgtggcaagatcactaaaaatctactcttttagctattttcaagtatgcaatgtattgttgttaactatagtcaccctgaggtacaatagatctctggaacttattcctcctgtttaactgaaattttgtgtcctttgactaacattgccccagtcttcagcccccacccatcagccctggttaacaaccattttattctgtttctatgagtttgacatttttagctttcacatttaaatgagatcatgtggtggttgtcattctgtgcctgacttatttcacttaacataacgtcatccagattcatccatgtgatcccaaatgacaggatttccaaaatatataaggaactcaaaaaggtcaatagtatgaaaacaaataacttgattaaaaaacaagaaaaggatctaaacagatgtttctcaaaagaagccataccaatggccaacaggtatatgaaaaaaatgttcaacatcacttaataatcaaggaaatgcaaactaaaaccacaatgagatatcaactcatacctgttagtacaaaaaagatgaaagatggcaaggatgtggagaaaagggaagatgtttacactgttggtgggaatgtatattcacatagccattatggaaaacagcatcgaggttctttaaaagctaaaaatagtactaccatattatccagcagtttcactactaggtatatatccaaaggaagtgaaatcagtgtgtcaaaaagatatttgcactcccatgttcattatagcattatttacaatagcaaagatacagaatcaacctaagtgttcatcaacaatgaatggataaagaaaatgtggtacacacacacacacacacacactcacacactagaattctacccagccctgaaaaagaaggaaatccataataacatcttttattttggatagaatggacatcaagggtatttgtgacagatataccatgaatgacatgaacctaatattaaatatttatttttgttgatgtaaggaacattaatagcctagaaactataagttttaagatttagcttaggaactcaaacgatgtagcaaatatatttcatcatgatttgatctatctatatcaatcttataaaattgtgtgagcatgaggttttggggatgaagagataatggaatcaaattttagcttttacccccaaaccttctagactttaattgtatattatgtaaaatgtaagtatttaaaatatgaagttcatgaatgggttcatgagtcaaccgcaggggagttggtgaagcccctgaaactatatgaaaaattgtgtgtacatttacatttttcaagagagatttgatctagtcaaattttcaaagcaccctgagatacccaaaaagtgatagaccccttaaagagataatctctaagaattctgtctcctttttcattaacagttttataagctttcttatgaaaagtatgtcatgtttatgatatttagtaatttctttgctgagccttcatttttagctattcaagaaatttaaaagtaaattgtaaatattacaattagtttctaaggattgtttaaaatatcattaattatataaaattttaatatatattttcagttcttcagctaggacagacagagcctctttaaaagattttatttgatgctgggaagggtgctgggaaaagagaactcctatacactgacgatgggaatgtatattagtacagccataatagaaaacagtatggaagtttctcaaaaaactaaaaataaaactatcatatgatccagcaatcccaccactaggaatttattcaaaggaaaggaaatcagtatattaaaagtacacctgcacccccatgtttattgcagcactattcacaatagccaagatatggaatcaacctaagtgtccttgatggaactggaggtcattacaataagtgaaatgagccaggcacagaaagacagatatggcatgttgtcactcatatgtgggagctaaaacagtggatctcttggaggtagagagtagaatgatggttaccagaggctgggaagagagaggtgggatgaaaagaggttagttaatgggtacaagcatatagttagatagaagaaataagttctagtgttcgataacacagaaaggtgactatagctaacaataatttattgtatatttcaaaatatctggaagagctgaagtgttcccaacacaaaaaataataatcgtttgaggtgatggttatcttaaataccctgatttgatcatcacacattgtatgcatgaatcaaaatatcacatgtacctcctaaatatgtataattattatgcatcaatacaaatatttacagtaaaaaggagatttgaattgtaagaaaaaaagagaagaaattctatttttgcaacttataatagttattatttgtgtgagatactcacttgcccacaagatggcgctctctaattttggatatactattttcccaaaccaatttctcaagaagttatttctaaagtgttctcttccctgaaaaataatatttacaataaattattcttcactactgtttgattttcatgcttgaacatctaacaatgcatgacaaagtatatgttaatgtttttgtgtgagtggattgatgaatggatgtttcagacattcacagaatgtttactaaatttctgctgcataaacagctttgcacagtggatttataaacaaagaaacaaaaggtgttaaagtataaagagcaaatcagggttactatttttcaagttaatatttttatatccaagagtttcatatttaaatgaaaaatgattgttatagacatgtaaatgtacagcaaagagaagacatcggttcagttaggtaaaagaccttataagttgttgtgacttatgaagaactttaaggtttgtatgagaaggaggtaaggggaagatatttaagaggcggcaaataacataagaaatagcttgaaattatgtagtcatgccatcccaaaataaaatggcctcccattagataaggctagatgagttacagagggtggtaaaagtcactccaagaggaagaaaaggtaactaatatttactgagaacataatataactcatactgttatttaatgatctttccccacccttgaaaatacgtggatgtgcctcttattagagtgttagaattatggtgctatatttggatattttgagtaggttgcacttccctaaatgttgtactaaatcccagtatacagtcaccagaggaatagagatttcccagagaggaaatcagagttaaggaggtgagccttaagtaagcataggaggagactaaacttctctgtcttgattctcaatctcttgagtaatgactatgtcttgtggagccctctcttgtgggaaagttaaagatggcctctgctgtccagtgtgaagagggagtcagaagaagagtttctcctaggggacttcatttgaataagatatctcctatgatagaacaaattatctagtttcatgttactttgattctacatagtttgtcagtaaagtgttgctttaaaattcctgctttgtctcagctgttaaacaaagaaaaggatttttttaaaacccacatttagatcaaattgacttaaaaagagtacctgtctgtccaaaggatgatggtagtgagaacaacaatgagaaagaccctgaaaaaaagaattctgcttctcactgatctctctttcttcccttattcccctaaagtcatctccaaattaggagtcagagggatcttgttaacatctgtttaaaggtctttgtttaataaggcaaagccactagtaagatgaatagagctctgagtccccttctgtttcatctccaactttttcccttattctccactttgctacttcactccagccaccaggaccttcttactgtccctccatgatggcaggaggactttttgtacctccttcatgtttgctcacatgctaccttctgaatgaggtctttcctaacaccacttaaaattccaccacccaccacacacacattcgttaacctcttctctaatacacttttcttcatggtatttatcacaaaatcttccccatacatatttttaaatatagatatataaataaatatatatttctatatattacatatatatataatatataaattattttcatctttcactcccagctggaatataaactccacaagggtagaatttttgtctgtttcattcactgctgtatttttttttacagtacagagaagaaagctcagaacatagtatgccttctgtgataatcctgagtgtgaacttgagtggatggaaggatacaaagtattgatcctgggtgtgtctgtgagggtgttgccaaagaagattaacatttgagtcagtgtgcagacccactcttaatctgggtgggcacaatctaattagctgccagcgctgctagaatataagcaggcagaaacatgtgaaaagaaagactggcctagcctcccagcctacatctttctcccatgctggatgcttccttctctgaaatattggactccaagttcttcagttttggaacttggactggctctccttgcttctcagcctacagatggcctattgtggaacgttgtgattacgtgagttaatacttaataaactaccctttatatatatgtgtgtgtgtctatatatatatatatatatattccattaattctgttcttccagagaaccctaatataccttgtcatatttattgaatcaactttttaaaagtctaatttctgtgttctcttgaaaaatcagaaagcctgccaaccctggcctatattttcacatgataacaactgtgaggagctcagaagtcactgcgcatgcaggtgaggatatatctataccctccttgcccaggatccccctgccttctccatttgaatagctcctggctcctgcagatatgtgagttgtgacctgctggaagagtcctgaaagggagagtgacaggatcaaatgaagactttcagtaagtcacctggaaatagtgtgtaggattaatttaacgagtctggaggttgatgcctgttagtatctgctgtcgaagtcctggcatgaatggatgaggacctatgtgatgtgaactcagctgaagaatgaaagacaggggaagtagagtttgaagaaaggattaattgaacctgaggatggattggatattaaaaatgaatgaaaagaaaaagtaatgatgactaaaatttctagactggataattaggaaaatgttaatttctgatgtaaaagggaactcaggaaagagtcaacctaggacaaaaatcaaaagacctacatatggaaagaaatatactgatttgagtgaacccaagcagagtttgaagacacagattcaaaggtatttgacaacaaaaaaaggactttgagatcaatgccagagatggggactcaattttgcatactgcttatatactgcctacgtaaaggcactttatgataaagaacatctcaaaaaaataacatatagaacaaggggcaaaaataggggataaaagagatgattcccaattattggtcaagtggttggagtgagaattaaaggcaaaattcctcttctccccctcaaaattacacacaactacacaaacatatgtgttaatgattttagtgtgttgaatctggctgcttccacactgcatgcatcctacctttctccattcacacctgagataatctcattctagtgaagtcttacattataaatgacaacaccaatatttagggacgttcctcttttttcttcactgactttgcctttccaaacaatatactttgtgaatcctctgagaaaaaagaaagtagtttgatctgctggtttttaggacaataatttttaaaggacttgttatttttggttcagacaccatgcaaaactcatcttcaatcaagggcaggtgccaggtacagcatcaagaaagtaacaggtggtttctcttcctctcctttcctctaaaacatgaataaaacaaaagttttagcatttcagaaataatctttttaattaaaagtggaagataaatgtgataaaagttttctttgagctcttgaaaacaagttcattctataagggttagaaatagtattttttatctgtcactagagccattgtactgtggggcctaatgtttcagattttggatactcatttctttcgattgaaggtgtcatcaggtgttttccacctttagtgatctcaagtggttccccttcagttgctaaaatatactgtgtcgtttgagcagtccaagacccacagagatctgctatctatattggcagataaatgacagcagatggaattgaggctgtgttctgtctcatcggcaagcctgcagccttagaagaagagatgtgcccctgaagcattatgcaggttgctcatccagaatcagtgtcactgtcatagtttgtgaaagggaaattggcaaatctctatacataataggcaaaatgcaaccctctcaattctcaaaggcatattctcttcactcacatttttgtctttttgctgaagggaggtttctgggccaagatgttctgacagcctggtattttctttttttgcccaatgtgtaagaagataattaatgttaccattaatgcatgcaatgacattagtatcaattcccttagtgatatatatgcactaggaaatgaacacaaaagttaattaacaatttattgagcatatactatattacaagtttactatacaattgtgctttattactattggtgaaaataatgaaagatggcacttttctattcttcaccatatacaaggcacagttccaaggatttaaaatctatcaactttatgaatctttacaacaggaggagccaagatggccgaataggaacagctccggtctacagctcccagcctgagcgacgcagaagacaggtgatttctgcatttccatctgaggtactgggttcatctcactagggagtgccagacagtaggcgcaggtcagtgggtgcgcgcaccgtgcacaagccgaagcagggcgaggcattgcctcactcgggaagtgcaaggggtcagggagttccctttcctaatcaaagaaaggggtgacggatggcacctggagaatcgggtcactcccacccgaatactgcgcttttccgacgggcttaaaaaacagcacaccacgagattatatcccgcacctggctgggagggtcctaccccacggagtctcgctgattgctagcacagcagtctgagatcaaactgcaaggcagcggcgaggctgggggaggggcgcccaccattgtccaggcttgcttaggtaaacaaagcagccgggaagctccaactgggtggagcccaccacagctcaaggaggcctgcgtgcttctgtaggctccaactctgggggcagggcagggcacagacaaacaaaaagacagcagtaacctctgcagacttaaatgtccctgtctgacagctttcaagagagcagtggttctcccagcacgcagctggagatctgagaactggcagactgcctcctcaagtgggtctctgacccctgacccccgagcagcctaactgggaggctccagcaggggcaggctgacacctcacactgcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaatcagagcgcctctcctcctctaaaggaacgcagctcctcaccagcaacagaacaaagctggatggagaatgactttgacgagctgagagaagaaggcttcagacgatcaaattactctgagctacgggaggacattcaaaccaaaggcaaagaagttgaaaactttaaaaaaaatttagaagaatgtataactagaataaccaatacagagaagtgcttaaaggagctgatggagctgaaaaccaaggctcaagaactacctgaagaatgcagaagcctcaggagctgatgcgatcaactggaagaaagggtatcagcaatggaagatgaaatgaatgaaatgaagtgagaaggaaagtttagagaaaaaagaataaaaagaaacgagcaaagcctccaagaaatatgggactatgtgaatagaccaagtctacgtctgactggtgtacctgaaagtgatggggagaatggaaccaagttggaaaacactctgcaggatattatccaggagaatttccccaatctagcaaggcaggccaacgttcagattcaggaaatacacagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattctcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcaaaatgacaggatcaaattcacacataacactattaactttaaatgtaaatggactaaatgctccaattaaaagacacagactggcaaattggataaagagtcaacacccatcagtgtgctgtattcaggaaacccatctcacatgcagagacacacataggctcaaaataaaaggatggaggaagatctaccaagcaaatggaaaacaaaaaaaggcaggggttgcaatcctggtctctgataaaacagactttaaaccaacaaagatcaaaagagacaaagaaggccattacataatggtaaagggatcaattcaacaagaagagctaactatcctaaatatatatgcacctgcaggagcacccagattcataaagcaagtcctgagtgacctacaaagagacttagacttccacacattaataatgggagactttaacaccccactgtcaacattagacagatcaacgagacagaaagtcaacaaggatacccaggaattgaactcagctctgcaccaagcagacctaatagacatctacagaactctccactccaaatcaacagaatatacatttttttcagcaccacaccacacctattccaaaattgaccatttacttggaagtaaagctttcctcagcaaatgtaaaagaacagaaattataacaaactatctctcagaccacagtgcaatcaaattagaactcaggattaagaatctcactcaaaaccgctcaactacatggaaaccgaacaacctgctcctgaatgactactgggtacataatgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaagtaaaagaactagaaaagcaagagcaaacacattcaaaagctagcagaaggtaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaacgatcccacagaaatacaaactaccatcagagaatactacaaacacctctatgcaaataaactagaaaatctagaagaaatggataaattccttgacacatacaccctcccaagactaaaccaggaagaagttgaatctctgaatagaccaataacaggatctgaaattgtggcaataatcaatagcttaccaacaaaaagagtccaggaccagatggattcacagccaaattctaccagaggtacaaggaggaactggtaccattccttctgaaactattccaatcaatagaaaaagagggaatcctccctaactcattttatgaggccagcatcattctaataccaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacacaaatcagtaaatgtaatccagcatataaacagagccaaagacaaaaaccacatgattatctcaatagatgcagaaaaggcctttgacaaaattcaacaaccctacatgctaaaaactctcaataaattaggtattgatgggacatatttcaaaataataagagctatctatgacaaacccacagccaatatcatactgaatgggcaaaaactggaagcattccctttgaaaactggcacaagacagggatgctctctctcaccactcctatttaacatagtgttggaagttctggccagggcaattaggcaggagaaggaaataaagggtattcaattaggaaaagaggaagtcaaattgtccctgtttgcagactacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaacacctaggaatccaacttacaagcgacatgaaggacttcttcaaggagaactgcaaaccactgctcaatgaaataaaagaggatacaaacaaatggaagaacattccatgctcatgggtaggaagaatcaatatcgtgaaaatggccatattgcccaaggtaatttaaagattcaatgccatccccatcaagctacccatgactttcttcacagaattggaaaaaactactttaaagttcatatggaaccaaaaaagagcctgcatcaccaagtcaaacctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaacggttctgggaaaactggctagccatatttagaaagctgaaactggatcccttccttacaccttatacaaaaattaattcaagatggattaaagacttacatgttagacctaaaaccataaaaaccctagaagaaaacctaggcattaccattcaggacacaggcatgggcaaggacttcacgtctaaaacaccaaaagcaatggcaacaaaagccaaaattgataaatgggatctaattaaactaaagagcttctgcacagcaaaagaaactaccatcagagtgaacaggcaacctagaaaatgggagaaaattttcgcaacctactcatctgacaaatggctaatatccagaatctacaatgaactcaaacaaatttacaagaaaaaaacaaataaccccatcaaaaagtgggcgaaggacatgaacagacacttctcaaaagaagacatttatgcagccaaaaaacacatgaaaaaatgctcaccatcactggccatcagagaaacgcaaatcaaaaccacaatgagataccatctcacaccaggtagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaacgatagactggattaagaaaatgtggcacatatgcaccatggaatactatgcggccataaaaaatgatgagttcatgtcctttgtagggacatggatgaaattggaaatcatcattctcagtaaactattgcaagaacaaaaaaccaaacaccgcatattctcactcataggtgggaattgaacaatgagatcacatggacacaggaaggggaacatcacactctggggactgctgtggggtggggggaggggggagggatagcattgggagatatacttaatgctagatgacgagttagtgggtgcagcacaccagcatggcacatgtatacgtatgtaactaacctgcacaatgtgcacatgtaccctaaaacttaaagtataataataaaaaaaataaaaaaataaatctttacaacattcctatgagtttagcatttaccaactgcattttagatatgagagaaaatgctaatagttattattcatagtaataccaacaaaaataatagctaacatatgagtatttgctaagttttaggtaccattatgtatgttacataaatatgcatgtatgcatatatacaggttgagcatccccatccaaaaacctaaaattcaagatgctctgaaatccaaaatgctccaaagtctaaaactttttggtcactgacatgagatagtgactcctttgctgatggttcagtgtacacaaactttgtttcatgcacaaaattatttaaaatattgtgtaaaattaccttcaggctatgtgcacatggtatacataaaacataagtaaatttcatgtttatggctgggcatggtagctcacacctgtattctcagccctttgggtggccaaggcaggagaatcatttgagaagaggagttcaagaccagcctgggcaacatagagatatcctgtctctacaaaaattttaaaaattagctggacatggtggtgcacacctgtagacctgcacacctgtagatcgctggagcccaaacgttcaaggttacagtgacctatggtcatgccactgcactccagcctgggcaacacagactctgtttctaatacatatattagagactatctatctatctatctatctatctatctatctatctatctattttgatcccatgggggagatcactcctttaataatgcaagagagtgaataagatgggggagggtggcgtgcaattgagagatgagctttatactggaataccaagtttatggtgtggaactctggggtattacactgaaatgttaggggttctcagtgggttatttgtctctttctattaaactccatttacatttagctctgctgatgttgctcttgcagcaattggttttctcaattaacagaaaagggagagggaacagcttaaagccttggctgttgccgctcagcaagggaactgtgctgctctggagagaaaggtctggacattgtgagtttctgtttatttactttgtttctgacacacctgtctttcaggaagcctggcagtcctaagctgaatgaatagcatgctggaaagcccttcttttgaactaagttcagggcttttcttctaaactgaggtgccctcacaacacatgttctgccaaccacccgaaggtcaaaaagattttctggatgtttttgagacaaagggaattcaaaatctgcaaggaatggcctggggcatgataattctgagagacaagattctccaggctatgcacagaaaaccaactttttatgttagtatttaactcaagtagaatcaacaatggcatggaaattcgttttattttgcttttcctaaggaggatcatctcgtttaaagtgtgaattcaaaaactcactattgtgatagagtgacctcttttcatcctaattattttccataagtatcctgcttgctagtgaaaagactgaaagtgaagaatactagttataaatcatctttagagtgagagctgaagtgagataatttaacctgaacagcacaagctgtccctgacatctgcaacttcactcatcaccagcagtgaatctgctggtctgattggccaggtgtacatgtctcctctcccgaacggtcaggggtagccagtcacacttctgccaataaagagcacgacaagtccctactctacagttagtgaccatgttaaacctatcaaagattaaaggggaaatggggtattccattcaaatgttaaaaaattccaatccaagatgtctacctattatcatgataatcaacacaggacatttatatccagaaatttggttgctttggttccttttatatttacaaaataattattaaactaacccacacaccccaaattgtatgcacagggcttagaacaagttgcaggagtcttttgtgccaccctcttcataaggctctcaaactatttttttttaaattccatatttctaactgactttctattatgaatgatgaagatttcacactctttcaccatttcacctctctacttccctctttctatcctcccattacagttatataacaattattggctaaataaacattcagtgttctattgtatcatccctgcaaagtaacgtttactgataaaccaaatgatgtgccataattatgttttatttatggaacaactttttgttttttctggagttatatattaccttctttatttgattatgtgacattatcaccaatttttctagacgtctccaaaacataattttttaaattttaaatttctgttggtacataataggtaggtaggtagacagacagacagacagacagacagacagacagatagatagatagattgattgatttatggggcccacgagatattttcatacaggcaagcaatgcataataatatcagggtaaacagggaatctattactgcaaacatttaccctttaagttacaaacaattcaattatattctcttagttattttgagatgtatgataaactactgttgactgtagtcaccctgttgagctatcaaataccagatcttatttgttctatctaattatatttttgtacccattaaacatccccacttcttacttcctcccatccactacacctcctagcctctggtaaccatcactctaatctctatctccaggatctcaattcttttaatttccagctcccttaaatagtgagaatacgtgaagatgatctttctgtgcctggataatttcatttaacataacatcctccagttacatccatgttgttgcaaatgacaggatctcatttctttctatggccgaacagtactccattgtgtatatgtaccacattttctttattcattcgtctattgagggaaacttaggttgcttccaaatcttggctactgtgaatagtgctacaataaatatggaagtgcagatatattgatttcctttcttttgggtgtatacctacctagaagtgggattgctggatcatatgggagttctatttttagctttttcgaggaacctccaaattgttctccgtagtggttgtactaatttacattcccaccaaaagtgtaggagtgttctcttttctctacatccttgtcagcatttgttactgcctgtcttttggataaaagccattttaactggggtgagataatatttaactgcagttttgatttgcatttccctgatgaccaatgacattgcacaccttttcatatgactgtttgccatttgtatgtcttcttttcagaaatgtctattcaggtgttttgcccatttttaattggattatcagattttttttcctacggagttgagctcctaatatattctggatattaatcccttgtcagatggatagtttgctaatattttctcccattctgtgggttgtctcctcaccttgttgactgtttcctttgctacgcaggtatttttaacttgatgtgatcccatttgtctattttcgctttggttgcttgtgcttgtggggtattactcaaaaaatctttgctcaggccaggcgcagtggctcacacctgcaatccatgcactttgggaggcctaggcaggtatatcacttgaggtcaggagttggagaccaacctggccaacatggcaaaaccctgtctcaactaaaaatacaaaaattagcccagcatggtggtgtgcacctatagtcccagctactcaggaggctgaggcacaagaatcacttgaacccaggaggcagaggctgctgtgagctgagatcacaccactgcacttcagcctccagtctgggcaacagagtgagactctgtctaaaaaaaaaaaaaaaaatctttgctcaggccaatgtcctggagagtttccccaatgttttctttcaatagttttatagtttgaagtcttagatttaagtctttattccattttgatttgatttttgtatacggcaagagatagaagtctagtttcattcttctgcatatagatatccagttttcccagaaccatttattgaagagactgtcctttctcaatgtatgttcttggcacctttgtcaaaaatgagttcactgtacatgtatgaatttgttcctgggttttcatgccagaaccatcctgttttggttactatagctctgtagtgttatttgaagtcaggtaatatgattcctccagttttgttctttttgctcagtatagctttgagtattctgggtcttttgtggttatacatgaattttaagatatttttctatatctgtgaagaatgtcattggtattttgatagagattgcattgaatctgaagattgctttgggtactatgtacattttaacaatattgattcttccaatccatgaacatgaaatatctttccattttttgtgttctctttaatttctttcatccgtgttttatagttttcattgtagaactctttcacttctttcagtaagttaattcctaggtattttatttgtagctattataaatgggattacattcttgatttctttttcagattgttcaccattggcatatagaaatgctactgatttttatatgttgaatttgtgtcttgcaactttattgaatctgtttaccagttctagtagtgttttggtgaagtctttaggtttttccaaatataaaataatatcatctgcaaacaagaataacttgacttcttcctttccaatttgaatatcctttcattctcctgtctgattgctcaaggggtaatggacatccctgtcatgttacagatcttggaggaaaaactttcaatttttccccattcgatatgatactagctgtgggtctgtcatatatggctttccttgtgttcaggtatgttccttctatcctcagttttttgagtttttatcatgaagggatgttgaattttatcaaatgctttcccagcataaattgaaatgatcatatgtttttgtccttcattgatatgatgtatcacactgactgatttacattatgttgaaccatccttgcttccttgggaaaaatcccacttggtcacgatgactaatctttttaatgtgttgctgaatttggcttgctagtattttgttgaggatttctgcataaatgttcattgggagtattggcctgtagttttctgtttgcaatgtgcctttggtctgtttcggtatgagggtaatactggccttgtgcaataagtgtggaagtactccctcctcctctatttttcagaatagtttgagtaggattgatattacttctttaaatgtttggcaaaattaagcagtaaagccatcagatcctgggcttttctttactgggagacttttcattatggcttcaatcttgatggtattggtctgttcaggttttggatttcgtcatggttaaatcttggtaggttgtatttgtctaggaatttatcatttttttaggttttccaatttatttgcatatagttgctcctagtagcatctaatgatcctttgaatttctgtggtattgcttgtaacgtctcccttatctttccttatctttccttccccccccccccccccatagagtcttgctctgtcatccaggctggagtgcagtggcacaatcttggctcactgcaacctccgcctcccaggttcaagcaattctcctgcctcagccttctgagtagctgggattacaggcacgtgccaccacgctggctaattcttgtatttttagtagagatgggatttcaccgtattggtcaggctggtctcaaactcctgacctcatgatctgcctgccttggcctcccaaagtgctgggattacaggtgtgagccattgtgcccagcaacatctcccttttcatctctgattttatttattagcatcttctttcattgttttaaattctaactctcttttgttcttacttgataattttgtatagtatccttttgtttcattaatgtgataacttgtcatctgtctagggctacgaagtttattttttctgaaacgtctatttgtttcttaaactctttttatatcaacctaatcatcatcattattttcatttgtttgcattaggctttttgttgaagaatttcctcagagttttgtggagacttggctatctattcatattcaacagggagacactaaaatactgactgggagccttgaatgatttaactggacttgtagagtcttggggttcattatagggtggtgttccttgaatgtcccctccaattctcatgttgagatgtaatcctcagtgttggaggtggggcctggtgggaggtgtctgagtcatgggagtggttcccttatagctttgtgagcaagttctcataaaatctctttgtttaaaggtgtgtaacaccttccttcccgctctctctcttgctccccctattgccacgtgagatagctgctctctcttcagcttccaccatgattgaaagctccctgaggcctctccagaagcttagcaaatgctggcattatgcttgtacagcctgcagaactgcaagccagttaattttctatttcttcataaattacccagtctcagatatttctttattgcaatgccacaacagcctaatatagaagactggtaccaaggagtggggcattgctataaagatacctgaaaatgtcaaaatgacattggaactgggtaagagacagaggttggaagaattgggagggctcaggagaaggcagggagatgaggaaaagtttgaaacttggtagagactgattaaatggtcatgaccaaaatgctgatagtgatctgcaaagtaaagtccgtgctgacaaagtattaggtgtaagtgaggaacttattgagaactggagcaaaggtcacccatgttataccttagcaaagaacttggctacattatattcatgcccagggacctgtgaaagtttgaacttaagagttaatgacttagggtatctggcagaagacatttctaagcactgaagcaattgagatgtgacctggctgcttctaataacctatgctcagatgcagaagcaaagaaataacctaaacttggaatttttacttaaaagggaagcagagcttacaagtgtggaaaatttgcaacctagctatgtgatagaaaataaaaggccatttttggggaggaattcaagcaggctgcaagcaatcatttgctagggaaatttgcataactaaaagagaacaagtgctaatagccaaaataatgggaaaaaggcctttacagcatttcagagatcttctaggcagctcctcccaccacagtcccagtggtacaggaggactaaatggtttaggggataagcacagggcaccactacactgtctacctcaggaggctgctccttgcatcatggtccatccagtccagccgtggctcaaagagcctcaggtatggctcaggttgccactctggagcatgtaagctgtaagcctttgtggcttccttgtggtattaagccttcagatagaaagaatggaaagagtgatcctagtctctgcctagatttcagaggatgtatcagaaagcctgggtgtccaggcagaagcatgctacagggacagagtcctcacagaaaacctctactaaggtagtgcagaagggaatatgggattgaagccctgcccacaaagaatcccccctggggcattgcctagtggaactgtgggaaggaagccattgttctgtgggtcccagaatgtagatccactggcagcttgcatcctatacctgggaaagccgtaggcactcaactccaacccatgagagcagtcatggaggcttcaccttgcaaaagctgtagaggcagagctgcccaaggccttggagtctacccttacatcagtgtgacctggatgtgggacatggagtcaaaggagattattttagaactttaagatttaatgactgtcctgttgtgtttcagacttgggtggggcctgaagtcatttcttttggctgatttcttccttttagaatggaaatgttggccaggcatgatggctcatgcctgtaatcccagcactttgggcggctgagacaggtgaatcacctgaggtcaggagttcaagacaagcctggccaatgtgatgaaaatccccatctctacaaaaatacaaaaattagctgggcatgacagcgggtgcctgtaatcccagctactcaggaggctgagacaggagaatcgcttgaacccaggaggcagaggttgcagtgagccaagattgcaccattgcactccagcctgggtgactaagcgagactccatttcaaaaaaaaaaaaaaagaatgggaatgtttacccaatgcctgtacctctattgtaccttggcttggaagtaaataacttgttttaattttacaggctcataagtgggaggaactcatttccagacaagattttgtatttggacttgggacttttgagttaatgctggaatgagttatgactctgggagactgttgagaagagatgattccattttgccatgtaagaaggacatgagatttagggggccaagggcggaatgatacagtttgggtgtcccctccaaatctcatattgggatgtaatccccagtgttggagatgggccctggtgcgtggtgtctgggtcatgtgggcagatcccttatggcttggtgagtgagtgaatgagctctctgagatctagttgtttaaaagtgtgtgctaactcccacaacccccttactcctgctctcaccatttgagacacctactccccttttgtcttctgaaacaactacaagttccctgaggcctccccagaagctgagcagatgccagcaccatgcttgtacatcctgcagaactgtgaaccaattaaacatgttttccttataaagtacccagtctctcaggtatttctttatagcaacgcaataatggcctaatacatggggtaattgaggaataaagacccttggcttctttattgggcaaccatctaatgccagtactataggtcttttctctgggtggtaattccatttttctgaagaagaattcttcttggttatttttatttttaattttaattcttatgagtacatagtaagtatatgaatttatgggtcacatgaaatattttaatacaggcatacagtgtgtaataatcacatcaggataaatggaggagccatcatctcaagcatttatcatttctttgtgttacaaacattccaattatattcttttagttgcttttaaatatgcaataaattattgttgactgtagtcaccctcttatgctatcaaatactagatcttattcttcctccccactacccttcccactctttgataaatggcatcctactctctatctccacgagttcaagtgttttgtttgtttgtttgttttgtttttttcttgagacagtctcactccatcacccaggctggagtgcagtggcacgatctcatcacaacctctgcctcccaggttcaagtgattcttgtgcctcagcttcccatgtagctgagattacaggcatgcaccaccatgactggctaatttttatatttttagtagagatggggtttcattatgttggccatactggtcttgaactcctggcctcaagcaatctgcctgcctcagcctcccaaagtgctaggattgcaggcgtgagcccctgaacctggcaagttcaagtatttttattttagttaccaaaaattagtgaggacatatgcagtttatctttctgtacctggcttatttaacataatgtcttccagttccaactatgctgttgcaaattacacaatctcattctttttttatggctgaatagtactccattgtttataggtactgcatgtttttttgcatccatttgtctgtcgatgggacacttaggttgcttccaaatcttagctattgtgaatagtgctacaataaacatgggagtgcagatatttttttagacaatttttatagaaaaacaatttttctatctcctctcttggcattataaggctaactgacagagttcttattcccaggtgctactagagaagtcagaacttcactattcagttgatagactttcatttactctctcaccttccaatgtgcctagtatccccaggttaagacttctcttatttatttttatagcataaatttccattctaatgaggataaagtggcactggtctcctagctgagcagggtgagaggagaacctatggaggactccccttcatatgcagatttctcatccaccttcccccctttttaagattcttggttcctcaattgccatctttcaagattttgacaaagggaatggtttgctggttttgccctcctctgtgggcactttgtaattagcattctcaactttgttgattttttcctctcctttccatttcctaaattggtcctctcacatctctagttgtttcttctcgtcaccctttattactgacactttattgtcttctattctttaccgtcatttgacaagagggctttcaaaggtagcaaataaaaaagactgtattaattttccagggcttccataacaaaataccacagattgggtggcttacacgacagtaatacgttttgtcagtgttctacagtttggaagtccaagatcaaaggcgtcaacaggtttagtttctctgagacctgtctccttggctttcagatggctgccttcttaccatgtgtttacatggttgtctctgtgtgcatgtgtctaatgtctctttgtgagtccaaattccctccctttataaaggtatcattcagattggattaggggccactctaaagacctcattttaatttaatcacctctttaaagaccttatctccatggttacattctgaggtaccaggggttaggacttcaacattttgagaggacacaattcagcccataaaaaagatcacatttaaaacattttaaaaaattcttaacactacgccaaatgtattgcaagtattctctatccttttacttaatgacgctgggaccatctatctaaatgaacactgctctctgaaatagcactcttttcattaatggattcgctcacttattaaatatcaattatcgtgcatctatttttgcaaggttcttggtttatcagcacaacaggatacagaggtaagccagactcaatatctatatacaagagggctttgttgagaaggataagaacaggaggctttttatttctgtgatgaacttttataggatactttaaagcataaaatatttgtcaactccttaatggtggttattctgaaaagaacttgaatgttttcaagggttgtactaatgcagtcatcttttacattaaatgcaacgttttgtacttttattttttttaagtcacttctgttacccagaagtcaggcacttataaaggctacttctgttactttctcttgtcaccatttcatttcaggaaatctaacagctcaactttcaattgcagaagagaaagtgaagaattgaacaacataaaaagcatactcccctctgcggtagttacacatccacaattacgctctgcttagggcaagttgggagcactggagtgggggaagaactgattatagaggggagctgagggtctgtagctcatggcacggctcccaacaatctggcccatggctgttcttacttggcaagcacatgaaattgaagatcactgctgcatctcatgcttctacagggtattgatccatggaaaatattaatgattaacttaagcaatacaatgagaggttgttactttgtactggcaatctttgacttgatcccctatacaaatcacatgcagaatgagtataaagcaaaaagaaaatgattgtttcatttactggtaagttattctggtccttcaccaaaatatgggaaactattttggtctaacatgagactactcaatgagaagtcataactgatatccctgaattttttataggtataaggttaagcttaagatgataatttatccgaagtcttctgaactctgtttttcttaggcagttttctgtatcttggcattgctggtactatattatggtagatatgaaatcagccaaatttaaacttgtctatcttttgttagaaagcatttggaggaaaattatctacattttaggattttccagttataacactgttgcctgtggcaattgcacttgctattagactcttcctgccctttttcaggaaaaagaaactcaagtgtcatttgttattcttgataccaatgctgagtgacctaacaaaaaatgccatggttggctgggcgcggtggctcacgcctgtaatcccagcactttgggaggccaaggtgggcggatcacgaggtcaggagatcgagaccatcctggctaacacggtgaaaccccgtctctactaaaaatacaaaaaaattagccgggcgtagtggtgggggcctgtagtcccagctactcaggaagctgaggcaggagaatggcgtgaacccgggaggcagagcttgcagtgagccgagatcgcgccactacactccagcctgggtgactgagtgagactccatctcaaaaaaaaaaaaaaaaaaaaaaaagaaatgccatggttgtcttgttgcaggtattctgtatttgcctaccatactatgcagtgtccttcttacaaccacctaacctttctccctcccacaatccctgaacctgggtacaattgcatgtagataaagattgacagatggttagcacatatattgatctaggcagataatctcacagatgtgatatgcgggaaataataacatcaaacagctttggaaaagatgtgtaaacactgtgaattttttgcttctatcactttaagagttggactgatttgggaaggactcaaactcttcaagtctagagtcttcatagataaaatagggacattttcaacttcctcctagaatgatgctttcttgtggggactgaatgaatcaatacacatgaaagtgcctctctcccttgatatctacaaatacatgtgcacacacacaaatatacacatacacacacacatatatatatctgtgcatatctgctcagaattctattatgcatttgtttcagtccagacacttgcagtctagtttagaaatcaagcatgaattgtatagcaatccaaatgacaacaaaatcttacaatgaaagacattttagaagctacatgattacatatcctatgactgtactgaaagtaacagagttcacgtgctccatctgaaccctcactgaatgccagtgcacacgttattcttaatactcaagatagttctgcaccttatgttttgttactgtgatttcaaagatatggaatgtgaacctcagagagggtaggcaacttggcggaaaacagaagaaacagatccacttggaccccaagcctggcctccttccatcaggccacccaatcctgaatttgaaacacagtgaattgcatcatgctccgcagtcttcatcatggaagagggagggactggaccttgaagaaagggtagaatttgggcagatcaagaagaatgcagggacacttcagaagaggagaggatgcgagccaaggcatggagacacaaacattggggacatatttgtgagacagtaatacaccagtttgtctataccagaggatctgtgtggatgaaaagcaagagaaggagccagaagagtcaagtggagctaattctgaaggcctggaatgccagacaaaggaatgtcattcactagctcatacagaaaatgagaaactgtcaagaaaccactgtgctctgttacagagatatcaagatatcgaacaaacaacaaaacaaaacaaaaataacaacaacaaaatagtctgtgtagggcttagagcccatgtactcctatatgtggactaggactctggggctatggcagaagtctgtgtggagggccatgacagcacaaggaagggagttgtcatttggatctggcatggaagttgtcaaaaaaggtttcacagaggacatggatttatgctggaagtgacgggcagtgaagaaatagtttgaactgtggagagtatgataaagataccattttcagaaaatgaactcagtagcagcatccagagggcataatgtggagtgatggctagagtctggagactgaggctaattaaataggagatcattgcagctatccatgcaaaaggagagggtagtggcagtggaaatgaagtcacaggaaagcatgagattttacagtgtacatctcagaggacttgaccttctggcagataaagctgatgagggagaggaggattcagtgatcactctaaggttctgagtttaagtggaaaaatagcaatgtcctgaagaaaaatacgggattttcttcaggagagcttcttcaaggaaaaaggtgtgctcaggtgaggaaactgaagcataaaaagagaaaaaacttgcccaggttggcaacaacttgccaatacagtcagtgagtggcagactctgagttcaaacccagataatctaaatatgaactgtctaatacggcagccaatggccacaagaggctgttgggcacttgaaagggggttagtatgactaaaggactaaatttttagtcttacttaatatttatgaattaaaagactgatagttgatttaataatactatatttggaacaacttgggaagtgaatctatatttctaattgtaaatcttatgagatctaaatgtccaataaagatccagtataattgaggacaattgggcatccaaattaatatgtgatgtaagtaaaaaatacatacaggatttcaaagacaaagtatgaggaaagaatgttaaatatctcattaataattatatatattgtttacaagttaaaataatctgatacagtgagttaaataaaatatatccttgaaataaattttacctatttctttttaccttttaaatgtggtaccagaagacctaaaattacgaagtgtctcataatatttctatactccagcgttggtctatatcctgagaaatacataaatgagaggtcacctgcatgagatgagtgacgtagttaatgggataggctattcctttcctaactctaaatctctattttcggaagatgactgaggagaatgccaacattgtcttaattcagtggcacagtgggccctgaacatgatcacattgttaatctccctactctcttgtccgggtcaacaatttcacagttgtcagaaaatgaacaactcaaattcccctttcttggtatatcttacatttttttatgtctcaaaggagaattatttcattcacatctgtttctgtctttcaatgaccagctctatcttcacgtcagtctcaatctaaagccaattttatcagagaatcccagagacaagcccaaagaggacttcttggatctggcctgagaaaatagtaaccagaaaaccaggggctattcaggatctgggtgtagcctgtatgcctgaatttttttccatgggggttcgttcgtagtctgatagtgaaatccaaatggtgtgtttgagaactgttgacaataatccagatgtttgctctactaagagtcatatgtgtaataaactaaaggtggacaacttcaattgaatggaataaaaggtcagagctaagcacttgtaactctctaggtattgcaggaattcgggtagtatcatttataaagaaaaagaatctaaaattctaccaattttcaggcattcagtgcatatgaagcaatgtgtccccaaagttagatcatccagatgttttatgttaatcagagtaaacatatgattcatcacagattcaacaaagtcaaaggcagaaaattcacatctacttgcaagctaaggggtgtagtgctttttccattttctatgccagctctcttgacatacttagcacttacccatagaataattgaggtcattggatttataataaaatgccattacaagaaatgctaataaaattatatgttctgtacatatagatgtatacatatacatatattttatataattctgtgtgtacatattgcatgtatgtacatacaatacatatatgaagtatttcacccaagagatattcccacttttcgaaatattgtgtatgaagtcttagtacaacagataaactattctactttactcctttttaatttctaggtattattttaacatattggctgtatatcctttgttaacaattctctataaaagaaaacttaagcaaaaattatctataacttttcatttatacattatatttggtatatatcatattaaaatgtacagaatgctaaagtactatatctattgattatagcaatgaggtgctcacaccgataaggcaaataaaaagtaacatctccagccaagagcattggggaagagataaagaaatccattacaaaggacattaaatgcatttgaaacagcttcaataaaatacccaagctcctgggaaaataatgtatctaaagataaaatggttttcagaactactgaaagggaataacacacaaatatccatgtctagccaaacaaaacaactgtacacctattgaacttccagtaagaaatgtttggttaaaaagaaaaagctgttaccttttttttttttaataaacaaacaacataatgaaaaatgatagagcactcaagctcatggctaactttcactgtgtggccttaaacatacttctttccagtgacagagtactagtactattttttgttggtttcttctctgttctcctctacaattccaaaattatgtagttctatccacagccaacaaatctctaacaattatgccaaactttggctgatttctggcaattgtaccacttaaacattcatatttattgctgaggatgtaatagtagggcagatcagtccatcacaatgtctctagcaaacattcgccgctatctactttattcctagcatggaccattccacgttaggccctaattacctgcactttttgaaaagcaaaaacaacaacaataacaacaaaacgctttacttttcctgataggtttgcatttagccattgcagaaacatagaacttaaaagaatacaaaatttaatattgtaatccatcatcttgtattagttaccaccttattacctgcaaagcaaatgattgctataagtcccctcattagtctccttactctagtcttctggtattccaaggtgtgtcttcattgctgccacttcattctttcataagcaaagctatgatcataggactccctctcttcaaaatctttaatagctcaccttagtttagaaaatattcctttgcttaattttcatgaccctaaaaatatagtctcattctccttttcctgttttatctcctatctacatgattgcctctcaagttcaataaattctgaccacactcaattttttttctataaacgttcatgtattttcctacatccacacctttgtgagattgttctcccagcctgaaatgcccttcatcttcaactctgcataactgaatgcaagctgcaagaccaaatgtcattttatctacaaagcattctctgatactcccagttgaaagtaaattctcccttctcagagctgccaaaatattttactcctgctttctccatggtacttaacagaacacatgggacaatatttagagaacagatgactggtgcctgggtcccaactccaggatttacctaacaattttttttttgtttttttgagacagagtcttactctgtctcccagggtggagtgcagtggcacgatctcagctcactgcagccttcgcctcccaggttcaaccaattctcgtgcctcagacacaagagtagctgggattacaggtgcatgccaccacacttggctaatttttatttttggatttttagtagaggttttaccacgttggccaggctggtctcaaactcctggcctcaaatgatctgcccaccttggcctcccagactgctaggattatgggtgtgagtcactcactgcacctggccacatttaactaactttatggtcttcagtaagacctttgaatctgctgggtctcagttttcttatcagttgatgtgatagtcaaaggaaacaatatatgactatctactttgcaaactgcaaagtgctatgtaatgtgagttcattctctgccagccaccctctttttaggcactgcctttcaggagagtacttcatcctctttcatgaccttatttgtaagataatccctgaatagcccagctggtggtaggtgtttggtctaatgtactcctagaggactattaaagtccttatgtagttataatttatttttccctttgaatttttgtctgagcagttcgactttgatttttttgaaggctaagaatttttctctctcagttttgcattcctagctgaaaattttgaaatcagttcctattcagtaaatgtttgctgcacaagtgaatgtatgagtgaattaaatgaatgaatgaatttactgatatcttaatgttgtggacagttatttatgtttagcacttatcatctgtctttagattttaagctccatgagggcaggttctttgtatgatccatgtttgtatccttatagttacatgtgcattatataaaataaatacttgcagaaagctgaatagaaaaaggtagctgagctggatgacatggtaggaggctcctgtgcatagagtttcctgtacaacagtttttttactgacgtgcatgcaatcttaacatctgtttaattcacaaatgaggctaatatttattattgacattgaaatttcttttcaaattgaataaaagaatgtctgtaaacatagatacatcttttgatggtagagtaacacaaacttcagtggagtcatctcttagattatgtggcaagaatctgacatagtcacttttaccgtggagaaccccttgaatcacccaatgtaaggcaaaatgttcacactcaacagttcaccaaaggaactgagatgggaagagtggtagatccacatctcctacctcaatcacacttactagtgaacatagatccattgcacgtggtggcagatggggcatctggaattgctctattggaatttttatatctcccttgctctatctctcccattttacttagcacgtgtatttgaatttgcatcggtaagtccttggatggtgaaactgtactgaattgctcttttacagtatcaggttctcctcagtcacagtacgtgtaaaatttctcaatagcttagaaagattaatgggtctgtgtaaatctcattatcccttaagtaatttaaccccaatgatccccattgtaacccaaatcctagtctgacttggagaatccagtgtggtaagtaaaaatggcaatttacctttaaaaactgccagtgatgtgcaggttaacactcatcttcctactttattttgagatgactttgaacatatactgaagtcagagacaacagcaaccccagggctggaatgtcctgcttccacaggactcatcatatgggattcccagcatctatcagccttagaattcaagtgggtttttccccagagggaagactttgctgacgaaatgaaacatcagggagaagcaaaatctcttgcaaatcaaaatggccaagaactcccttgctagcagagtatgaatcctaccacaagcaacagaaggagaaaattagattgtgttactcttgatgtcatagccactggattactgcacaagaaaaaaaaaaaaaaaaacaagaaaagaaaatggaaacttgaagagaacaaagagctgctggtattcacagtgttcttgctatatacatgatggattgccatggtaacaccagtatcatatgaatcatcttacatcggataccggcatacattgttcaaaaataacagcacaaaccagagcacatattttcagtcagggtagcagggggcaggagggcgatttaggaaaactgtttacctatcataagggtgagttaaataatttattatcgcacaactgactttgagacctccgtacgcgtatgtgtttgtgtatttctaacttttgcctgaattaaaaatcaatgagtaaatgccgtatgcttcagtaattcctcatagactatgacaaactgaagtttatacattttgtgagctggtttattgtgaattctcatacaatcacaagcttggatttcaagaaatcttaggagaattttgaacgttttcatcatgaaaattaggcaaattcattgttttttgattcaaccattgcttagaaagaaacatcagagcagtagaatttgtatgtttatactcgaggtcaattataaaacacagtacgttttagtgtaatttactagtactgcagaaatgtgaatattgctatagcaatgaaaaccaaccaacaaacacaaagacctttggggtggattatatgaaaaccagcaatgtggagatcacttcagaggctcttacagtagttcacatcagttggcaatattaataaagacagagtggaagggactcatataagaacattataggtaaaagaagacttgatgatgagagacagtgttaagataaaggaagatgactaaggtgactcctgtgtttctagtttagataactctgtagtaatcaatccaacaaagaaatagaagaaaaagaccagatggtaagagtaagatgatgagttcaattttggccatgagaacaactgaaataatttccaagcagttagtaggagtctaaaggggaggagtggtcagagcttgagatgtacatttggaagttgctgaaagaacttttttttaaataaagaactcattgcctgctaatggaatgaatttaatgtttctccaaaagggtacacatatatttactgtctgattacttttgtactctcagttgaaaaaaaatgaattttacaagaatttattgaatatctattatgtaccaggacccagacaaagcaccagacacataatggtttaaaacataggcttcaaccttgtttccatggtcctatgattgaacgtgggaggaagcccttaggccaataaaatacataaatatgtaattgcaattgtgacaactgctcaaaaggagacaagaacccagtaagagtacaaaaataggcacctaacatagtctgagcgtttggagaatatttccctggggatgatgaggcctgaggatgagtaacaacatgctctactgagaaccacatgaatgaagcactgaccatcttttcaaattcaatgcacattccatcttgtctgaggagctgattaccttttccttagacacctgtaacatccttctcatcaaatttcttcccttaggggcccttctctccatcaccactaaactattttccttcctagagcaaccttcttagggcaatatgaaacacaacattatgggccaagtccaaagtcctgactattgtttcaaaggctgttagtagattgttcaccttcttttgcctttgaaaggtgccatcctgagcctggaatgctttgtcagcattcgccacttcatttatcatagtttacaaagtacgataaaaggtgataacagaagctttccgtttgtagttcatccatgtaataattttcttcaacttaagagcaaagccatgaaaaactaaaaagaaagttccaaagaattattaagtaatttaatgtctcttattggatatagaaatgggactatcatataaaggtcatcaagattgtgtagtgtcttgtactttgctgacagtaaacattccaagtactctaacaattctcattccactccttttggcaagcgagaggctgcatggttgggtgatggataaatgctgaactgattgcagaacaaaggtcaacatttatgacagtttttattaaactctagcagttgggaatagatttgaaaactgacctttttcttttttaaatctcagttggaaaatattacctattgtttatttcaatgttttaaaaacctcaatgataaataagacacaaagaatatgtttttaaattgcattgccaatgaataaattaataaataatcacttgtttctctccaaaatgaaataaagaattattgggttaattagcatgtaagaaaacagtagtctcccctactcatcttctccagtttatttttgccactctcctctctgcctcattacacttcagacaccttatccttttagtttaacacatcagggcttcattcatgtggttctcagcagagtatgttgttactcatcctcaggcctcatcatccccagggaagcattctccaaacactcagactatgttaggtacttatttttatactctcactgggtccttgtttccttttgagcagttctcacaattgtaatcacatatttatgtattttgtaattgtaatgaaattgtccctgtcaggatttcacactgcttccttctgttggtgtagggattcattcttttccattccaattaatgcagcattccattgccaaattttttctgaaacaactctttccatcatgccactcttagggaggaggaaagatagaaaatatataaattaagatttattatgatagtgcagtaacagacacagaagaaaagaaaaacagctagttaaggaggcacttccatttggaaatagaaaattatgaaaggtcttctaggaaagatctgtggaatgatgggattcatcacaaaatgaggagagaatggaactctaggcaaaaaataggtatagctagtagttatttatacctaaaatacacagtatacatgggtgacaagggcaatttacaaggatgcagagatgtggaagggaatagatcatgatggctgggaatgtaacctttttttttttttttggtagccactgaaaagctagtggtataagcatggaagcgtcatgatggcattttagaaagtggatctgtggatgacagtcaggaagaggatgttgatagaacagagactagttataaagttagcggttttcaggcaagataacatgagggttggacccaagatggtagcagtggagatggcatcaaagggtgaggtgaaggaggaagagtgtacctgcaactggatagtggtagagtggttaggctgagggagaggaagcacttaggaggacttccaggtctgggccataagaaaaaaggacatgggagatggggaaggtccctgggtaatttttgtttcaaatctattgagtttggcagcactacatagagaagagaatggggaactggagatatacattcaagttaaatctgttactgctaataatttttacccagaagtagggagaattagaacaaattctgaggataatttgaagttttgtttaaagtgaaaggaagggcctctcatcaaagaaagtagtccctttgttttcaaagtttttccttcataaaacgtgttctttgctgtattcgtctgttctcatgctgctatgaaaaatatccaatactgggtaatttatatagaaaggatggttaactgactcacagttccacatggctgggaaggtctctggaaacttacaatcatggtggaaagcaaaggggaagaaaggcatcttcttcacagggcagcaggaaggagaaagagtgccaacaggggaaatgccagatgcttataaaaccatcagatttcagagtactcactcactatcacgagagcagcatggggaaactgcccccatgattcaattacctgctactagggtccctcccacagcatgtggagattaagggaactataattaaagatgagatgtgggtggggacacagccaaaccatatcatttgctattaggatgagctggttatgatgaaaacacacaagtagtcacacattcacaatcgatgggtccatgcatttaggcaagagttcagcagagcttcacataccaggccaacaggatggtcgcttaatatatgtaagtgtatgtgtaattttgcctagtattttcaccactacttgaaaagcatatctcaatgtttattacctagtctggagctacaataatgtatttgatcatttattcagctatctttaatgaaatcttagtagtctccctactgaaagaataataagccctgaaaatgcagtaaagccacactaattcagacaaatcagaagacaggatggtttgaattactgaatgctttatattattttaaaagtgtagcagttgtccatttttaaccaggcaagaaagtgttatcttgtgcttaccacaagaaaggtaaaagaaagtattttcatgaatacctaaaaaatatcaatcatctagatataaataaaggtcttaaaaaagctctgaagttctccctgatttaattgattcacataaggttttttccaccttagcactactgacattctgggtcaaataattttttgttgtgagaggctgtcgtgtgtattataggagatttaacatccctattctttacctacttgaaatcatcagctacttcccacttattacaataaaaaaagtccctagacattgccaaatgtcccctgcatgagaggtggagggtagaattgcgtcagttgaaaatcactacacccctcaataataattttaatacctccactcctcttgataaaagctataaaaaagcaaatgttagtctaggccacgtttgaatgattatagagttcaaaataaggtggttgaatttgataaagatttattgtttgcaatgtgtacttgtttttctttggtacagaaaatgggacgtattcttctccgcaatgcctccctcgtgcaggttcatgcccattattgagtccacttttatgaacatgaagccactaattattcaggattcacagtcggattactatctctctccacaatcattattagtaaatcatttcatgagcacaatttgttatgggctgaattgtgtctaccccaaaatttgtatgctgaagccctaaataccagtatctcagaatgagactatatttggagataggaccactaaagaggagattaaaatttaaataagcctttagggtgggccttaatccagtctgactgatgtccttataaaagcaggaaattttgacacatacagagatcccagcgatgcctgcgcacagaggaaaggccatgagataacacagtgagaaggtggccatctgcaagacaaccagagtcctaaggagaagccagacctgctgacaccttgaccttggatttcacagcttttggaattgtgagaaaacaaatttctgctgtttaagccaccaaatctgtagtattttcttatgaccgtcctaacaaattaatacaccatttgagtaaattaatagcttgatgattggtcataaatctaagtgcatgaccttgtgatcgttccacaagaagagagcaggctggtttaccttcactcacacttactgtattccttcctgtcttctggatcttcgtaccctgctttttttctgatcccagcgataatagggagagcaagcctacctaaaggatttagaaaaacagaggccagagagtataccagaacagctgcatcaccagaaagagggagcacagagcaggcagcaagggaaggaccctcaccagcactcccacaagcacccccctaccaccccaccctgccccgacagtaatggtgtcaagccaccaaaatgcagggaagaaggcggctgggtgaggtaaaacatgacacccggctgtgaaaagtagtgctcaagggcacttgctttccattgccttggggtgccagtggctactgtctcaccacattcactgctactagtttttattttccattttgattaaaaaaaaatgtgacttttacattatagcaagacaacagaactggggcttatatgtcataatttttataactgattttatgaaattttgtgcttctatcaaatttcttacattttcttacagttgcagtattgtttccctctaggaaattcccctctgccacctcccacagtgactttttctcctcctttctacaacttgaagctatacacacacacacacacacacacacacacacacacacacacacacacacacattacatatatacaaatatatacttttatgaatacagaagtgaattatttcaggttctcctttgctgacctggtaatgacaaaatgcatgatccccaaccacttaagccagtaatctaaagtcagtgctacatgcagtttctacagggaaacaaggaaagggaatttaattgatccaaatgaataacagaagcaaaaatcttgccaaagactccatactgtggcatacagggaagtgattttatacacacacacacacacacacacacacacacacacacacacacacacgcccctatgccaaaatatgtaccatgcattttctaatcatttatttattaaacaaacatttattatttaacctgttctgggctctatgctggacactggggaagtaacaacaaccaagacgtgatccacacactcaaaaactttacagtccaattgggtgaggatgggttagaagagccagattaaatctgatttttaaatctctgtatgaagggccaggcttgattgctcatgcctgtaatcccagcactttgggaggccaaggcaggagggtcatttgaggccaactgtttgagaagagcctgggcaacacagcaagacccagtctctctaaaaacaaacaaaaaaattagcctggcacagtgacctcaactacttggtaagctgaagtggatcatttgagcccaggagttctaggctgccctgatctatgattgctactgcactccagtctggccaacagacacagaccctgtctcaaaaaaaaaaaaaaaaaagaaattgctatactaaaattgagacataaaagcttcataaaattgaaagaaaattatatttcttacaaaagaaaaagtgggacagtacaatttacagaggctaccaaaaattaaaaggaaaacatttttaaatcgcaaatatagaaagtaattataatcacagatggtagggttgtcattctcgtcaacattgagtttacttaagatttagtatgttaactgctttcttgatgtcttcattgctgctcttgaaataaaaattgagaccaattaaatgatcatgtggtcatgtgtctaatctaggtgattttctaataatttgggaattatttccctgttttccaagaaaaacatgctgttctttcaagaagtcattattttataaggatatacttagctttaaatcgagctatgttttgcacttatgcatttgatttcctacttcattttctctatggattttcgtgaaaagccaattttttttatcttttattttttgtcccgcaatctctgcttctttgggtaggctgaaatatcaactcatagctactcttctttagatgtctttccctccctcccttccatccttccttcctcagatttttttaagtaattagaaaacaattttctttctgccaaaaaccacaaccgagatgatatgaaaataaacataaacatgctactttagataaatcttagtcccagcaagcattctgaaaaagaaccattcaaaacttaggtagattttagtgaatctaagatgatgactcaccattccaagtgtattgttttctcaacagattcaaaagaagttgaggttttaaaatttacaacttaagaaaatgagtaacagaataaaaagacaacctctatgatttggatgttcttccattcattcatccacccctctaactattgttttcattacatgtttgttgtcatatttatcctttcgtagaatgaaagctccagatgtaataagttaactttttatataaaatttatttaattgatttactagccataggtaagtaatgtattctactgaaagaaaagatggatctggtatttttacaaatcccaagacctatacaattaaatactaattattgtaaaatgcctttcaaatatattttcttgtaaaatacactgtgatgcccaattttaagcctaaataggtatatgtctgaaattttctgggtctatgcatatacacaatatacataaaaacataatttgactgacttgtacaaaaagttgattactttaaagcagaaaaattaaggtaatatgaacagggacattagatattcatgtggattttgcaacttgtatggatttgtagtatcgtcccaccaactaaagaagggaatgaggtaactgacagcaactgagccatgttgggtgtcttaggacacacttttctgaatgtattttaaaatagttgcttggtgctgctagccggtcataaagtcaaatagtgatagagctggacagaaaagccttgatactctggagaaaagaataaaatattgtctcacaaaaatcagaaagctttctgaaggtttagaaactttttaatcacttaaacatcccttcatgtttataataaggtgaaatctggcaaaatgcatgctttgtgagtttgtgtagatataattagaaaaagaaaagtagaagagtaagatagtaatgacagtttccaagtaaaatacattgcttttagaattttggattttcattatgtggattcataaaattagggagaaatggaattttcacagagagaatggaacatctttataaatgcttctgaagttcattgttaattgctgaagaaaatgacgttgtataaaaccaaaattgaggggtgacttttggacatattagttaactatatcatcgctattctgatactacataaaaagggtgggtcgggggtagaacacagatctaaaatgacaacttttttataggaaaaatacataaccttgttcttccctccctagcaactacaggaaaacaaatgtttttgtagaattataactcatttattgcattaatgtgttatgatgcattaaggaatgtcacatgtagattatgagttactgggcatctggtataaacagccatatagccatcaataaatatatccattatttggctaaatcctctttcaaattctcatcatgggtgattttgatggcaatacaagcactgacaatctctcaaattcttaaaatctacagaccttgaaaccagatcagcttttgctaaatagctaaactatttccagctttcctctctggttaatttttttcccaactatccagtgtgttgaataaaaactaacttctcaccctgaccctcccatttcagcagacatccaaagcagttaccaaagggcaacaaaacacattttcactgacaaacaactagaggaaaggaaagcagttaccgtctcctctgtggcttaatatcaattggcatgttgatcgcgtatggtgatccatgaacataagcgcttcggaatctagccaccttccccagagtcaggtactcacagctgcttggcaaactcattatatccaaaaggcaagaagtaaaagcaaatctgagtagtcagaccagcattcctgggaaggctggaaagaacatgtcagataatagatttcagacatatgctgctcactggttgcccggtgcttctttgcttcaaaagtaaacgcgtgtttctcggaggctaaatgtactaccttgttttctgttcattctgttcatggatacaagaagctttttgcttatttctaaccaggctcatgctctgaccaattattggctgagtagataaagcagaaattctgtagctccacaaaagcctatttccactcagaccaaatctctgagtaggcagcaaggttttatccatttttgtctaacgttgaaaagaacatcaacctaatgtaatagtagtttggtaatcagagttatttacctgtaaacaaagcatgcatatctgataggaaggaaataattatttgctatattttcgaagagggaatattgttcactaaactgttatagatacttagaaaatgagatgggtatatggaaatgttatgggcggttttccaattctctggtaaaaaaattgtgggttcttattcataaattactattcatgatagaactgaacttagcctctcaggaacataaaaacggtaagcaatgtctttattcactaaaacgttgatgatgatacacattttttttcctcgtttaaaacactctttgagaaatgcaccttctacctgcactttgaacgaagatctatggaatcattgatagtgaatgttactaattctttgtaagctgttttttcataacagtgaaaaataagttggagaaattagaaaggatattaaataattctactgaaggcagcagggtcttagagaaatgctgtatctttatcccacagtttttctagcctttatgccatttgctagagttatagcaacaaaaccacaagtgttcagggtaatgagagtagcaggtgttcagagtattctgtgagataatttttattttgaaaaattatttcttatccaggatttgaatagacacgccagtttatttaagcatcctgggacctgggtaaacatacagtgtgctgaaaaagggctacattttattcttcagtagccaaattcagacactgtttgggtttaaacagcagacactgttaaaatccagaaattttaagtttgaaagagtagataattttccttttttttaaatcttgtattttaggtttgggggtagatgtgaaggtttgttacataggtaaacttgtgccatgggggtttgttgtacagattatttcatcatccagatattaaacccagtacccaatagttaccttttctgcttctctccctcctcccaccttcaccctcaagtagaccccagggtctgtgtccttccttgtgttcatgagttctcatcatttatctcccacttgtaagtgagatcatgtggcatttggttttctgttcttgtgttagtttgctaaggataatagcctccagttccatccatgtccctgcaaaagacacgctctcattcttttttatggctgcatagtatttaccatttctattcaataattttctttcttatattttaggtttcaattacaaaattatacatgctatttttttaacatgccaaatgacacagaaatgtgaagataaaaaagattgctgtcttttcccttccttggtaggattaatgggagggaaaagacagcaaactttttatttatacaaatataaatataccacacacaatacacaaaccctcacacatgtatagggattctccttcctttttgaataaagtgggctcatactatgtataatcctttattaatattaagtcaatcatgaaaaaattatttttgtgaatgcacagagacctagtgagttcttttcaatagttatataagattccatggcataaatgtaccattatttattcaatgagtcctttattgacggacatataattttggactcatataaacaataaacacatttgctaatatattcttactgattggtgcttgtatttctgaaaatggattgctagcttacaaattgtgaacatttttccctttaataggctatggcagttcatattcccacagtcatgttggaagatgtcaactcctccacactcctgccaagactatccattgttattcaagtttatttctttatagtatgaaaataaggtaggcagctctctgaaatatccagtgattgcatacagttccttgatgaaataaaactactattaaggtgtcgcaaaagtaagaacagcctttctgaactgaaatatatattgggacataaataaacagcttagaaaggctttgcacaggtgtacaaaaggcagaagtctggagtctcatcagaatgagagaacactcaatgcaaagttagtaaatagtaaataatttttattaatttgcataattatgaagagaataaatatagcaaaaattctgttatgtttttactcttcagtatatttttcttaatgggaataatatttcataatttgggagaaacatcactaattttacaatatggatgtaatgcctaatgactgccaactaattgtgatgtatgactggggtgtaatttgtagattttgcataaagaggctctttggacatactccttcatttgagagtctgaagaacaaaagctcaatgaagcattttcacatgccagctaatttaggagattgcccagtagaagagaataagatttgcttcacataagaatttcctaggaggggtaacaatcagaaattgaagaataagatataaacctctatggtagagacctatgtgtcctatgatgggtaaaattccagagttttcttagcaggggcatttttgcttgtacccaggtaattatttaccaaaagcctggcaggggctcctggggattacctgtacttaaatttggatgagagaggattactgttaaactccagcctgccaagaattcagagtctgtgagaactctggccaactagcaggaggtggcccttaagggaagaaaatggaatctttctatcgtcaacaattccctttctctggggctggagagaggtagttggggacttgatctttaggaaaataagaacacattggagagtttaatttcatctaaagattagagctaccatccataccaggcctacctccaaataaggctcaaatcttattaaggaatggccatgattacccatctatgttttgtttgtttttgcatactgggatttctatggaagacaggtatagagtctagcaaaaatctcacttatcatccccatgattctatgctcttgagaacattaaaagaaaaggagaactcacatgaaagcatctggaacatcaattttcatcactatgctagacgttgcaacgttaataatgccctgcacagcaattaaaagtaattgccagcaagcagcaatttcaatccataggacttttcttctaataactggaataatacatattaattaaggttctttcagcctttaactctaccctggcctacgtttagcaattttaaatgctggaggaacttctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgaggttatcatctgttaatgaccacatcagagcataagaattgactgaacgatttcccctggcttatggcttggaagactccttccctccccaaccctcgtgttttctgctcatacctggactggagacccacaaaaattggggtttgcatctgctctcaattcttggagttgttcttgattttgatctctacacttactggtcaatgcatccaatgaattggctttaaatattctttatgtgctgaaaaactcccacctctttattcagagttcacatttttctgctgttaccatcagctgcacatgagaaaattccacttgtaagttccatagctagttcatttgagcatttataatgtaattcaaatcaactgtgttcctcccctcctccactccctctccccacatttcttcttatattccctagtactggccaccattcagccaataaccagacaataactgctaatcaggtcacaaaccctagagacatgaatactattgatagtaacaataatattaatagtcaatagataatagctaacactgatcagatgcattcaatgtgctaggcactgtggttggcaggttgactaattctcataaaatatgagttgggccctattattatactcatttttcagatgagaaaaacaagacactgagggataagatatatacccaaggtcacatagagtgttaagtggtggagtcagagttaggaaccaattcatctgattccagagaccagactatatcttctacctctctacacattctttaatctctctcaattatctttccccctatgttttgcctagagttaatatttccattttttcctcctcaaatctatccttcacttacctaccaagattatcttaaaatggaaatcttagcaaactcatgcaaggacatgaacatgtgagtcctttgcttgaaattatccaatagttccacattatttagtaatgaagttcaaaatttaaattccaatactcagcacagagatgctctattgttttgctctcccttcctctcctgtatcagccacaaataacacttggtagtgtctttcctgtacacagtctgttcttctggcccactggggcttcccaaatgataggtactctggcaagaacatttttctctttcttctctggctggctaattccttttaagcgtaatctcttccaaaaaacattcttcattcctcagttttacttagaagcctctcatctattttgccaactcacatgactttaccacactgtttcatagctgttcatgcatttacaactcttccccatgacttttcttgagggcaggaattctgccttctttgaccttgtaatccaggaacctaaaacaacatttgcttattgaacaagatagctgaaattgtaaggtcctgatgctccaaagaactgtccaagtctttcctgaactcccttctcagttactttcccaagaataataattataaatatttgacaactgaaatacattggaagtagtggagctattcatcatatgcaatcaaacagaaatactttgcaaagagtgcccaaaggaacatgagagcaacatcttttctcaggaagcaagggatgaatgtggattttaattagaggtgttggagatgtgcctgcctgggctatcagtttcagttcagtaaagaaaagttatccaaatacttgaataagctcagtataatgccattatttaatcaagctctgtgttttgagagtgtactggcaaattcaaaattaattaaacactcttctattaagggtcagctacttatgttcatacattagcttttcttgttaatctactcttaaacactgcatatattacactttgcagtcttacacacaatggctacagtcagaaggaaataacagtgcaaatgaagatttaactatcatgaaggtcatcacagtgtcttacaaaataataaaaagatgtaaatatctttaatgcccaactacttaaaataaggaatagccaatcaatgtgaatatcatgaatccattaaaataatgatattgaaaaacttccttggtatttatctaaatgagttgaaagcttacatccaaacaaaagtcttcatcaactgaaacaaacatactattctagtaaaagatgttaacattcagatggataagtagtttctcagaaattttattagcatgacctaatctctcagattgtaaaaactgttgagactgaattgtatgtcttcttcgaagttaaagaacataaaatcccataaatcagctagtcagcaggcccacttaattttataacaaggataacttttgatcaaatcaatcaactgttttgtttttataagcaggtaagtttgagatgaatgaagcataaggtctcatctttttaaaaatgctttattctccagctaatggagcctctttgagagcggtttctctcaaaatattattttactattaactgtcattgcctccaaaacccaacagaaacccgttggtcacataaaggcaagtttattaaacctacttaagtaaaggagaaaaccacatggacggataccttagaagaggaagttagtgaatcaggtatctaagtaagttttgtttgttctgctttgttaaatacaaggacagtaaattaggcctggtccaagtgccatttaacaggtaccggaaattatgctggtttcaattctcccatccaacaaaagcccttagctactggtaatcttatctcaacaaacctattatatatccaaagtttaggctgagctaaagcagcaacaaaaccaactgaataaaatgatgctcattcattgaaatttcaggtaggcccacacaattcatatttccaagctctttataagctgtttgaatgttaaatggagtggcattttgctttagaatgtatagaaatggaaacaaatgagtttaatatacacaacaggctttgacaacatgacttcttcgacagatgtcctatactacttcccacactttcatccttaaaaagcatagtctacttgccaagatacaaacggttgccaatattcagctgcaaaagaatttccaacagtaggaaccagtggaaagaattaaaacactttaaacttatttccaaataaccaaatgtatcattataaagttgtaagataaaaaataatcatgctgcaagttcttactctgtcaactagctagttcagcaaagaggaggggtctttggcaaacaaggctctatatttggttgccagatgacttttttaaatctatcaattcatttttctaccccaaccagccagccagcattaattgagcatgtactatgtatacacacaagaagtagatggcataactcctatctaggaaaaaaaaaaagcatacaattcatttgatgtgcaattcatgcatcaagacaggactgatttcaattgacaatattatgagatagaaataaaagtggtacagcatcagcgtattagtctgttctcatgctgctatgaagaaatgcctgagactgggtaatttataaagaaaagaggtttaattgactcacagttttgcatggctggggaagcctcaggaaacttacaatcatggcagaaggcacctcttcacagggtggcaggagagagaatgagtgccagcaggggaaacactagaagcttataaaaccagcagatctcatgagaaactcactatcacgacagctgcatgggggaaactgctcctatgattcagttacctcccaccgggtccctcccacaacacatggggattgttggctgaactataaaattggaactataggaattatagaaatgaactataattcaatgggaactaggattcaagatgagatatgggtgggtacacagccaaatcatatcagtaattctgttggaaaccttgtggctggctaacatcacatcaagcttaattcagcttgcaccatcatttactgctttttattgtatttttaatgttctctgtcctaaagtgaattctgaaccacaagataggaagatatatgacttgtctttaaattcaccacagtgccctgtacactgttctatatatattgctacagtgcctagtatgtgtctctgaaaatagtagatgcaaggtaaatatttattactaaaaagatgtgcaagcatattttacgtttgtcgagtttttaaactaggggactttactcttcagtttgtctgaatagtatacagctattgccctggaatgatgattaaatagtgcctccttttacttttgcaatattattgcttggattataaattatctggttatcttctggctctggaactgcacacttacaatgttgcctcaaccacttctgaatgcatctcagaggcaaagactgaggcttactcattattgcttctccaaatctatttctgtactccacctcttctagggtctgcatcaatgatccaaggaaaaaaaaacaaataatagagaaactcataataaactaaatcagattgaatacatctagaaaagaaacaaaagtgatccacatggagataaattaggcaggcaaatattgacctgaatgttctcctaaatgtaaatgatacaaaagttgtctccttgtatttaaatccatacagcagtgaaatatcattgtcattgtcaaatatctctagatccctgagtttattcagcataatttcaaagttatttgcttgcagggagagatcaagaatgaatatgttggggctgggtgcagtggctcacatctgtaatcccagcactttgggaagccgacgtgggtggattacttgaggtcaggaattcgagaccagcttgaccaccatggtgaaacctcgtctctaccaaaaatacaaaaattagctgtgcatggtggcacacacctgtaatcccagctacctcggaggctgaggcaggagaattgcttgaaccctgggagccagaggttgcagtgagtgaagatcgtgccactgcactccaacctgggtgacagagcaagactctgtcaaaaaaaaaaaaaaaaaaaagaatggggatgttggtttcagagccaagtgactttgggtcacaatgctgcgctgccataaatggcttcggtaaccctggggaagaaataacacctttctggtatcagtttccatgacacttaggccttattcactcattcaacaaatatttatcaagttactattctaggctctgggtacccagtagcaaatagaacacatgcaaatattcctgcctttatggagctgacattccagtagagataggtaaatggacatagtaagtaaaatatataagagaaatgataactgatacagaggaaaatacagcagggaaggagcccaaggagttcagggatggggtgagaagagggactgctttgctgccatggagcccttggggttgggatataggggacataggatgactgagaggctggtcttcctgtgatgactgactcaaaaagggataaaagggtagaaaacactctgtagaggtaagcagctaggtgcaggcatgggcagtggttggtacactgcttgttaaataaattaggaagtgagtgaatgaatgaataccttcaatagatattagctgccatcctaagatgtagcaaatctgtcacctgagaaaataatccaatgaagctaacgtcacctagagcttaaccattaagattctgtaagtttctaaactgaaacatctctcttaattaatgaaagagattcattttttcggtcatgattcattcctttcttgatagactattgctacgttatcactagataatttaatatatgcaattgtgatttagcagtcacttaaagttttcatattaaatttgatgaattaatcccaaatctaggtaacatagaatgtaaaggcaataatggaaaacataaagtggtgacaaattaagagtaaattagttacaagtagcctaagaccttactaactaccttaattatttagcaacagaaaccggtgctaacattttaaacacctttacttattcccatccaaaaaataatcagttacaaatgcatagaatagtcactactgataacaattacaactaatatctattgaacatttacttggtgccatcaagcactattctaagaatttttcatgtaacactggtcgcggtggctcacacctataatcccagcacttggggaggctgaggcgggcagatcatctgaggttgggagttcaagaccatcctgaccaacatggggaaaccccatctctactgaaaatacaaaattagctgtgcatagtggtgtatgcctctaatgccagctattcaggaggctgaggcaggagaattgcttgaacctgggaggcggaggttgtggtgagccgaggttgcaccactgcactccagcctgggcaacaaatgcgaaactccatcttgaaaaaaaaaattttcatgtaacagatcctcatagttaaaaggttcattagaagccatgggaaattcagtcttcccctaatgcatgaacagccttgaaggaaaaacaaatatctggttctggcatgaggagccctgcttcatggtatgcttatctttgagcagatttaaatgcttatctttgagcagatttaaatatcgaaaatttaaatattgaaaagtttgaagatttaaatattgaaaagttctttgtatcaaactaaatttcacctttctaaaagtgctattctttgatcatagtcattcaaaaacaagcctgagtcttatttatttatttagaagcagggtctcactctgtcacccaggcagaagtgcagtagtgtgatctcggctcattgcagcctccacagcctgggctccagcaatcctcccagctcagcctcctgagtagctggaattacaggtatgggccactgcacaagctaattttttaaaaatttttaggagagacagtgattcaccatgttgcccaggctggtcctgaactcctggactccagcgatacacctgccttggcctcccaaagtgctgcgattacaggcgtgagccactgcacctggccctgaatctttttaatatgaaaacctcagattatctaaacaggagtttttattctctcccttttccaggccacatcagtctcggttcttttggcagttccgaagacatcatgattcccagatgcttcaccatcctggcaacacccttctggactgattgctccttgttgatttcctcttaacctgtggtatctgaaatgaatcccacaccccaggtgtgatatgacgattgcagggcacagaatgtcagtcagcttaatttctctgctgtacatctatgaataaggcttaagacagaattcctcacatattcttcatttacatgccatcacccttgggcctctaccatccaattctaattaactgtgcacttgaaattgcagtcatttttattagcaagcttaaataactattgactctgactttgcattccagtgtatttactatctctttatgtttctgtatatttgtttgattggatgaacggtcttccatccaggcaaatatttagtctttactcagtattctttatctatgttgttcaactaggaaaaaacacacttaatagtatttttatccaattcacacatccattatagctaccacaagatacttttgcaaatattttaccaaaataaaaaatacactatttatacagcatattcctgagttaccagacaagtgatagtgagattatggctagttttgtgtaaagtgggaaatgcaaatgataacaatgggctttgggaccattttttattaatgaaagataaggctttgtgagagagaagtaaaagaaattataggcagtatcttggaagatcattcagatattaaattgactttgtaatatagaaaaccaatttagttgagaccaaggcagtgtaacttgtggggaacatcaaatagtgaacacagactggggaatgaaaatgtggtttgacaacatccaagttttcataatagataaactagggacaaatcagcaagttaacagcttaatacaaactcaaggaggtcaagttgcaacatcagggtctttgagctcattttcccttgaaagagattaaatgagagctcatactcactgtgaagagtgacacccagagaaaattcacaggagcacataatgtgagtgaacaaatatttaaataagttggtacctttttgcctggaggtaagaagacagcggtgatttaacaacatgttttggagactttctgcaaaaattaatgatgcctattacattctaccttctcttaggaaatataaaagtatgtgattttaaagaaaagcagagggaataggtgcagcaacctaggaaggttacctggcagtagagggtcattaagcactgggttcttgttggggaaattttcaaaatatcttcaaggacccatttgtccacacccaattgccatagaagttcacagaggaaaagcccaagctaagagtatatcatttatatcaccgaattagttgttggtagaagtcattggcccataccatcttgctacgaaaagcaactctttttaaccttttcccaccactatacaacattaaaaagtcaatcacttaattctaatttattttgaccttagaaaaacccagcagagtgggaaatttcaacagatacaagagaaaaataaaatggcccctgtcctcacaaagcttacaatactttttagaagaaatgacttaaacacaataaattctcagtcaatgtgagatagtacctactgtgtggctcaaacataaaatgttataagagttcagggaatgtaaaatcaatgctcgcatgaagtaaactaattcagtttacacaacgactcttttgctaatctcattccaggcagacgacagaatgcctgaaaaaaaattgattgcgtagtttctagaatatgaatttgacaatctgatcatttttcttatgaatagacacaaagaaatagataaagacagcaaatgttatactcaaaggcttacataatgttaccttcaaagatggcatatgtttgcactttattttttatttccataaaagaaatggcagaattcctgaacagcatgttccatttagaaataaaagcatgtactctctcgttctcctttccaatactggaaaatcaatagtgtgattatatggagacagaaaaggccgggtcatctgaactaacaatatcattgctattattaataataagagtgcagtatctagaatttatttaacgtgattattttgccatcatgaacaatgttaatccccacaagaacagatggtacaaccatattttaaattattcaatgaagtgtgttttttaaatcacaaatgtgtatgagcagagtggatgcatttgaaatttaacccttgcttatatttttgctgtcatacagtctaagagataaccagtcaatggagaagtggccttttctctctcttgaccttttggatacaatgatgatagaaaataggtaatgaggggaaaaaaaatcacagaatttcatatggaaatttttttaaagagagaaaacaagagaaataaatgacttgtttagggtggtacaagagggtaacactaaggtggcagtctcttctcagtgagctagtaaacattaaactattgagatcaaacaggaaggtatctaagcccactctccagtgcttttctgcaacgacacgctcttcacagggaactataattttagcgagctccatgaatacttagaagatcatgatagtcagggtacttgtcttttttgctttgggctattcatacttacagcatagtgagaaaacaagagaaagcttctctggggtttttctaaagatatcacatgcaaaccctgggcttggctacagaccttgggccttgctcatagatatggaaaaattggaatatgacattaatgccgaaagataacaaaggaaaatgctatgacctgaaaggtgtaggatagagtgggtaaattggtcctccttggatcaaatatggacagcaggcctgagtttgtccaacatatttttaattttgtttttccttttgatccaacatttaaagcacacagaaaatgtcacattaaagttgagatttgggcttcttttgaatgtttaggaggtttaaaaccttcagttcccagtcgggcgcggtggctcacgcctgtaatctcagcactttgggaggccgaggcgggcggatcacgaggtcaggagaacgagaccatcctggctaacacggtgaaaccccgtctctactaaaaacacaaaaaattagccgggcgtgatgtcaggtgcctgtagtcccagctactccggaggctgaggcaggagaatggcatgaacctgggaggcggagcttgcagtgagccgagatcgccccactgcactccagcctgggtgacagcgagagtccgcctcaaaaacaaacaaacaaacaaacaaaaatacctagagttcccctccctacatattgccagctatctccttcagatggggcaagcattctccagtttgacaatccccattcaagttctgtaactcagatacatttcttcctggttctgtaagtatttaatctgaaggcctttcaagtaaaactgagttaggaaaaagtaaatctgctaccacctggtcaaactcttaaccaaaacatctctaaaaccaagcacttttagagaatgtcctgtccttcccaccacaatttacttacctaccaggaactattttcaactctttacgaagcactaaacctgaattccaatcgatctggaattacctcatttgttatgtatcaaaaattctctaatatattatgaaaaaacctaggttttatttaccaatgtatgcctatatttaaatcaagataaataagtcaattttagtgaaggaagaatcattcagtaccacatttttcatgcattcaagaaacatatccagtttatgctggcaaatactcccccaatggtactgacatatattgttcatctggcttatggtgacatatctgaagtttctgataattctgttcccaacatttatatggtattaaattgaccctatgcaggctgaactgcctgaaaatacagattctgttgcaatttgtctgtagttgtaaagaaagtcgattatttaatcagaatttaagaagacttctacatgaccttgataataccaatgatttagtcaaaattatttgacataatacagacaaaaataacacagttaacagaatgtagcctttttgagtagtttccggcaacttgtaagcatagtttaaatccagtcttaatcaaatgcttcagattagcagaaattcatagtctgggaattatgtcatgttgcttatatagaatttatttatttatttatttacctacctatatggggaaacaggatataattcacttttgaaaaatatattactgccatctgcctcacaatataatttctttttgatggctagaaatactaaagaagaagaaaaagcatgatacacatcagtgatttttaaagcagtcttttgtctgccccatggtcatacatacctgagtgttgagtagctataaatgaattcccatggttggtttaaagatagagtccccagtaactaaataactgagctaatataatttgccagttttggcttctgatataacagaggcaattgtttaagaaagcgtaatgtgaaaatgttttaattaaaaatagctgcaaagacaatttaatttggtcattgtgctatatgtatacacatatattatataacatatacaatcttttatgtataaaaatatatagacaaatatcaatggatcattttatttatattcattataagtacttaagtaacttgataattttaacacttataagtgttacctatatagtaacaagagtgattcttcaaacatgtataccatatgcaaattcaaaccaatgtttcctaaatatttatttcaatgaaaaaaatatagtgaattctattaggattaaagacatttttgacattctctttgggaattatcattacagggcacttccagtgtgcataagaaaactgcctcttaattttatagttacttctcattttgactcaaaatagcattcgctaactggatcatcaactttaatcatcaggcttaatgccaaaggacttttggcagcttcatagaactagataaaccttcaacagatggagatttgtcatcaatgaatttcaaaaacatgtagcaaaggctcttttgaaggtaagttcaagaggggaatccctgaaatgtttgaacaatggcaatatccttgagatattactagtacggagctccccacaggcatcattgagaaaggctcaaactccattacattaatgggtaagttctgctgtgttctagccagtctttctgcctcttttctcttcggttcatgtgtgtttttaaaatagtaaaacaaaatgtgtgtaatttccagagtcaatgtcagaggttcacgctctgtttagactttttggttgtgcagattttaacataattgctaaaatgtctcatcagaaataatgaaaaatagttatcgctttcacattcctttagtgcacattcctttgcagcatccatgcaggtgcattagagatttgatttttggggaacctaatgagggtcagactggtcagcctgtgggtgctacatctgcagtttactaccccaatcctctggtgctgtgagatgggtcagacttggcagtggccaagattgatgttatgtagactttcgagttcatgaagcaaaatccaagaatcttaccttcactcaacatggctacaactgaatctatcagctgttcttccctgatttacctccctgtactttctcatctggtaaccttctagttattcttcaagattccactgtgatttctactccatgtgcaagattgcttgctggaatggagaaaaggtgagtgtagggaaggtaaagaaaacactccctcatttagctattaattcattaattatcaataaacactttttagggtgtccattgtgcaccaatcacacacttgggtctcatggatgaatatcacattgctcctgccctccaagggcccaccactgagggaaggagagagacaagtaaaccaagcacaatacagtgtacaaattatcacaggatagatgtatgggcttttaaacacagctaagaagaaaaggaatagtaattcatcggaatgaggaagtaacattagatatagctttgggacagtgcacagaatgtatgtaaaaaactttaagtacttttgtaattaatttgaaagaatctgattgtgttattgtaaaaatgtttaacagctttccaagcccattattgtgccaggattatacttcctgccccactgacaccaagctgatcttgcaacccactttggccaatggcatgtgcatggaagagatctgtggcatttctaaacagaagttttaaaaaatcactgtgtgcccctgccatctcccaatttcttctgccttctcaggatgggcagctcatttagggttggttccagaacaaaacgaacatatcaatatcatccagccaagaacaagtaatgagagcaagaaataagactgtggctgtagcaactgaaatatcagggtggtttgtaacctcagcctaattagtcaaaataagctgaaacaaagaagctcatcgtagtcaggggcagattttaagaagacgtgtatttctttattcaaagcaggctgacacacggatgttgagctggtaaaggctaaagtattttgtaaaataaaatggtaccttctctaacctttcataaggtttttgacaataagctttaagattctctggctgccaagtgaggtgggactctccatgccatgccccaatattccctcaaccacactgatgaggagattttgcctatttcccttctccatgttcatttccctggctctggggtctgttctcacacctgtctcttcccattgttactcccttagtaagcagtgcttgagagtgcaggttgagctggcaatgaagtcttttgaattttcaatacatctgggtattacttcaagtatcattataacaataatacactaaagtttgcaacagaaataattgcagccacaattcaaagaacactcttttgcagtggtaagtctcaaatgtgttttgttttgtttctgtatcaatatggagagtaaaaaggaagaatgtagaataatgtagtagaatgttgtagttttggaatatccctttttggcgggggaggtggaaggacatccaggctagagtgcagtggcacaatcgctgcaaccttgacttcaggactcacacgatcctcccatttcagcctcctgagtagctgatactacaggtgtatgccaccatgcccagctaatatttttttaaattttgtagagatggggtcttgctaagttgcctaggctagtcttgaacttctgggctcaagtgatcctcccgccttggcctcccaaagcactgggattacaggagtgagccaccattcccagcagctagggaatatcaacaacaacaaaaaactgctccccaggtgagtctgttataattttctgcctcccatccacatgttgtcttctgaccccaaatccagattgaaaggccctgcttcacatatgtgagagattacaaatcaaagaacaatgcttttgatgcataaaagcataaaaataccattagcagtcctgtgttccactgtgaacagcattaatgcccttcacccagagtgttccagcatcttcctgagttacctgagatcatcctgctttgtacatgttgctgggtttatgcctgtcttcttgtgaagttagtaatagtcccccttttactacttgagacagcaaattatttgatcactccaaatctaggttcattaccaagaaatgttgaggcccaggaaaagtttgtgctggaaattttccacagtgctccctcacattaagcagatatagtttttctcccaaatcgattccttctaacgtcgttataaaactttaaaaatgctctacccagtaaaaccttgaacccattgtgcaaaagtattccttatttaaccttggagcctttatatgaatttttcatattaaactcccttacttaactccctcttcttacctgccacaaatatctttactcatagcattcatggcttccttcataggacagagaaatgtatcaaatgattttagtttaggaaccaaaagaacaacactgttttcagcacgttaaaaatgcctatattctaacattggttaaattatgtaggttttctcagtctgaagtcttatgttggtgggggatatggcagggtgtgtaattagttaagagtggcaggaaaaaaaaaaccacctactttatggtccacccccattcccaatctccactacaaaacagggaggaagctccacagaactatgatttccttgaatcacttcaatttgtacaacactatatgcagaacttttatgaagcaaagatttgaactattaataatagctaacattgcagctacccaagggcacacatatctctaccaaatggaagctgactagcagaattcagtttctatgtgtttgccatttagcagttatttttccaccacttgggttataatgcaccatactgacatccagagcaatgccatttctgccttattttaagataaaatgctaaaccaaaagctctattctgactatgtaaatgatcgccttgtgccaactgattagcatttttaaggcaaaaaatttcaaagagatagcatgttacacacattacacttagcgtgaaagcaaataatatattggctaatgtttttgtagcaccacagtctttctctgacctatgaactataagtaagatggaatgtgttatttaagattttttctctaaaataagtttcaattcataacaataagttcacaactcaatcactctgtcagtattggctggtaacaaaaggaacctggtgggtcagcagtttagcactgagtacactgtgtccatctagtggccaaaaggtgactgagtgctctaaagaggtttcacagcataaagaataaaaggcaaggtggctggttttttaaaaacaactttaacccaaacactgtgcacacatttttaaattctaacaactattaatcaaatcactttcattttctgcaaagactacagcaaacgtccttcttctttcttctcaaatacttgagtccccacttcccacacacagcagatgatattcctactcaaagagaaaatagtaaccatcaaaaaggaacattctccatgtccagccatcaaaatgacaaacacatctactcccacagtcatcatttccattttccctcctgttaccaactcgggcaaatccttccacctgtgctttggttctttgtccttctcacattctctgatacgcagcttcatccatttttcccttactcttttcctcctctttaccaaatcttttccataagcacttatttttcactgtacaaaataagatccctctcaattcctacttccctatccagatacttcttacctcctcctcactctgagcataatttcttgaaataattttgtttatattcactatcttgattctccctttgtacttacacctcaacccacttcaatctggtttatgctcctactatatggaaatttctcccattgggtcaccaactgacttgtgtttcactaaaccaatgaacatttctgaagctattggccactccctcctttctgaaacactcctttcctttggcttccatagcacctaactttcttggttttcttcttaagtctctgttcatgtctttcatttcagctttgtcttcaaatattggcagttcttaggcttgagacaggactctcttgttctcctaatcttgcaccccctttagttgattttattgactcaaataacttctatgaccatctgtagatggatagctccccatcaatttctttggtctgcatctgcctcctgagctccagacacatacagcgcacctgactcctggacagctctccctggggataaccgacatatacctgaagttcaaccatggaactcttccttctccaatattccttctcactgtgattagaacctcagctacccagttgctctgttttgaatcctgaaaataatcctaaccctttcctcaatcttgtttcacagagtctctcaattaccaagacatgcagactccacctcctacctctatctctcagataagctcactttcctccattgcctctgctatcattctgctccataccaacaccgctgtctgtaataatcttctaaatggttccctgcttgcatcccaagtaattctatacaatgcagccactgactttaaaaaacacaaatgcccatgtcattccactgtaatgtcttccaatgagcttgacagccctcaaacattcttgaccttctttctcttgtatgtcacattccagttgtctacatctttagtttctaaaatatgcctcattttccttcccattgcacatgatctagaaaaaccttgtccaatccatgaggcccaggacggccttgaatgtggcccaacacaaactggtaaactttcttaaaacattgagattttttgtttgtgattcttttttttagttcatcagctattgttagtgtattttctgtgtagcccaagacaattcttccattgtggcccagggaagacagaagattggacacttctgatctagaatattcttcccctctccattgatacatttatattcacacttgaggttttagcctaaattttactttctcagtaaaccttcattgactacttctaacataagatccgcctctgccactcctatcaaggctttatcaaacagcttccgactaagctaaaagaaacactctatgcattttaaaagtagtgtatttaatagatctgattcattgcactggtgatggaagagttgaaatgccaaataggggactgtgaggcaacttaggggttagaaacaacaggaagcaactaccgcccctggactagagctaaaaaggagggctgatgtatgcaaggattagggtcacctagctaagggtgaagccatggaggagacacagctactgcctgaggtgctgcctcaggtagagagagtaaaacactctggcttctctctttctgcctctccccaaatgtccaccagtgcctccaatgtgctacatctatctaacaaaggacatggaagtcttgagaccacagccttcagagcgtagcctccaactataaagggcagagaaagggcaatatgtggtctgagaataaataggtaaaaggccaacacaaaaacattcatcacatttaatgtctttactcctaaagattttcttccagtccaaactgtaagaatcatgaggacaaggactatggcttaacagattttctcttttaaatagcaaagtgactgaaacaggcatatctcattttattgtgctttgttttgttgtgctttgcagagatggctttttttttttttttaacaaaatggtttgtggcaaccttgtgtagagcaagtctatgggtaccatttttctaacagcatgtgctcacttcatgtctctgtatcacattttgataattcttgcaatatttcaaacttttaaaattattttaatacctattatggtgatctgtaattgctgattgttgatgttactattgtaattgtttaggagtaccataagccatgcctatataagatggcaaactcaattaatgggtgttctgactgctccaccaactggccattccctatctctctctttctcctcagtcctccccatccctgagacacagcaatattgagattaggtcaattaatacaatgacctctaagtgttcaagtgaggtgaagagcagcacatctcttactttaaataaaaagctagaaaagattaagcttgcttagtaaggcatgtcaaaagtcaagacagacagaaagctaggcctcttgtaccaaacagccaagttgtgaatgcaaaagtaatattcttgaaggaaataaaaagtgctactccagtgaatacaaatgataagaaattgaaacagccttgttgctgaagtggagaaagtttgagtagtctggatagaagatcaaaccagccacaacattcccttaagaaaagcctaattcagaacaaggccttaactctcttcaattctataaagattgatagagatgaggaagctgcagaagaaaaggttgaagccagcagagactgtctcatgaggtttaaggaaaatgccatctccacaacacaaaaatgcaaagtgaagcagcaagtgctgatatcaaagctataggaagttatccagaagatcattgaaactacattaaacaacaaatttcaaatgtagacaaaacaaacttttattggaagaagatgccatttagcactttcacaactagaaagaataagtcaatgtttggcttcaaagattcaaaagacaggctgatcctcttgttaggggctaatgcagctgagggctttaagttgaagccaatgttcatttaccagtctaataatcctggggccattcagaattacaccaaatctattctgcctgtgcttgtgcctgaaacagcaaagcctagatggcagcacatctgttgacagcatgatttactagatattttaagcacactgttgagaactactgctcttatataaagatttttaaaaatatattactgctcattgacagtgcacctggtcatccaagagttctgatggatacatgatatggtttggctgtgtcgccacccaaatctcatcttgattgtaactcccacaattcccacatgtcgtgggagaaacctggtaggaggtgattgaattatgggggacaggtctttcctgcagcattctcatgatagtaaatgagtcttacaaaatctgatggttttaaaaacagaagtttccctgcataagctctctctttgcctgccgccatccatgtaagacgtgacttgctcctcctagccttccgccatgattgtgaggcctccccagccctgtggaattgtaagcctattaaacctctttttctccccagtctcaggtatgtctttatcaggagcatgaaaacagactaatagagtaaactggtaccagtagagtggtgcagtgccgaaaagatacctgaaagtgtggaagtgactttggaactggataacaggcagaggttggaacagttaggagggcttagaagaagacaggaaaatgtgggaaagtttgaaacttcctagagacatgttgagtggctttgacaaaaatgctgacagtgatatgaacaataaggtccaggctgaggtggtctcagatggagatgaggaactttttgggaactggagcaaaagtgactcttgttatgttttagcaaacagactgctggcattttacccctgccctagagatctgtggaactttgaacttgagggaggtgacttagggtatttggtggaagaaatttctaagcagcaaagcattcaagaggtgacttgggtgccgttaaaggcattcagttttataagggaagcagagcacaaaagtttggaaaatttgcagcctgacaatgcgatagaaaagaaaatcccattttctgtggagaaattcaagccagctgcagaaatctgcacaagtaacggggaaccaattgttaaccccaagacaacgaggaaaatgtctccagagcatgtctgaggtcttcatggcagcccctctcatcacaggcctggaggcctaggaggaaaaaaatggtttcatgggtcaggcccagggtcaccatgctgtgtacaggctagggacttggtgccctgtgtcccagccacttcagctgtgactaaaagtggccaaggtacagctcaggccatggattcagagggtgcaaaccccaagcttggcaacttccatgtggtgttgagcctgcaggtgcacagaagtcaagaattgaggtttgggaacctctgcctagatttcataggatgtatggaaatgccaggatgctcaggcaaaagtttgctgcagtggcagggccctcatggagaacctctgctatggcactgtggaagggaaatgtggggttggagcccccacacagagtccctactagggcactgtctagtggagctgttagaagagggctaccatcctccagatgccagaatggtaggtccactgacagtttgcgccatgtgtggaaaagcagcagacactcaacaccagcctgtgaaaacagccaggaaggaggctgcaccctgcagagccacaggggtggagccgcccaagaccatgggaacccaccctttgcgttaacatgacccaaatgtgagacatggagttaaaggagatcattttggagctttaagatttgactgccctgctggattttggacttgcatggggcctatggcccctttgttttggccaatttcttccatttggaatggtatttacccaatgcctgtacccccattgtatctaggaagtaactaacttacttttgattttacaggctcataggtagaagggactccccttgtctcagatgagatgtaggactgtggacttttgagataatgctgaaatgagttaagactttgggagactgttggggaggcatgattggttttgaaatgtgaggatatgagatttgggaggtaccaggggtggaatgatatggtttggctgtgtccccatccaaatctcatcctgaattataactccaacaattcccatgtgtcgtgggggaaacccagtgggaggtgattcaattatgggggcagctctttcctgtgctattctcctgatagtaaatgagtctcataagatctgatggctttaaaaatgggagtttccctgcacaagctctctctttgcttgctgccatccatgtaagatgtgacttgctcctccttgccctccgccatgactgtgagtccttcctagccatgtggagctgagtccattaaacctctttttcttcccagtctcgggtatttctttatcaacagcatgaaaacagactaatacaatacacaagattcatgttgtttttatgcttaacacaacattctttctgcagccatgattcaaagagtatttcaagtcttattatttaagaaatacatttgggaaggctactttctacagtgattcttctgatgtatatggataaagaaaattaaaaatctggataggagtcaccattctagatgccattaagaacattcatgattcatgggaggaggtcaaaatatcaacattaccaggagtttgagaaaagttgattccaaccctcatggataactttgaagggttcaagtgaaggaattaactgcagatatggtagaaatagcaagagaacaagcattggaagtggagcctgaagatgtgactgaattgctgcaatctcagcaacaaagagatgagcagttacttcttatagatgagcaaagaaagtggtttctcaagatgaaatctactaatggtaaagatgctataaaaattgttgaaatgacaataaaagatttaaaatattatataaacttagctgatacagcagcagttgggtttcagaggattgtctccaattttgaaagttctacattcggtaaaatcctatcaaacagtatattacatgttgcagagaagtcttttatgaagagaaaagtcaataaatgtggtaaactttattgttgcctggttttaagaaattgctacagcttctctgaccttcagcaaccgccaccctgatcaatcagtagccatcaacgtcaaggcaagacttcccaccagcaaaaagattactacttgctgaaggctcagatgatcataagcactttttagcaaggcaatattttaaaattaaggtatgcacgttgtcttctagacatgctattgaatacttaatagactatagtgtaaacataacttttgtatgtactggaaaaccaaaatgtgtgtgactcactttattggaatattcactttattttggtcatctgaaacccaacctaccatatctctgaaccctatacttaagagatgttcaggaaaagttggctgaatgggtaaatgaacacaataccattgttcacatttgcagatggtgcaaatgagacctatagaattcacgtctgtaatcccagcactttgggaggccgaggcaggtggatcacctgaggtcagaagctcaagaccagcctggccaacatggtgaaaccccatctcaagtaaaaatacaaaataaaaatggctgggcatggtggtgggcgcttgtaatcccagctactttgggaggctgaggcaggaaaatcgcttgaacccaggaaacggagtttgcagtgagctgagtttgtgccattgcattccagcctgggcaacaagagtgaaactctgtctaaaaaaaaagaaaaagaaaagaaagaaagaaaaacagaaagacaaaataagacaagaaaataacgacctacagtcccacagctaggaaaatgtgaaccgttaatgtgactctaatctgactccttattcttgttactggaccatattgacttctgatctgctttcttattattttgccttctaatacactatgatacatggatttaaaaagaacactcagccattctgtggttttgatacatagtgctgaaatcacatctttgattcttttactatttatgcacttaatgaacatttattaaacatgtaataaatttgataaaccaaaaactgtgtagaaagaaactattaattttgttcatcattgtattaccagaacttgggacatgtcttgcacatcataagccttcaatacatatttggtgaaagaatcattgcataagtaaatttcaatgacactaactgcttaagatacagagagagctcttgacattaaggaattctcagtgaaacctcactggaaatagtctatgaattaattaagagatactgaaggattttgaactgcagaggacataccactgaaacaaagtaggcgctacttgcctgctttctgaatctgctttgtttgttctctcaggctctgtctgtggctggaatccctacaccttctatcgttgttgaactgctttgcatgttaaaaaataacacattttgggaattaactgtacgattggttaagcaaggggataaaaacaaacccagattggtaccttgttaacctacaacgatttctggaccaggtaaatcctcaatctctcctctgccaaaagaaaatgacaacgcataaaaataatgcagaaagcttaactgacatagttctgtcagtgttactactctggatctgcaatgaaatctgattgcttgcacttacatgaaactttctcatggatattgcagcatccttccccaatctcatattttattggcaatgcaagaagacataatttgcatgagatgcagaaagtggtaaattagaaaaattaactacgaagttgtttgccaatagaggtttatatttatcttagtataaataatttaatgtgtattttccttcatgattgaatttataatgaatattcgatgattaatttatttttatagaataaaaactgtttttaatggcccttttaactgtactctctagctttggtttcagtgttatcaaagcagaaacatttactccatttctaagtattttgagaagataattctgttaaagtttaaacaatagtgtttttaaaaaccaggtgaactttttctccttaccctgtcttatgtactgaaaaaaccaggttaatttttaaaagtattcatttgggaagcaactttctgagaggcgaaatattcttacatcagaaaagacagaagcagaggctagtgcctggaatgtgtttgtctctatctcggtagttccaacagtgcttacctgtttcacattctatacattttggcttcaaatccagtggttgtcaactctggatgtaccttgccttgaaccctaactctggcaatttaatagaatcaaaatctctccaggctggggccaggtatcagtattttaatattacccaggtgaagctaatgtccagccaaggtttcactctaacaggaatttgagacagcttgtttggtcagatgatcctatgatactgaaatcatcccaaaggtagctagcagatattagtagtccaaagccctgtattagattttgactctaattctaataaactttgtggagctaatgaggcatccacttaatttactcaatctgttcaattcttttagttacggaaggaagctaattcagtcctgtgtggttgttaactaatcacagatctctaatcatctgacaaagttagagacacacatgccagaatactaaacatttctacaaaattttacatggcatcccctagagcatgtgaagtcagatatcaattcctctaaggttcgaggaggggatgccttgttaagacataaaaccaagaacaataactgactttataatgagtcaaactagccatcagtataaggaggccttctaacaattagaactgccctgtaatgttaagaagacattaaatgtgaaaaatgatgtccatatggaaaaaatacagaaaatagacataagtagaaagaaagtagaaaacagacaaaattatagtatatataccatatatgcttgatatatattgtatatacttttattaaatgtatatgttatatgattataaatgggaaagaaatattacaaaatgaaaaatccataggaaaatggattaaaactttactgtgaaagtattttaataaaagtataacaaatttttaatgtaaaattaaagtagacaaacattatgctaattaaaaagattttatcatcttccctttgtggaagacatagcaggataagacaatactaaattacttgggaaaaggcattgcagaaaccaactgtgttagaaaattaaacagttgtcacccaaccaccagatgatgtcaagatatcacatttgttactattcaaggctactcaggaacaatgatttaagcaagagaacaccatgagtggtactgtctgaacatgacctagatagctcatgctgggtcgtctggacaatatgctaacagttggcagtgtcccccagcccatctggagaggcctccctgaaatacagcttccaagaagacgggtgactgccttttcctggaaaaagggagctgcagctttccatgcttccttaaggtctccaagcctggacagctgactttcctagacaattcctataaagagttgacatctaaaccccaacagtctggtaaccaaaaggtttatctgtaccccaactgggcagattcccctttacattcaccctaaagaggagagcaagaggcatgatgcagggtcggggtggtacaagtctcctctcttctagccaacacttgattagtaaatcactcaaatcctgttcctaccccatactgtgtgctgttgcagcacatgtgctctgccaagatatgtgtcagccatgaaggaacacacttgtcctcaaggcaggatggagaggatgttagtttcctcaagcaaagtcaggaatgaatttactttaccattatgggctactttcaaatatctaagagtcctcttggggagcacgctgctttgttctgtttacaacttcatagagcaacatgtactgacataaatagctaagaaattttaggtaaaaaaaaaagtttgtttaaaagcatgttgtaaattaccattttagtaaaaaagattatatatatttacatgtatcaaaaatctaaatatgtatacaaaaactcttagaaatagttatctaagagagaagcgaagattataaacatctaagttatatttctgtagtgtttggatttttttttacaaaatgattataatatataatcaagcaaaaataaaagaaacatcaaaaaattaaatcaggttctctttagacacagttttaaaacttggtttcctaagggacactataaaacacagtcatttggtaattaagaaattatctctagaccatctggctacctaggtaggccaaaatgttttgacctttttgcctgtaatcagttaagaacaatgcaagttaataaaagcctagacagcttacagcctgaacttcataatttttccccaggagttgactaccagtgtaattattctcagttcagtcaaaatgttgtaattggtttatttgtgtaggcttcaactaatcattgcctcaaagaaaaccagatttttttcctgcttattactctttagacccccaatttatttctcctagtatgccatcctggaagttgaacagatttttctggaatctagttgtcctttccataggctctcagtagaaagggactccttctactcatgatatatctggcccttacttattgtccattttaataggtcttaatgcaataatagatttaatgtttaaaatttaatgaacaaaattactagcattttgttaacagatactggcctatgtgactggtagttgcaaactctcattcttaagaagtattcttagctattctatgatagtcagattaagtaatggaggcaaataacataagacaatattcatcacctgtttagaatgatcaaattaatgcatcaaagcagtgattttataatcaattgttcttcttctaaatgtgaagaaaacacttctaagaatagcaaatagaacaacttagcctaaattatctccatttcccttcttcaaattattttagtcttcattatcttattatatcatccaccaattgtgtcacttgcaaaactatttccttggattctaccaatccaccctggcaaaattagctagggtctctaggtagtaccaagataccccaggtgtgtcttggctcaagttgttggccaagcagatgatagggtggcatacatcattccaaaggacatgcatgctggtcctctaatttcctaagtagcatctccaacacatcagtatagttctgagcaccctggggttttgtgagaatcagatgagtacaaccccatattatcttatgaccatcttagttaagcagatcaatatttcttcctaaacatcaaaaatataccaccagcaacacttttctggccacagatggagggcccttgcaggtgtttgacttgtttagtccagcaaccagcatgaaatctactaaatggagcagagagcaaataggaagttgggctgggctggtaaatcaaagatacgtcttaggatttaaacccttcaatgatgtaatatttaacagtagaatgaactgtgtctttcatatgtactattttctgacattccattactgacagtagtatgtcataacagtgtttcaaaacaaagggagcagaatggaatgagcctaaggggataataacttgtaaaaagttaattgtaaaaaaaaaaactgcagacaaatttttcttttatcattaagtatttatttaaacttcatactgagagacccctctatttattcctgaatcctttacatataatcttgtaagcagttgcaatgactaaaatgtccttggttagtcattaaattcaattattgactgtatattgagaaggtgtaaatcatagttcaaggttaatttaggggtctcttattaggagttggatgaaatgaaatatatgtgttacataaattgctgactgagggaaaaatatacagttaaaataataatttggatggagatgcattcatatcatattgaaacatgacgtttgtttgtgaggacacaccatatggaaattccccaattccttatactttggttataaatctttactgattatagtaaccactgtttcaggtggttaacctagaaagcttcaagaaggaatggaaaatgagattaaactcacatacatagcatctccaaataaggtttcttaccagcgaaagaaaatcaaagattcacattataaaaattcattactgatgcaaacctggttcccatgatgtttctaggattaagagaggtaacagtccccgcactgaatcacatgctcattaagctttcccttaaagccaggtggccaaggtttcatctctgctaacaaaggtattcaaaggaatttatgataatcattctattgtttgaattttccattgctagataatgcaagtgctcagtgcagagagatttccttaaaaaatgtttctgctaggtcaaattagcacctgtacttggatgttcaagtcaacatttctttctaagtgtcactgatttagaacataagagtatgttagaatattaaaagatctcgggtgtggggaaaagcaagagagatcagattgtcactgtgtctgtgtagaaagaagtagacataggagactccattttgttctgcactaagaaaaattcttctgccttgagattctgttaatctgtgaccttacccccaaccccgtgctctctgaaatatgtgctgtgtcaaactcagggttgaatggattaagggttgtgcaagatgtgctttgttaaacagatgcttgaaggcagcatgctccttaagagtcatcaccactccctaatctcaagtacccagggacacaaaaactgcggaaggctgcagggacctctgcctaggaaagccaggtattgttcaaggtttctccccatgtgatagtctgaaatatggcctcgtgggaagggaaagacctgaccgtcccccagcccgacacccgtaaagggtctgtgctgaggaggattagtataagaggaaggcatgcctcttgcagttgagacaagaggaaggcatctgtctcctgcccctccctgggcaatggaatgtctcactataaaacccgattgtacgttccatctactgagatagggaaaaaccgccttaaggctggaggtgggacatgcgggcagcaatactgctttgtaaagcattgagatgtttatgtgtatgcatatctaaaagcacagcacttgattctttaccttgtctatgatgcaaagacctttgttcacgtgtttgtctgctgaccctctccccactattgccttgtgaccctgacacatccccctctcagagaaacacccacgaatgatcaataaatactaagggaactcagaggctggcgggatcctccatacgctgaacgctggttccctgggtccccttatttctttctctatactttgtctctgtgtctttttcttttccaagtctctcgttccacctaatgagaaacacccacaggtgtggaggggcaacccaccccttcactcgggtcatgcaggaatcatatgtgcaaaaataatgtgataaaaacacacctataaggtgaaaaacatctacgtatttgctataaatacacatactttgaatttctatattctggcaaaagcattggaggacaaaaaaaaaatcttttcaaaatacaaatttgaatatgtatgggcctcacttttccacccactaaagccaacctggttagcaggatatttcgaggattaagagcggtagcagtccctgcactgaatcacacacatccattaagctttctcttaaaattaggtggcttcccattgttcttagggtagaagacctaatatgtctataaggttttgctccagttggcctctgctctcctctctagcctcatctcaagttactggcttcctgttagctctcttcatctcagcctcaccagccctcccttggtaaaccgtactgtccattcagtactgtttcctacatcaggactttgcacatgctgttcccagacactcatctttttatttatttcattctcttgcttctcctaccaccatcaccacctacaccaccactaccatcaccaccttaaccactattacttttggaacacatatccatacatgtgcacatacacatatgtgcacacatgcatactctgaaactctcctcattgttacatcctaggagaaatatttcctgacattttacacataccctccctgttataaaatctcctggtactgtgtatatttactacacaacactgattttttaaaattttatacatatttttagacttttaatgtcaatttctccattaaagttggagttgtctgtttcttctcatcattatttacccaacatccagcatgaaaccaggatacagtggataataatacctaaacattgtttaaatggggcaatgaatgtttcaatcaatgaatcagtcacatctgcacacctctgtgatagatggattatctactgtgcaaaattcaacctgaagagagataaagaaaaagaccattcattgggctcaactattttgacatgactgggctaactgctttgcttatttaaatttaatatcagcaactgcccaaagtaggtattctgattccttttttacagatggagaatctcagactcaggtggacttagtaacccacccaaagacacgtttggtacgagagcaacatggttattctgttttgttttgtttttttagaattttctataaaattgtggcaccatgtttatatctgcattcaatgacatttacatataatttgaatttaggatgatcctattttgaagcacagaaattacttttgaatgctggctctagaaattatgaaaaatagaatataacaaaacctgaagaaagtaatacaacaaactgaaccagcattttagtgttgaaattttaatgaagtaaacatcttccatttaaattagcgtgtgtacaattagaattattaagaattaagtatgacttcagaacttaaaatacaatttcttaaaccaaaatttgttttagtttcagctcacccaatctgctaccttgcaaccacaaatgtgtttatgatttccccctccaaaaacctgcctctagttcagaagactcttcactgggtaattattttccacaagcccaaattgttttctgtggtatgaggctgggttcaatgctctttacacttttgcccatttgcagagatcagcatttcctttcgccagaatgctcctgctgacgagaatgctgttgggcctcccagaaagaaagcagagacagttcatttgaccactgcctgactcaaacctctgctactgtttttttctgtccagataagggagctaaagtcagcaataattggaaaaagaggctctcatttggtcctgttatgctactttttccagtaatttcaaacaacaaatatgtagcatttaatattatatgccagccctctaggaactgtgaatgaagtaaacaaaacttgaaatatgatcaatccttatccttgatgaacttgttagggaagatagaaccaatatacatggaagaatcagagaataatgaagtgagaaactaacatgggctgttacggggtgaatcctatacccaaaattcatacattgaagtcctcgtacatatacctccaaaatttgtacgttgaagtcctcgtacctcagaatatgactatatttggagacagggtttaaaggaggtgattaagttgaggtcataagtgtgggccctaatcaaatgtgacgttgttataagaggagctaaggacacagacacatacagaggaaagaccccgtgaaggaatagagagaagtcagccatctacaagctgaggagagaggcctcagaagaaaccaaccctgctctcttgacttcagacttccagcctccagaactatcagtaaatcaattcctactatttacgcttgcagtctgtggcactttgttatggcagcctcagaaaattaacacatggattctattaaaaaatgattttagggcaggaataaaccagtctgtgttcaaagacttgaggaaagctttgtacatgatatagggtctgagttgaatatagacaaaaactaaataaagcagagacagagggatgacattctaggacagcaggaaactcaatgagataagactagtaaatgggagagagaaatgatttagtaacaggtaatggtctctgaaaccttttaacctttgctatttgttcatcttaaatgttaatgtatttttaataatatatttactcacattggatagataatctcaatttatagtaaacaatgtcttgttactaaaagggctatgctgaagttaacagaaacatactatttaccatatatgtttaaatctcgaaatccacggccatataaaaaaggactatgaatttgggcaaaatgccattgaagcatacgtacaattgtattttgtatgttatttcatatgtacacaggaattgtacatggaaaatgagaaagagaagacataaaacatgaaataaattatgtttgagttcactggtatttcatttatccagattatacacatttattgtcaaaagctttatggatttttctgggtgaagtttatacatatattcatgatcatatgttacaaagcatttaagtatatagcttcatagctatacacatgaaattaaatattaaaaatactggtttttttttctaatttaaccctcttctagaaaaagatcaaaaaaaagttccctcagcatgtgcacatctgtttccattgaggattttaagaaaatgtttaaaagctgcatttaagtgaataatttccagcctgggaatggtgagccagctcagaaccaaaggctgttcatctaaccaataagcaggtgtaaatgaatatttcatgaacactgtctgtaattttctttttacttgcacggcaacaatccctccccaccctccccgcatcttcctgtactgttagtcctctctccaaaaagagaggggtgtttgaatgccacttaaaattcttaccagtatctggtatggtgtcattctttactgttcacattattttttatcttttggattttgctttcaaaagccatttgttctacatcaggcagctgcattttctttcagcattaaggaagaagaataccaaaagtacttacctaaaaaacaaaacacaaaaaagggaaagattaaagtatattcatggagatgcttgatgtcttgacaaagcaccaaagtggggatgaaaacacccatagcacctaatggcccatggcaaataaagcatgtaaagccaccaaggaatgactgtagaagttgcacccttgtctgaaacttaagacagcaaaaggggtatgccttggttattttaaaaatgaataggtaaagcaaagttttgattttcttttattttcacttttttaaacaacttacattatctcagactgtaatccatcacgtctctgtccttcaacaggttctaactgcctacaataatggcttttatcattatgagccagaagactttaatcataggcctaacttagagcttcaatgcaaccataggcctaacttagagcttagagcatcatgaagagtgcattgagatatgccagacactggtggctcatgagagaaacaagggctttgctaacagttgtcttcctaactatgaggcctcctgcaatatgagacattgtagtgttggtagaagggtctgctttcttagacatttttgcggtactaacatagatataaaaactaacacacggccaggtgcggtggctcatgcttgtaatcccagcactttgggaggcagaggtgggtggatcacgaggtcaggagatcgagaccgtcctggctaacacagtgaaactctgtctctactaaaaatacaaaaaaattagcagggcgtggtagcgggtgcctgtagtcccagctacttgggaggttgaggcaggagaatggcatgaaccaaggagacggaccttgcagtgagctgagatcacgccaccgcactccagcctggttgacagagtgagactccatctcaaaaaacaaacaaacaaacaaacaaaaaacaaaaactaacacacatagtcagatgtggcatacaaaagagaaaagtaatttttgtaaatatttaggaaaaaagaataaataataagtggcaaacatcagtagttttcatcaatgtgccatctgtgtatagatacgatgtctttgactgtctgctggtcacagaaagccctctacacaaggaaggcaggggatggccttgaacagtgctcctgagtgacagctctggaataggtgggagaaggcacagtgcatacccagcgaagaaatctgttcactctgtcagttaccaaaagccaaagaaaaacttcctccataggaaatgatttccccattccattcttgacaagcaagagctaacaaaagaaagagtcccaaaagaatatgggacttttgggagagtagaggagatctcatttacgaagaggagagaacatccacgtgctgatagcagcagctaatagagctgcctgatctggtgctggctgggcaaaccaacgctaaaggcagaagcacaaaaaggcattgcaccacaatcatctgggtgacttggtcaaaaccaagaagcacaaaaaggcattgtgcttcttgcttttgaccacgccagaaaggcattgggcgacttcgtcaaaaacatgatgttctcagggcccaccaagatagcatctctggaggtaagattttggaatttccatttttaataagcacccctggtaaattttatgtggttagctgggcaccagtctgcacacagagttttaagaatcacatgctagaaggtgtgggtctgtctcctgtaagtgctacctgtcagagactattctctgagaatgctgagtcacataatttggtcagaatttaatgaaactgcagggacagagatagggaatgtgcatttctcttccctatttaattctgcctcaccaacaaactgctggtaaggaaaaaaaaaatcacacaaaatatattatttgaattggtctgtgccactaaccaatgctgttgtccattcctactgtcccctggttcttgttaataagataacattctgtactcctactcatagagggcactattttcttgtcagttcatgctgttgcagacagttggtaattccaactaccaaaataccataatttcatcagtgaattaagccgagaaatagttttgaatattacagagtatatagtaagatcttccataaacctgagttgactaatttctagcatctcttgaccttcaatttcactaatactgtttagctagttcttgagctatttttatctgaataatgtaaattgagaaattgatttactttgtttttcaggaaatattttaattaatttataatatttctctgctttagacatttagaaatatttattttacttacaggatagatgttgtggcatatttaaaaggataaaaatgtacttcagaaaagttcacaaatttaattctatatataaagagatttgttttttcctaaggtgctccactattaaatgaaatataacttaaaaaaaatcagtcctaatatcagcaaactgtgaactgacctcaaagttaatatttacactcatcagaagctaaatggagccgagtgcaatggctcatacctgggatcccaaaatcccagcactctgggaggctgaggtgggaggattgcttaagcccagcagtttgagaccaggttaggccacatattgagaccctgtctctactaaaaattaaaaaatacatagccaggaatggtggcatgcatctgtggtcatagctactagggaggcagaggcaggaggactgcttgagcccaggaagtcaaggctacagtgagccatgatcctgccactgcactccagcctgggcaatagagtgaggccctgtctcaaaaagaaaaagaaaaagacactaaatggaatggaatgactttaattgcaggtgagcctgtattgccattttaaaagatttttccaagtctgtcttgacatagcattcattttgtatttcataaatgagaagactgtgaagattaaatcaaaaaagctaacagtgctggtcaggagctagaaaacttggggtggagcttgaggaaagaagactatgagaatgatttttaaaacatcatctatatcttagagcataaaatggggtaaagataaactattaactgacacagggtgcaaagcaccacaaagcagcacaaatagctttatagcttctgtaaatcctaaggatcttcctaagactcacatccctctacaccccttcaaatcagattattcatttccttttccctctctgctgtacaagtgacaacagctacaaaatgcatcacccaaagggaaggtcgttaaaaaggcctgaagaatataaagtgtcaagcagtttggctttaactgtggcctttgtctagcagcacatagagtgttgtctttttgttttcttcatttttaaggttgtagtataatatattacagcccaagaccaacagttacagcttccagaggtagctactccgtgattaagagaactcatttacagtatattccatattttttatataaaaaaattaaactgtacttgccttattccacattcaaatggttaatatataacaattatggatatgacataaatagccctaccagaggcaggtcagaatatatatgacagtagggagatgtgaaaaacacagagaaagagaagggaagagccaatttatgcaaaaagagaaatcacaccttctgctattactacatacggtcttggaaatataatattttattaaagtcaaatgaagcatactttgttagagtttagccagttcaactacaaagagtaaatacaaatctaaagtaaatatgcttgctgaccaaagcatccaatgacaatcttatttgaaatcataccacatattcgtatgactggaagccaacttgcatagcgctctttatacgcaaagactgattttatgctgggcacaggaaagaagagagagtggaaaggctggaagagaggtatgtcacatcaaccaacctcctaaacccagatggttttcatcatcataaatcatttccccaaaggcagcaacccatttcatttgctaacattgctcttgaacaacttgcctggcaagtagctttctcattaactttcaaagacatcctatccatgtcattcatctcctgcgaatatacgaatataacatttccattaccttgacttttaatttccccttcaaaataggaattttatgaattgatttgacaggtcatataagtctctttatactattcataaaacttgccttccaatatgctttgaaattaagattataagccagttccatattaacatactaatgcctacccaaaattatgctggagacagctggctaggcacaccaagcctaattaaagagctaatatttttacaaagggattaaaagttacttgagattgaataatacatcttaatgacttaaaaaaaagaactttggactagaaatgctctcaacataggaggaaagtaagggctaaaagcagattgtaggaaaaagattactttcttacttacataagatcctctctctttaatcccatcagacactataaacaggaggaagtttaatctagcaataagagcatgacttttattgtcagacaaagctaggttcatggcctttaatatagttatacccagtttgaatcattctgctttctcatgaaaaaaaaaaaaaaaaaaaagagaaaatatggaaagaaagaatgacctagaaaaaagtctagaatacaatacatactgaaaaaagactgtttcaggtcttttgctttctcacataaactagctcagtaaaccaaaatactctcatagtttcaactatactaatgcctctcaaatatatagtttagactctaatttctaatcaaagctttaattcttaatttcgagtggccagaatagagaaatcacataacttatcacattattacaataatgtttacaattcacctgggaattttaaaatgatatatacactaataattatatctaaagcctgtacttaattatgtcatttagaagactgtagacaacaccaagccactccatataatccaccaaaggtacttttccttcctataaaaaatgatcaggaagatttgatcaataattcttttatttttcaaggaggagaatttcttgtttgttgtggctaccatctcaaaatgccttatagtgtctctacttcaacaagaacatccctgtaccaatgattttcaatgtccagattcccagatgttattattcctgacaatgaatctgcatttgtttcagatgcatttaagaaatttgtgaagctagagctcatctaacctgtcatcattactcttcatcaccctcaagcaaatggtcaggctgaaagaatgatgcagaccactaaggaagccataaagtaaactatcagaagaaagtgactgaggagatttgcccagcttttcatcactcaacatatcagtccaagtgggacaacagaagtcagttctcctgaataaaaaaggcagcaacattgcaactgtgcctttgacagttcccatataaagcttagcttagaatttatagacaaaccagaatgtactctgggaatagtactcattcttaattcatttttctagaagaatttgtgttgactagaattttaaatgaaacagaaaggggcatgttcctatttaactaaaatcacggtgtgtgtgttattacaagggctagactgtagatggaactaagtggcataacactaacaagagcaattcagtgttatgttcaggttttttacattcctgctagtattttatttcttttaagttcattatatgccactgtgtacttattttaagttcagatatattatatgacaaagttaaccaagaatattttctttcaccaaaaataagactcaaaccctctttttctgcttaacatcaatcaaatctccaaaaagttaggagaatttggaaaggagtacagaaaagagtgaatgtgtctaccaaatacttctagctttcctttttctggtcacatggtaagattgcccttagcctcccctttggtatcctacatgaacatgggatatactttgaccaattattttaagcaaaagtggtatgtgtcacttctaggtgaaagttcaggcaacctgtgacggattcattacatcatttttccctggtgaagaagcctgagttgagataaagcatcaatcatcttgggtcccaggtttactacaataagtagagcctcttgccaatccctcttgggtatgtatgaagagaacaagaaataaaatttgttatattaagccacttagattttggattactgcagaataacctagactatcttgacttacataaaattaatcaaaataataaaatattaataactgaagtcataaaaagttttatgcaaaaaagttaattttttgcagtattaaattcaaaaatgaaaaccaactaagggtttgacttaattactatctacaactgtaggaacagtgttggttgggttttttttccccctaaaaaggtgtttaccattttgcaaaaggaatatttctgttaaacaaaggaaaccagcatgaaccaatataattttgagttggaagtaagagaaaataaaggaatcttcaagtcatgaaggaagaaggtgaaaccaaggaagggtaaaggatgaagacagtgtggtctccttcctagataactgtaataaggaccatacttctatcactcctggattatttccactggcaaccgttagagaattttagactttagaataaagctgagggatcctcagagggaactgtgcattagcttacggggcctgcaaacggacaaggccagtggctaaattatgtgtacctaggtacacctttcagagaagacatatagctttattcagattctcaaaggggtctctaaccccaaataaggctaagaaccatggttatatattaaccccacttgaaatagggtattataaagcataatctcagttttctacaactgtcttggggataacaaatctgtagtcttactttcactctcaagtcaatgtaggagatggcaagaatttttacttttcccaccttaaactacctattagttttgcagagcaggaaccataacttgaattctaaccaagaaattaatcagagttaactttaagaggtttagagaaaatatcttaaaggggctgggggctctcagttttttaccctatccctaaggtccattcttgtctcccagtaaaaagattaacaacaacaaaaaggttggcttagcctcttacacagtgcttttttaggctttcagaatctaaactttccagactcagtcgttgtagggctcaggcttgttgactgctgtatgcctcaatgtccccaagctcccagagtcttcccactgactactcatggcaaaaaggaaattagagggcaggcttgtctttaaaatttctctttttttcccctccacaattctgtttgtttccattttattattaataccatataaaatagagttatacaatgaatatgtaaagaacacaaactgatgttttcaaaaacttttccaagcatgtcactcaaagacagaaagcaaggttcttaaggcatgattatgttgatcataggctagggaaagaatcagaagcacgagtttcctcccaccaacctattctcccttccctctattttatgaagaaaatagtggccttaaaatttaactgagttctgtttctggatacagtgaaattgcttatggaaaagcagcactctcaccaagaacacaaaatggtaaaaaaacaaaacagacaaaacctaatcttatgtgatgtggtgggaggggactggggtatggtaccagggacttctgggagaattgacaatgttctatttcctgatcaggatggagattacatagatgtgttcactttgcaggaattcatcaaactgtaaacctataatttggtactttatgtaggatatatttcagtaacatatttatctttaaaaaatgctaacttattttagcaggcctagtgaatacctggaaatacatcatttgtaaaatccaagcatatgtacattttctctgagaagcttaacttttagacattctactgcatgtgttcaaatttactcccactgtaattattctctcctggcagttttacataagccttagtgagagatagtctcctttggctggtaagttcatgagcaacacaatcttgcataaagtaatgcccatctgacactgcatttacctttaatatagattatggttatatactttggaaaactgcattgcatgtggtcaaatgtccatctcctcccatccctataactcatttatcagtttcatgatggcagaaaggagattttctatctatccaaaaattacaaaataaatatcctgttctaaattttaagtagacaaaattttgaaacattgcttgcaaactacacttattaatagcattacagcacgtaacaataaatcactttggaaggtaattgaatctcataagtttcaataatttataagaaaatatccagagataatagtaacacatgaaaaagaacaataggaccaacagtctacaaataaaagctagggaacacaaaaatgacacaattatcaaattcaagaatttgaatttctattcacaattgacagaatatataaaggcaactgtaaaaaccacctacaaaaaattaaaatgagaatattagaaaaaatttggtagtgatactgagtaaaggatttctgtaacttgtttaattgtactgagcagcagcagctattacattgattttactcttataaaacaatttataaattttattcttaaaaaacaaaaggacatattagtgctataaaatattaactaacctgcacaatgtgcacatgtaccctaaaacttagagtataataaaaaaaaaaaaaaaaaaaaattaaagaatctctacaaaatatgcttacttatatacctaataaatcaatgagggctaaaataaaagtgtatgtaatttaataagatgaaaaaatacattggctaggttcaggtaagaaactcttagatattttaaaatactacatttaggctattattaaaaagttaaaaaacaacagatactggcaggattgtggaggaaattgactgcttatacgctgttggtggacatgtaaattacttcagccactgtgaaaagtagtttggagatttctcaaagaacttaaaacagaggtaccattcaacctagcaatcccattactgggtatatgcccaaagaatacaaatcattccaccaaaaagacacatgcactcatatgttcatctccacactgttcacaatagcaaagacatgaaacccaccctatcagtggtggtttggataaagaaaatgtggtacaaatacaccatgaaatactatgcagccataaaaaagagcaaaatcatgtcctctgcagcaacatggatgcaactggaggccataatcctaagcaaattaatgctggaacataaaaccaaataccacacgctctcacttgtaagtgggagctaaacaccgagtacacatggacggaaacatgggaacaacagatactgcagactactagaaggggaagggagggaggagagtttgggtgggaaaactacttattggatgctatgctcactatctgggtgacagagtccatactccaaatctcagcatcatacaatatacccatgtaacaaacctgcacatgtgccccctgtatctaaaataaaagttaaaattaaaacaaaacactatacttagttgataacatttaataattaccatcatatgggaatatttacatctattttttcaggcattagtaattcttgccagagtattatctaattggaaatggtaagaatttgtatgagcacggatttgaggtttataacaacattacttttttcagatagattgtaaacatctagacttaattcagaaataagatttcagaggaaatgtagaaattatctaaaaggacaacctgtttttaagaacttctgaagtttctgtttatgtttgaaaaatggatacactaaccacaaatcattgtatcttctttttaaattgggtacagaaagatcctctatttgtcaataatttaaatatcttaattagttttctaaacgttcaaaatccttttagaaaacagttcatcaattacataccacagacactaaatctacagtttttgtgtatgtgtgcatatgttcaccaatttcaattaaaatctatgacaaaattaaagaaattatttttggttttggaagacataaaataactgaggattatggaagtctactatttaaataaatataagtattaaaaactatctatttgacttagttaactagatttctcctgagccacattcaactagaaaagtagcacttaacatataacctgctcctgtcaatgaattcttcataaaattttcaataaatcacagtataacattttagtaataagtatcttaaaatttgaggttcaatgatgtgcataactgtatgctcatagtaacctctgttattcaaaaatatctgttgcttttgggtgatacacaagaaacacgtcataaaatatgacaaaaaagcattgttaacatgacaaaagtattcagtgcacaaggcaaaggcatctactcagagttgctattgatggtttgggtcctagcttcatattacaattacctggggagtttcttaaaaatactgatgctcaggccccatgctcagagattctaaatcacttggcctagagtttccaggacttttgcatactttacaatgctccctggagagttcctaagcaccgtcatggttgggaggctcatgacataacagcttttaagtagctactgtactacatccacagtctacccttactagctatggttaaccctaaacaattccagataaataaataactagatttcagactagttacctttatctggcctcagaagaaagaaaggtgaaatcatacgtattttctattttttaatccttccaacctggataataattccaaatttcccatttacatttttgccttgagtctgcatatttcaaacagagctcatgaccaacaggaaggttgtgaaacaaatttcatgtgttgtgacaaactttaaaacaaacagaatagagatcatcacatgtatcagagatcatcacatgtagtaagagtaagcaggattttgtgaaacttttgtctcagttgaatatacatatatgtgtatgaatacatatgccgagtggtaaaataaaccgtatttttacaatagattgttgggttctcagctgattccagctgcttgtccttttctcactgtctgaaaactgatactcttcgacaatgtcatgaaaagaagtttatttagtcataagcttaatcaagacagtactgaactcataaaaaatcttctgagagaataatcatggcatatatcttgtaaattcagactacagtggggagagtatgcacattaacttataatttctatgccaagcatttttttttggctctttctccaaacattttactaatatcttacggcatacagattggtctcttggtctcccaacttacaggagacattttttggaggttgtatttttaattttttttcaatattgaaaaattttataggcatgagcatttcaataacttcattaaagaagaaattctccaagatttttgttcatgaatattatagtactccaagcttttttttttaattcaaactgttcagtaatagttttcagtttgcaaagttatcaaaaaggatagaatagtttacattagaataaatgtaacattagaataaatgcaacattattgttcatatacatggaaagtatatatttttatttgaataactatcctttcaagaagatcatattacaatgaagataatgttcccacgtactctctgaatagtctgagatttaataaaaatgccatctgccaatgtcacagattacctcccttatctatttcccactaccacccaacacccaggttctggtccaacccagaccactcaagagtgcttctgcttcccttcattcacgatgggcactgtagtcacatcatcatggcatgtggccatgttgggtcactgagattcactgagaggttaatgggtccaatatgccaggatgggaataccccatgaagccaggcattattttccaatatgacatttttcttaaattactttgtatctttccaataagtctctttttacttgatccaattaataggtttctgttcactcattcatttattgagcagttactgtgtgccagacaggtgataataaccaatagggcagtgtagttcctgcctttgtgtcatttactttattacaataaaacttgccctgattaaaacaatttatgttattctcctcccttgaaatggattttaagtcaaggccaatcggctttagtgtttgcagagtaaccaggacagcaatgaccagggcagtgtcatgcacatgaacttggtgaccacttgcacagcagaatgttcctgaaggctctttgtctctatttgcagtagaagtcctaacaaggccaaggacaaaacaatagatggcaaatattcctacactctggagttgctgcaacatctggtaggacttgcaaaggcgcagctattctgaccgttagcttataccccacatacagcctttaaaagaggtcaaagggagacaaaaaatcctagagaggatttctttttagagtcccattggcatgctaagacctaactctttattggattttaatgacagtggagggaaaggcaaatgttttctgactttgctgtatgagtcttgcttgttcaatatggcagttaaactttttaatagactggggagtaatacaatgtagtccaaaaaaaaaaaaaagttcgagtcaagaagcctagtctgcagttggtcaccccttagccatatgtcctgaatatatcattcacttctctgagactcacctgcttcatctctaaaatgggagttgaattagacccatggaacccttcaagtggaaatctccataatttctgacccctattccctgctctatgggtgcatttgggtggtggtaaggaaaggctgctccagcggtagagttttaaaatcccggaacctgcctgagtctccacacttctgtggtctcctccaacatgaagccttcatgatttgacttttcttggaaatcaagacctttggtcatttcgttgttcccatcactgtcattattgaccacagtccctttgttgaagccattcatcatctggctcttctcatttcccctataaaatttttcagtattgaaaaaaaaattaaaaatacaacctccaaaaaatgtctcctgcaagttgggagaccaatctgtatgccgtaagatattagtaaaatatttagagaaagagccaaaaaaaaatctttggcatagaaattataagttaatttgcataccttccccactgcagtctgaatcaaaaagcatggtttttctctacatcctttgtgcttacaaaacccacttcttcaggaaaaaagaaaaataataaaaaaaaatttcttttcaactctcacattttaagtacctgccttagacctaagagtaagtctctaggctagctacaacatccccttaacattcataccctctccagcttgtgaattaacaaaatgacagatattttttcatagttgaacttatttggcttattaggcttctcctattctagagcattacatattttaattccttaatacttttggaaagttgcttcaattaattaagtgatgatgtgtttgttgaaacatgctggtttaaccattgtctactggtctcttctttttaaaagaatgtaagggcaatgagaagagccacttattgtggcattgttcttttaaatactgcctttaaaatgaccttcttttacagttgtaaagtgctaaagaaaatcattttgcaatgctatttcagatattcaggcaaaatcatccctgtagtgataaaagaatatgcccttagaaattcaagatttttcataaaaaatattcaacagaagtcaaagaaataaaaggaaaaaggtgattcgcccttgttgtgtctgaaatggacccatagaagttattgtgatgccttagtaaataaggattatttttagaatggtgtacacatcattatcataacagggcaaaattttttgattcttgcttaatggtcattagcaataatggactctaaatcttcaaatcacaaatttccttcttatgctcctctctaataataaccatcatttttctatttcctacataaatctactattttacatatgaataaatatacatggtgggatgattgattttatgtgtcaatttgactgggtcactgggtgcccagatatttaattaacatcatctggggtatgtgtgtgagggtgtttttggataagagtaacatttgaactggtagactgaggaaagcggttactctcctacatttggatggccctcatccaatcagctgaaggcctgcatagaacataaaggctgaaccttccacaagtaagagaggattcctcctgcctgcctgagctgggaggttggttttttcctgcctttggacatgaactgaaacatttgctccttttgggtatcaagcctgccagctttcagactggaacttataccagcagctctcctgggtctccagcttattggctgcagatcttggaacttctcagtctctgtagctgtgggagtaaattccttaaaataaatctctttctatgtatgcatatatcatataggttctgtcctttgaagaaccctgactaataaacatagaaataaattttcaaatctattaaataagtaaatatgtatctcacatataaacttgagcccatccccctctctggaattccataaaaaataattttcatagcctttaaaatcctctacagttccaaggacctgcccagggcaaggagactgaaactttttatttttaactctttttttcttacaattttattttttaggggtgtatttttaggaggagctaccagcagaactatatcccagcattgctgatactaaggtaatgcccgtttactttcctctgttttgtgtggctcattgcaaccagggactggaggtggtggtggaggagcaggagagtaagtgggggttctggatggtaccaaaatgaccacatacaaagacagcacaacctgctaaggctgcaacctgctaaggctggatgtctggcaacagtggcctctatccacacagtgctcaggatgcaagttgctttttagggacacctttgctgctccctttacctttaaggctgagtgttacatttccagaaagaggtataccctcttcttccatattaaagctaattttaactaagtgacaaacatcactagcataaacataaaactgaataaatgcagcaaagattattatggtctctgtttgaagagacagtgtaactacaacttagcagaacacaatttattgtgacttggggaaaggcagagtatggtttttgcttgggccccacctgggcagggctgactcccagctcctctggttatgttctgcttcccaatatcatcaactactgagaatcccaactatgtaaaacatccctggggaattccactagggtctaggcttttccatgacaggcaggttcttagaaacaagtcaaaactatggtttttgaggggcttcccctccaagccaaatgttttcatctaaataccagcactaactggtgattcagtatctgatgaataatgcttatgtttttatgctcaacttgtaatggactataattgtctacagacaaccacttagcatatctttatctttgcagactggctctgtaaatgtcatatctttgtgaatacttgactcccctatcatttgagtgtctgtgcctattaagttctgtatattgaaaaattctagataatctagaccagttaaagcccccactgaaacactgtgtggagccagacctcatttccttattttccttctagaacaaacaaatgaagcaggtgcaatgatgtccgttccccttctttcatcccaccctgagtcaatggcagcagcaaacccaaagttactgcaccttcattcctgtgataccgattttaatctcactacatttaatttcactacatttctgagacaaagtaacatacatactagcaaaagctgcagactacaagttagcagcctgtagtttaagcttcaattctgacagtaactgtctggctctagtgaaaccatttagtcatttgtttcacattttctcatctgtaaaatgtaatgtgggtcaactctgaatttctctgagagttctaaaagtctacgattcaccaaccacaacttgacaaccagtaatatccaccatgatgcatgagactcaagctaataaaccaattagttaagcaatccccatggcaaaatcagatccagttttggatcacttttttaaaataattccaagaaaccccagtctcctagggaagactaggatgtaatagattctgaaggtcatagagattaaagcaaattatattgtggtactatctgcaatatctggtgggtttttataacctacctagccactagcacagtggcttttagaagacacagtaagtagttacttgttatttgactgaggaacagataaaaagatgatgactctatcatctattagtattcaggaaactatgaaatgaatatacagtgcatccagtgatttgtgcaatgtgtcagccatctgggctttattttcactgtacgccaccgttatttattaaagagtagaaatgattaacacagagacatctggccctgcttatatacccacactgcaagtttttaaaaaaagatatacccaggaaattaacattcatatttggatacaaaagtctggattgaattttgttttttagatttatgtctctaccagtaaggttttacaaaataaactctcttctcaagaatgatgctttgaagaaaggctactaccaaacttagcagttacatatttttaggtttattatataaatataaatatatataaacatatacaaatgtaaaataagttatacacaatcttactgcagaatagtttttctagaagaaatgccctgattggaaccaagaaggtaaaatctctaaatgctttcattttgcataagattagagcctacactgtcagaaaatgattaacactcagacattctcactactgtcaaaatactgcacaaagagagagaatgcaggattgccaggggcattcccagctccctgacgtcaattcagatcaaattcagataacttactatgccagctgcttgatttttccgttttgtgaaaatcctattctctttaaaatgagtttgctatctaaataccatcaaagctactttgaaatattgggaaaagggtttaagcttttttttaatgcttttcacctccctcctcatgacaacaagcttgtagagaatgatcaactccttctgattccttcaattattatcactatcatgatataaaatattttttctggactctatagtttgatgtagagtgaaagacaatctgcactctgttaaaatttatcttgtataggttcatggatatggtttggttagagactttgtaatagatgtggcacctctgggcttctgaaaagaatgtcatctaggaaaccacattatttgattccttggctccaccctcccaactcctgtcctcaccatcctgttgtcttttctctgtggcactatctaatgccacaatagacttcccatggttgctctccagaaatagaagaagcttttggatatttgaaatacataccatcttaactactcctgctctaacagcaacaaacttttcatcttagttgcaattgatgtttttctgtgccttcttgtatgaattctttacaggttaataataacatacaacacttataaaatacttcccatgtgccctattgcatgctttatacatgttttatttcagttaactatcacaatacatttattaaatagacattattattatccccattttacaggtgaagaaatgtagacccatagctgttaaatgactcgccaatgtcatacaacatgcaaggagtggagctgaggtttaaagatgtactcaggttaatatgttcttaaccaccagtgtacattacttccctttctgagcatacaaagtacataggagacatggcctatggagcgttaatgcattaaatatacaatgccctgttaaagtgactgaaaaatactaggtttttattaagcatttattgtaggtcaatacttgacatgcttgtattattgtgggaagtaaaatgaaaatcataaaatgttttctccctgcatcaagaacttaactttaagaatacaattttattttgcaaaaatagttaataggccttcttgttttagtttccagcctaagagttgtctatcaggaatgcatagaagtagaagataataggaatcatatgtccatcatttaaatatgtaagatcatctttttaacacctgtgatctaaactgaaacaagcaaacaaaatcctagtcagtatggagatgggggagaaacaaatttctagattgaaaacagaaggcaaaggagcgtctaagaagagatgtaacaatgatgctttttcaggataagaaatgcttcatgagaaggtatttcaagcatcctgggaaaggtgagcgaaacttctactgggagtgaaaggcaggggaggaatttcaagttgataggacattaactgcagagaaatagaaatagctaaagaaataagcatttgaggtttttttcgtgttcagttaagaggaaataagtaggtaaaacttgaaaatactgactgaaagccaagaaccagactcacagcacaagggacttgctgagtgaccttggacaagctacttaaattcagcttcctcatgggtcagacgatgctatcagccctatcattttcctagttagttattagtctatttgattaaatgcacagtggttccagaaagcatttaaggcagtttataaaaatacataaactaagatagcactaataaaaagtaatcaggaaggagagcaacacaaaaaacatgccggaaaggaggctaaaacaaaaaggcacatcatgaagacttagtccctggctatgaatttgactctgagtttcaaagcaacctctgaattagtgaaatctggtgagttacagacgttaggaggagaaatagctcccttctagcactgaaagcatccagtgagatcccgcatgtaacaaatgcttatttccttctcattcctcttttccatgaaatggcaggaagtgccagatccctttagagagctaccacaagtgactgtctgccatagtatttcttccctgccttcccctctgcacatcagacacacagtgtgtacacagagacacagagacaccacactcacaccccacactgcagggagcattccagagctgactactaaggcttggggtctaggtgctccctagttccctcagttttcaccccggtcactatttacccgtggagacagacatcccagataaatcttctgacatcatcaagagccaaaaaaaaaaaaaaaaaaaaaatgtgtaactgttgaagcaatgtaaaatataatgaattttaaagtgttgccatttctaaggcctgtaggccactcaggctgtagcttcgtttccttttttatctcacattttcatgctttaccagtgccaaacaatttgagctattcagctgaagcaagccgagaaagaaatagaggagagatgtgcatcttgtaagatttggaatacagctatttaatctatcagaaattagtttggagtagataagctgtttaaatacgcatttgaaataccattaatagggacacttctctttttctctttgctctgtattgtggttcttttaataaaattggcaatggtgatatcagtgtgtgcatagctgtgcacactgtgcttagcaaacagttacttaaagccaggatattcatttttatgaaaaagaactagatatatattcaatagaacaataaacctttcaaaaaatataaccactagagataatcttctttttttttttttgagggggggatcttcagagagctttccaagtacagttggaatatttcacaatttcaggagacttgtatgcatctaaatacaaaaattgaatgtattttcatggtaaaatattgttggatgtattaggattggcggtttagctggtaagtaaaattttagggagagtgggagcaaggcagacgcataaaacatctgtgctttccaactgagatgagtcaaataaggagaaaaatgacaaagttctgtggtaaatgagctttgaagtgttctccagttcaagccaatttttaaattttaatattaataaggattgttggccaggcgtgacggctcatgcctgtaatcccagcactttgggaggctgaggagggcggatcacgcggtcaagagatagagaccatcctggacaatatggtgaaaccccatctctactaaaaatacaaaaattagctgagtgtggtagtactcaggaggctgaggcaggagaatcgcttgaaccctggaggcagaggttgcagtgagccaagatcacaccactgcactctagcctggcgacagagtgagactccatctcaaaaaaaaaaaacaaaaaaaacaaaaaaaaacattgttgctgtggtccctctgtaatactgctctcttcctgaggcttctacttgcttgagctcttttgtttcttacaaaagcacaagcatctagaagacagtaattagtttctttcttgatatatcagaattattccctaattaaatgagatttaaggtgataaatggaattactttgtcttttagacctccatatttctctggagaattaccttacaaggtttaaaatatgtatattaaggaagcccacttggaaaatacagaattgtttggctatttaaatgaaagcagatacatggtgtttcagtattcttattgtctttatggcttcaatgctctcaacatttgaattaataagatttggggtgccttagctgcatggaagaatccttatttgtttccttgtgcccacattaaaaagaactcaaaatgactcattaaggaaaaaagaaacttgcaatgaaagaactgttgtgtgggtgagtcccaagggagacttgacaatatcatgcaattttcagttttctccctatttctttatattttaataacctaccagttttctatagagcacatctttctccatgccgttgttttcttacacatatagtaatgataatagttatctaagatttcaactttaaaaaagcatgtgtttaataagatctctggtattcctctagagatagtaaaattataatatcagcactgccttaataacaacattttaattgtttattacttccagtatagtaaaaatatcatttcgcaaatatttgcttagctctttggactctctcatatggctacaaagatgagatacccttacaattatctcattttacaaactgattttctttttctttcttctaaagcaactgtggagtaagtatcctcttaaaataaatttcatatgctaagtgattttctaaaaagtaggtggttgaacttaaacaaaaatattttaaaatatttaatatattggctgtttctcaaccctaccactgcatgcaaaatagcttttcttttcaggtgaccatagcaaataagtactaagtagcttctttatactaattgctcagtcaaatgctttcatatgctttcatcaaatgcttttatctcattttttaagagtcttatgagataaatattatgatctccactttgaagatgaagctggagacataaataacagctatagaaaagaaagaaaaccaactaaaaacagtttctgaacttaaaaataatccatgcaggtaattcatgttcatacacataatgtaaaccacttagaaatgtagtatttctttatatgttacatgcctcatttgtcatctttgtgcatcccttcagacatctgcatttgtgtactgcaatgactaataatagtaaattaaagtaaaataaactattataaccaaatttatcttgttcctttgatgtggtacagaaaataattaaacaggtaaagatataatacatttttatgtgccagaatcaattggcaactgacgtggtaccacgaaagtaaaaggctcatttctcccactatagagaaactctaggcaatgtatctctatccagattaagtcttcagggagtacagaggaagtatacatagtggagggaaagaacatgagttccacgatccacgtatagacgatcaaatcttagccctacttactagcagagtgagattggccaagattatttctctctgaacctacctttcctcagcttgaacacatatggcctaacatatatttcaagcatatctgcaatatttatatttaaaatgatatgaagcaaactttacctataatgacattagttactcttgggagatgattatgtatgtgattttatattgccctgtgcacttttctctatgtttaaaacatctcattattctttttaaaaagaataaaatgagtaagtaaataacataaagttgataatagctacttccaggggagggttcagataaactgaaatcagataccatatataaagcagatactgcaaagtaggtaactctcaatttttagctcccttctttcttgttttcttggcaatgcaccattaccttctacctcatcaatttcattcatgagattgagcagtgactttccagtaaagcaagttatcatatttgatgtcagtggtgattgatacaatgctaattaagtagctacatcacaggaaaaccacataacattgaaagcatatttcatttaaacattttggaaagctttctctgtagtctcattgtgaatagtaactgatgccttggttatgcaaaattcaagtattttcctcagtatttctccagaaagatgatataaaaattcaccatactttcaatgtcactatttaactatatgtatattcacacagattcaaaagaatcatgaataccttatttcttacttaatctaactatctaataacaataaatgttatagttaaatataatgtataagatatagaaattgctctttatcgctatactcttcctggtgagatagcagggataatggataaattttaggttgcccaggcaagaagcagataggagaaataagaaaaagctgtagctttatttactaaagttaggatgttttgctcaaatatgcaacccagatacccattcaggattgaggcattcattcccccagcagctgggagtcttctcagctaagtctctctcctggaattgcctttatccaaagagagagaaatctactgcacacaggtgttgatcttaagagaaccccacccccaaacaaatttcttgggcctaaatctctgcctccaagtctgttttctagagaatctggcttacggcatgttgcatcacctctttcttccttgaatgcccatgaaaaccttgaatacaagtatccatgatcctgaacatggtttggttttctaaaaaaatttactgggactatcccatctgtacattcactgacaataaatgatgtagaacattcactagagaatttattcaagattacctacttatattaatccagaaataatataagaaatgctgtctgattagggagagtgaggttgctcacacttggcacctgacccaatttctacaacattttacttgtgccagtacagacctatgttgttctttttgaagagttaagtgtatatacataggaacattgctcatttctatttactcagaaaatctaattttcctccaatgcactaaaaacaaacaggaggcccagtgagattaaaccctcaaattagtgtgagaatacctggtttcttttttactgccctcaactgaatttctcatcacctggagctaattttccagggtacatgtgctgtggaaataataccagggaagtttattagtgtagggaactgataggtctattatatgtttaggctgtgtccccacccaaatctcatcttggattgtagctcccacaattcccatgtgtcctgggaggcaatcgaattatggggtgggtctttctcgtgctgttctcatgatagtgaataagtctcacaagatctgatggttttataaagaggagttcccctgcacaagctctctctttttgcctgccaccatccatataagacgcgacttgctcctccttgccttttgccatgattgtgaggtctccccagccatgtggaactgagtcccttaaacctctttttcttcctagtgtcaagggtgtctttatcagcagtgtgaaaatggactaatatgatctatatggtcaattcagtgagaggtgtccattggctaaaattgtttatatacttttaaaggcttaaaaaaattaattgtcagattggtaccaaactctgagtttttttattgcaatattttaggcattttggcaaaatatacactggggacccagaaaaaagactattctaaaaagaatgaaaacctcttattttgcaggtggccaaaatcctttgttaagattcaaaaatccgtgtactaaagcagttcataacacatctctgcagaaacatgatcagatacagcttctcaatgtatatacgtaaatgccttgcaataaggcaaaatggttaagaatgtcattttaaaaaagcatgttctaaacactggaatcgagtttactatttggtaaacagttcaatatactgtaataaactagctcacaatgaaccaacaaattaatgtaaagttgttaaagcacagtaagttctcatttttcccatctactctgtttctcaagttaaactgcctattaaataaccagaatctcatccagttatattcataaatacaagttaaatacatttttctctaacaaccagcaactcagttttagagaccaaatgataggtgtcctggtgatttaaatacataattacaatgttttaatgtataggtaaattactaagatcagaaactgaatgaataacgagagagatgtggcaggatattttaagatccatcataataggtaggaagagtgattctatttatttgtgaaaatgcattactgtttaagttcgattcatgaagctatacaaaccccaaatgtcacagcattatgggaaaaggtggaacatacgtctgagcataaaacagtgatctaatcacatctgaccacattacgaaatagtttttttccaagttataataaggattgcttcaaaaaataaatggcttactataaatgcatgataataagataaaaacaaaatgagctttggaaacttggctttgaccctagtaaccccaattaaaattagagaaatacttcctttgacagtttatgctgtgatatcaaaaatacaatgcaactcagggagacagaatgtaatgctttgggtgttgctacctggtgagttcagaccactggcaggaaggaaaatgtcatctaagctgctgaaattgtttgtactccacttgtgaatttgcaatgtgtcagatatgtaataaaggcactttctagaagtcgtatagccattaaacttcctaggcattgccatgttagtataatgatggattgcaggtctcaaaaataaatactagcaagactagaattaggatacaaattcagctcctgaacatctgttagggaaagtcagtgtcctaatttgacatgaaaattagatctgtcaacctaagcaaacaaaacaaaacaaaacaaacaaacaaacaaaaaacacctagaaatttattttctggtctacatcagttctcacaaaagtgagacatcaggagaaagttgaactgttagtcataactttcatttattttatatgcccaaacttttgcaaaaattttccttgtgattttaattaattattgcaaagaaatgttactaaggttgcacagtcttttaaactactattaactatccctaatctttctctttcaaaaaaccaagaaaattctaaatgtctagcaatagacctgaggcacttgcattaagactttgaaacaatcccaccagcaacgtaccttccccgtaaacatgcccctcaaaataatactcagtgattggtgcggactacaagctgagcccaaaccttattcctcacttggagtgttggaataaatggatgtgttctatacatttctaagaaaaaaagcaagaaaagaaaaagctagtttttaacacaggctcctgtattcaaatccccttcaagttaccccctacaattcccacctaaggctgttattttcatcaatatgctctttctaccttatccagcccagtttggccttgacttccccaccagtttcctccctaggaatcttccttgagtcttgtcctgcctttatgatattgtaagcaaactcacaaatatccttgatcacttctggatataacttgctcagctccttgaccacactgaagtcgggctttctcctgatggcacactcttccaaaatgtttactatcagaagtagtctccccacttgcatgcttctcttagtccattagctcacgtctgctcttcaacaaggttttttctttgcaagtccatcatatctacttactccattctctttgtgtctctcatttattaccccctggccctgtttctaagtttcttagtgaaattatcatcaaatttcaacaagcctcatcatcaatcctcaatctccatgtctccattccattttcatccttcataaatagagacatgaaagggatcaagatggctgagcagaagcaggtagtgtgtggctccccaacagagaaacgccagaatagtaagtggacaccttctgagcagatagtctaggagagaatgcttggatgcgatagagaagagacataaagcattagaagactgcaggggcaggagagttcccgaagccaggtttcttctgggtggcaagacatgcagctaggggcagctttgagacctggaaccagtctgcgtgtgttgctacgaaatgagaaaggttcccttgtcccccttgcaaggtgtgcaactggagaagtggctcgcttcttcagtgccctgctgctcgtacctctaggggagcatgcaggttgtgggggtcgatcccacggcagcatctaggggtggatgtttacagctcccaaagccccagtgggcatgtgctaccatgggctctttcagttttgccgtctataggcagcttgtgttaaccagctcaattagaccctccaccttatcacaaggacgagggctttctgtatcccgggttcttgccttggcgtgagggaagaattgaatcacacctgggcttggagaatgagtacaaggttttactgagtggaagtagctatcagcagatgggggagccagaagggagatggtttccccctggagtccagccgctcagcagcccgggctctcctatgactgccacgaccaaactccgcgtcattcctctgctggacggcctgccaggtggcagcatctgttggtgtgctcttccaccagcgtgctcccctcgatgtcctctccactttcagctgcttgtgtctctacccgctagggtcttggggtttttataggcacaggatggtagggggcatggtaggctaggttggtcttgggaaatgcaacatttgggcccaaaggctggagtgcctgtcctcacctaggtccgtgggcacaggcctgggggtggagccctcgccagggactcacccttctttacccagcacttcccagcatcccttacatatcaactactgggttccccagtcggcttccttgttcagttgggggacagtaacccaccagctctgaaaagtggtaagggaagggacccactcccctagaaatctagccctcggttcagtcggcccctaagggagggggatgtagccggctaaagcccctcttgggtcaaaggttgggtcaaaggaaacaggagcactgcgctagccactgaagggggcgccaccaaagccagggaatggttgtcgagaaggggtcatcgctcacctctctcatccctcttcagtgtactgttgcggactcgaaggtggctctccccagcggaaccgagagagtgtgggctgaaagagaccacttttggggcttctccagcaattccactcccactgaaggcaaacgcgctgaaggagggcactttgcagacttttccattgcttctgcccttgcccctaccttctggcgctcactcttaagtgccacctactgggctgcagcctgaattacactacaaaacaaaattacatcactacaagaagcaacgtctcagccaccgcacaaacttatctgcaaccaaggaacccatacagagccttggcgccctgaaagcactcagaaatgaagctgatccacccatacacattttacaccacagtcatacccacaagggaaaaaagaatttaaaatcaacaagctccatccaaacaatagcaaattcaaaaaagaaaagaaaaaagcatcagctctctcagatgagaaggaaccagcacaagaactctggcaatacaaaatgtcagagtgttttaccacctccagagaatctcactagctcccaagcaatgaaccctaaccagaatgaaatgtctgaaatgacagatatagaattcagaatctagatggcaaagaaactcaatgagatccaagagaaagttgaaatccaacacaaagaagccagaaaaatgatccaagatttgaaagacaacatagctatattaagaaagaaccaaacacaacttctggaattgaaaaattaactatgggaatttcaaaatacagttggaagccttaacaacagactataccaagcagaagaatgaatttcagggctcgaagactagctttctgaatcaacccaggcaggcaaaaataaagaaaaaaataattttaaacaattaataaaaccttcaataaatatggggttatgtaaagtgacattggcatttctgagataagagaaactaagcaacttggaacacatatttgaggatataattcagggaaatttcctcaatcttgccagagaagtcaacatgcacatacaagaaatccagagaattcctggaagaatactatataatatgaccatcttcaaggcacacaatcatcagactatccaaggtcaacgtgaaagaaaaaaacttaacggcagctagagaaaacagtcatatcatctataaagggaaacccatcagactaacagcaggcttctcagcagaaaccatacaagccagaagagattgggggactatttttagcatttttaaagaaaaaaaatgccaaccaataatttcatatcccaccaactatacttcataaatgaaagagaaataaattctttctcagataagcaattgctaaaagaatccatcaccaccacactagacctacaagagatacttaagagagttctaaacatgaaaacaaaaggaaaggatgatccttgttaccatgaaagcacatgcaagcagatagcccacaggccctaagcagtgactgaatcaatactacaaagcaaccagataataacactatggcaagaataaaacctcacatatcaatattaacttttgcatagtcaaaattaatattgatatgtgaggttttattcttgccatagtgttttaacataaaatattaactttggccatgcaaagttaatattgatatgtaaggttttattcctgtcatagtgttttaacactccatttaaaaggcaaaaagtggcaaattagactaaaaacaagtctaacttcaagatacccatttcacttgtaatggcacccataggctaggctgcaagtaaatggatagagaaagatctatcatgcaaataggaaacaaaaaaagaacaaggatcactattctaatatcagaaaaaatagacattaaacaacaacagtaaaaaaggaccaagaaaggcattacataatgataaagtgttcaattcaataagaagacttaactatcctaaatatatatatgttcaacattggaggatacatatttataaaataattgcttatagacctatgaaaagactttcatggccacccaataatagtggggaacttcagcacacgagtgaaagcaatagacaggcaaaaaactaacaaaaaattttgtatttaataaatttgatagttggccaattggacctaatagacatctatagaatactccacccaacaactacagaatatgcattcttctcatctgcacatgatatatattccaagattgaacacatagtcataaagcaagtcttaatacatttcaaaaaatcagaatcataccaagcatcttctcagaccacagtggaaaaaaaacagaaatcaacagcaagaggaattcttaaaaccacacaaatacaggaaactaatcaacttgtttctgaatgactctaaaataaacaaaaaattaaggcagaagtcaaactgttatttgaaacaaacaaaaatagagatacaacataccaaaacctctagagtacagcaatggcagcgttaagaggaaagtttctagcactgaatgtctacatcaagaagatacatctgaaattaacaacctaaaatcgcacctaaaaaaaaaaaaaaaacagaaaaacaagaacaaaactaaacctagagctagcagaaaaaaaagaaataactaaaatcagaacagaattaaatgaaattgagacccataacaactatacaaaggatatacaaaatgagaagtttgttcttggaaaggataaaaaaagattgatatactgctagctagattaacaagaaaagagagaagatctgaatatgcacaatcagaaatgacaaaagtgacatcacaaccaatcccatagaaacataaaagatcctcagagactactatgtacatctctatgcacaaaaactagaaaacctagaggagatgcataaatttctggacacacacaacctcccaagattaaaccaggaagaaactgaaatcctgaacagaccaataacaagtaatgaaattgaatcagtaataaaaaacctaatgtccaaaaatagccctgaaccaaatggattcacagctgaattctaccagacatacaaataagagctgatacagatactactgaaagtattcaaaaaaaaaaaaaaatcaaggaggaggaactcctaattcaaaaccagtatctttctgataccaaaatctggcaaagacacaacaacaaaaaccctacatgccaatatctctctgatgaacagatgcaaaagtcctccacaaaatattagcaaaccacactcaaccaatgagatactatctcacaccactcagaatggctagtatattaaaaaaatcaaaaagtaacagatgttggtgagactgtggagaaaagggaacgcttgcacactgttggcaggaatgcaaattagttcagccactgtggaaaacagtttggagatttctcaagaactaataatagaaccaccatttgaccctgcaatctcactgctgagtgtatacccaaaggaaaataaaccattctaccaaaaagacacctgcacttatatgtgaatcacagcactattcacaagagcaatgacatggaatcaacccatatgcccaccaatggtgggctggataaagaaaatgtgctacatatataccaggaaatactatacagccataaaaagatgaaatcatgttccttgcagcaacatggatggaactggaggccattattctcagtgaattgaaacagaaacagaaaaccaaataccacatgttcttacttataagtgggagctaaacactggaggcaacacggacacaaatatggaaacactgaacaactgaggattccaaaagggtgggaggagggaggtgagcaagtgttgaaaaactccctatggtcctatgtcactacgtgggcagtgggatcattacaagcccaaacctcagcttcacgcaatttacccatgtaacaagcctgcacgtgtactccctgaatctaaaataaaaataaaataagaaaatacaataaagagatccctctactaccctcacaggactggccattgtatcatttcttttggtacagttcataaactctaaccctttatttcttctttttttctccccttctgatcttctctctttccacattttcactttcagtgctgtatccctttctcatttttccatattatagcctcacctgctagaccaactaatttttttcttatttaaattccaaaattgaattttctaatcagattcacattatcacttttgaatctcttatacttggtcttcagaagtcctgaatgtgaaatccaaaccctctctccattcattgtattctttttaacaataacaaaattatatctttgaatacttgttagagatatattcctcagtcagtctgccttccgattttcattacaatttatcatgtagtcatttcttagtttttagttgttgtgtagcctaatctgtcagctgttttctcccaataaaacaattcaagagcatatcctttatctgtgctgggatatggagattacataatacatttggggttcagatttgtttacttcaacaaatattaagcatgactacactaggtagagtagatatattaaagaacagctcctgaccttaaggagcttgcaacttttggagaaaaacaaagacatgcacaaataatttggatattacacagcaaatacagcgacagacatgtatcagcatatgagagcacagaggaatgtattaaatacatcttggaaggcaggaaaatgaggaaatgcatccagaggcagaagaaagaggcagctggggaggaaagaggaaaatagactttccagacagaaaaaacccagcagttgtgtacaataatatgatgaagatctaaactagtgtagtcaattgataaaaaggaaaaagcttaaaaaatattcagaatataaaatcagcacagtatggtgatggtgactgattggagacactacctaactacactggggaaagactggcacagcaagagaacagggaagcgatgtgcattcatattgataggctgaggctgagctgctaattggaatgtcaagtggaatagatagtagaatgtctaaatttaatgggtaaatttatggatgaagataaaacctgaagatgcatgagaatgtttatgatagctaacattttgctcttgcttgcagtttccccaggaatttttacagtgcctttggagactcagagaaactgtcttgttctattaattcctttgcctcctttcactagtgttctccactaaattataatctccctaaagattcatgccatggtttctttacctttatatccctcctgtctcctagcatagtgcattactcttagaagagagtaagcactcagtaaagtttattattgaaaggtcctcaatagcatgaacatataactaataggtagattaaacttatgtggaacacctgtggtcaacaaaatacctatatgcagatgttccattaacagataagtctttctgagatgattaaagcaaagagaaagaggtctgacatttatgacatgactttcagatttaaagcactcaaatagttgtttaaaagaacagatctctgtttaattacctccaaccaatggaggtattagatcacattcagaaagctttaaacatggtgtctgagcaataggaatttcttccatattcttctacccaattaaaacttggggtgaatactgaaaagatggagatatatctaatgaaacataaatttaaaaaaagacattttattcactttgggacaagatcaaaaagacttagataattattttaattcaattaggaaaattgaaagcaccattattttccactcagataatttctttattccttaaggtagtgtgtgtgtgtgtgtgtgtgtgtgtgtgtgtgtgtgtgtgtgtgtgtagtttgttttatctctttttttgtaaaactctccttagggaatattgcaagaattgtttttcttgatataaaaattaaagcatggagaaattccagtgaaaaggaaaggacaaactaacatctgattccacactatttctaattctcaatcacaatatcttgataggatagaggtgttttgtaggagattagaaggctttttttttttttttgctgaaattgcttttacttgatttcttttgaagagttgatctcaatttttaaaattgtcatttaaatgctaagttctgtattaggagaaaataatctagaagaatctaaagacaagtgtatagccttaggtaaagcatcagaaagcataatttaaagagggcttgctgtggaagacccttcaattcagtattattcagagtagcaaaaaaggttaggctacaatattcctgagtgttaatttcatgctctggagctcttaggtaattttacagagtatggcaaagtgataaaagttcaggaggtccatcatctataactacttctgtagaaatataggggaaactgtaattacatcctcagaaacttatgctttcaagtaaaaggcaaataaaattagtaaaataacttcatgcaactcatggctatccagaggcagctttattcaatggaagtgctctcactgctggttcacagcaaaggttcccatgacaaccaagaatacacagtacagtggtgatgctgtttgcccagggatatcctgtcattaatataaataagtagataacgatatctagtctataggtattatgatccacagctgtctataaatgacaactgcagagtagaatggaatgctcagaactgagtttattccaagttcaattaaagttttatttccttactttctaaaaacatcaaagtatatgcttctaaattattctactgtgtttcactataattttcaagtttggtttcatcctggattatgacctttcagtgagctgggacagtaatgtggccccaggtatggtgagtaagcccacctgaaatagaaggtggtttactttcttgatatgaacaaaggctattttggagttggaactctccagaacagttaaaatgcatttatatctaaaggttcttaggtgtaaaggaacatacatatgattttaagcatatttctctactagaagtcttataatatttcttatctgttattctgtattcccatgtttcctgaaatactgtgaacttattaagacaagaacaaaatgtcatttacttttatatattgggtctaggatgagttggtttcttttatatattggggtctaggattacttgatttcttttgaagaatccttgtagaatgaaccaaaagataacagataaaaatatgcaatcaataaatgtaatagcatgtgctaaatgtcatgtgtaccagaattaacacttggcctatgagagatacagagtaatatagggcccatttgaatcctaacactgatttgtcatcctgtttatttaagaaagttacatactatagtatttcataatatagttgaacaaagtatctgttatatacatatgcacattaagccacaattcattttgcatttgtaagaaattcaatattattttgagtaatttgaaggaaacacaattcttacaatttgcataactgaggttcaaaaggaaagtccaccatctcaacccagttaaatttggctaactagtatgtaccaatcaatataaacacgtgctttaaaaaagttaccctagttctcattcctaggaaacatcagctgtgtagcaccgggattcatttctgttctcatacaatttaatttctgtaataaaaaatctatgtccattttttgatgtgtcattgctgatagctttaaagtgttatacctctctcttcccctctgtcctacatttgggaaaactgttaagaaagcccatgtgttctctcctttggtgatggtgggaaattcaaaccacaccagagtccacccacacaaaactctcagcatggcctcacccactaaaagtcataaaatctcaaaccagtcattttccccctgctctctcaagctacttcagaccttcttgggaggcctgctctgctctccccagaaaaacctcataattttataagtaatacatactttcatactttcttggtaggggtatatgtgtgtgtgtgtgtgtgtgtgtgtgtgtgtgtgtgtgcgtgcgcgtgtgtttgtgtatgtgtgtgtgtgaaagtgagagagagagaagtgtagggctgctcattagtcttaacatttgaaccatattttgggtggaggcttatctgaatccacacaatggatacaacagtttcatcttctagatcttggctatttggttctcctcttctgctcctttctttgggagggaagtaaaaagctaaaatatgcattcccaggttatgcatagaagctaacctaagggaactgcagctttaatacagcaaaaagaacccagaggagagtacagaactgatgttattattagcagaagttgaaaacattcacctgcctaattctgagttggctctggcatcaacagtctttctagaatttgttcaaacagcattattagcagagggtgctgagaagagcagattaccagattactctttttatgcctacattagattggcctcttgcagtgcatcaatataagggtatgtggtatcatttccaagatgaatgttaaggaaattcacacggacaggggaaagcaggttttctacacttaaatagcacattctcaagagggaaaatgtcaacgtatggcttattcatagcacaatagctgtttaaactacagcttagaatctactatgtgccaagcactgtgctaagcattttacattttgcatatatcattattagtgccattttactattggaaaccaaaaacagatccagcagttgtcagagatagaatttcaactcagacttacctcatattcaatgtctatattctaatgaactcattctaagacttcagatttacgttgttaagactatgaagctttttgcttcctgataatctctgaatgtctaataggcctttatagctggcaagcttaggaaagaagcacatttttttttctgctggaatgtagggagatatctgtcatagctcatagatgaaatatataaaaacactacatggtatccattattcatttcagctccattgccctaaagaaacataacaccatgaatttagatgtagcaagacaatggaataaatgcttttaattttttttcaataattatgtcaaaatagatattctgggaaccgtgagaaagtagaaagtgtagaagtcatgttgttgacttcaacatgcttacaatatacctaacatatggctcagtagtttgtctagttgttaataatttgaaacattgatttgctaaattaatataaatggtttcacattacaagtaaggtaagtattttaaaatactaacttttcaagacttcattttttagaggagtgagattcacagtgaaattatgaaggtatacagatttcccatatgtaacatactagttttcaagcattaattttaataattcttatatcctgagttagcatttaaatttattttatacccttagtctttggcaaaaaaaatgcttctgcttaaaatagcttattggctaagaatccatcattttaaagaaaattatgcataatcaacaggtatatagtttaaatagaaaacagcagggggagctcaaagacaggttggacaaattaaaagttgacttcaagagtactgaaaaattattttaataaaaatttgaagagaagaaggaatatactgttaaattatgagatgatattttatacaataatttccagcaaaatagctagctaaatggaggaatagtttcccatacagaacacttcaaaagtccagaaaaaaaaattaatgcacagaatcactagacatcagtgaagtgaaaattaaaattacaatgaaataacactacatattactcaactagaatggttaaaatgaaaaagataatacgaagtgttgacaagaatgtggagctcttagaaaatagagaatattggttggaatctaaattgaagaagctacttgagaaaactgtctgtcagtcttcaaaaaatgcatgcctcataatcaagcaattccacttctggctatatacccatcagaaatatatatgcattatacaaaaagatgtatacagtaatgttcatagcagcatgatttgtaatagtttcaaataaaaataaaacaaatatttaccaataataaaatgggccaggcacagtggctcacacctgtaatcccagcactttggcagactgaggcaggtggatcatttgagatgaggagttcgtgaccagcccggccaaaatggcaaaaccccatctctactaaaaatacaaaaattagccgtgtgtagtggcaggtgcctgtagacccaactacttaggaggctgaggcaggagaattgcttgaaccctggaggcagaggctgcagtgagacgagttcgtgccactgcactccagcctgggcaaagcagtggaactctttctcaaacaaaacaaaacaaaacaaaacaaaacaataaaatgaataaataatttataacatatttgtatgaagatgaaaatgaactacaactacatatataaagacaaatgttcctttaggcccaggagtttgagtctagcctgggcaacaaagcgagacccagtctatacaaaaaaataaaataaaattagccaggtgtggtgtcatatgtctgtagtcctagctacttgggaggctgaggcaggaggactgcttgagcccaggagtttgaggctgcaatgagttatgactatggtactgtactacagcctgggtgacagagcaataccctgtctcaaaaaaaaaaaaaaaaaaagaaaagaaaagaaaaaagaaagataacttttccaaatacagtgttgaggaaaagaagctagagaacaaagaacacactctctttggtaaataatatgaatattatcttagaaatcacaatagtagttactctggggtgggggcagaatctgaaaggtacacaaatgggggcttctacagcttagcaatatactgcctattaatctaattgctgcttacatgggtatgttatcttcatggaaatttaccacattttacatttaggtttgtgtgctttttcctcttatggtataattcaacaaaatttgctctaaaattatactggatgattgctttaaatcattaaattaaaagtttttgaggcttgaaattaagaaagcttggtcccacagggataactaagtactagaattgttttttgctttgtttgtttttttgtttttttcctgaaggcatttaccaattctttgggttccagggcaagaatctaaacaaggggcctaaacagagaaagaactcacattcagacttcacagaaagtcttatacccaaaagtcaatacctataactaggcatgctacaatctttcatgcagaacaagacttgtcttggtttcaggcagcatatttaaaacaaatatttctttcaaaaatttctaatcacaagtgtatacttgcgatatgtaatatggcattggatatttgcgtggcccaaaagttgaacatttcatttaaagtaaatctatagttagcagacatgcagttacttaaattataagcaaatcctctttcgaaaaatacactttcaacacagataatttccagagataaaatactaaagagtatgagctcacatatgtaaaaaaatatagaaaatgcataaaaaaaataaacttgcctgagagacaatcagtggaataaactgcacaggtagaccaacaagattacagatattggaactatcaaggaactaaaataaaaaaaaatatttaagctgtttaaagaaatgataaaaaatttagtaaatgagcaaaagacaataaaaatcaacacacatatttagaataaagaccaatagaacttctaaaattgaatgtctaataactgaaattagaaactcaacaaacaggtgaaacaacaaattagactctactgaaggttgaattagtgagccagaaaacatatatgaatgaaacattcagaatgcagtagaaaaagaagtggaaaatatgaaagcaaggttaagataggtgaatgacagagtggggccaacataagtcttactagggttgggatagattaaaaggaatggcaacgaggcaatatttgaaacaataatagctaagaattttccaaaataaataaaagacaccaacactcatatttaggaataccaatacattttaagtaaacttttgaaaaactcaacttctggattcattagagtgaaattgcacaacaacaaagataaaaataagaatttcaaagcacccaaaaagaaaaaagtaacactggtcagactgaaaagtgatttctcaaaagacaaggtagtatcgtatttaaagaggtgaagagaagtagttgtcaacccagtaatgcatacacaacaaaactaccttccaagtctaagcacaaaataagatagtaagaaaaccacacatgaagagaattccctactattggagagtcactagagaaacttctaaaagacatttttaaataaaaaggatggtctcagatgcaaaaaaaaaaaaaatgctgagcaaagaaaatggaaaatgtgttagaaaatgttcaccaaagatgacttactacaactataataataatgataatgtctacaatgtaatacaaatatgaagagaacaaaaatctattcttttgtattttctcaggaggacagtaaaagggtaaagatattatttaacttcagccttaagttacatatttggaaaattttttagggttattattaaaataatagaattagagtttaaaacttacaaactagaaggaaaaatacaatgagaaaagggaggaaatcactttgatctaaaataatgccagaaaagacgtgaaaagaaaacaaacattagaaagcaggataaataggaagcctaaattaatatttttgaatattataattatattataaactttataattttatattaagttataaatatataaaatataggtttatattataaactttataaattatataaacttatatataattatacttttgaatataattatattttttgaatattataattataattaatccagtgttcatgaattaactaatattttcagtttagtttcaacaatgtcaaagaataggtactatacaaatatctcttctgttaaagatgaacaaaattagaaattaataacaatgtatttatttaaaaactcattcctttggaaaacatttaaaaagtacttctaaataacacttgagtgagagaagaaatcaaagggatttataaaatacttaaaacttaataataaatatattatgcatcaaatatatgggattgtcactaaagcaatagaattaaatcactgtattagaaataaaggctaaaactcaatgcacaaagcaacttacttagaaaaaataggaaaataaacacaaaaaagtaaaggaaaataataattataaaaacaaatactaataagagaaaatacagtaatagaaattcaaaaacaaacatgaatatactaattaagtagtctggcaatttgacacaaacgagatacagaaatagaggaaaagagaaaacagcaacaaaaaaattttaaagagaaaagagaagaatgggcatagtataagagacagaggtagagttccagataggtaggtaggtagctagctagttaggtagacagaaacaaaggtagagaacatcttagtagagatagacagacatagataaaaaatagtaaaaatttaaaggaggcatgacttacctggaaaaatatagagacagaagatgtaaatgaaagaactatttcccaggtatatggaaacagcaggaaaatgtaatgcatcttggagaaatcataagggtctgagtgaaaactctttagttaagtgaagcaaaaggagcaccagtgaaaagtggtggcactagtgattccagcagataggcaaggagatctgaaaatataatttctcctacttaaaccgttttttaaaattctttctgtttcactgtaaaacttaaatccaagtaccggtgatcgtaagatttaattagagaaaaatagaatttgactcatttgtgatgcaagacaaaataaaataagattaataagtaagttatcaagcaggtcttactcaaatagcatctttttggttacaaaatgacaggggacacaaatatgattgtagaatttgacctagtaatcccagttcttaaagattattttagtaaaataaaagcagtttaatttaaaagataaggaaaacttctaaggatgtttctagagccatcatttctaatagtaacaaatgagaaaagaagcttgaacatcaaaaaatacaaaaagtttcgattaagtcagaatattatgtagtaatcaaaatgatacatgagaagactgtgtcagaagaaagagcaatatttaaggaataataatgtggtttagaaagtaagataaaaagtatacaattattattatagctccattaatatgcatataaccagtcaacattgggaaggaaaaaagaaaataaaagtggttacatcttggtagaatcatggcttaagtaattttcaaagtctttttctatatataattaggaactaataaatcttttaaatattctacttgtacttgttgactaatatgcacaatggtagcagggacagaccattagcttttacattatttttgtgaattcataagaaattcacaaaactagaaaacaagtataaaattccttaaaatgagctatataagtagagtagctatgttgcttttttcactttgataaatatgaaaatgaataataattttcaaaatatatagaagagcacaggttacaaggaagtacctgctgtatctttataatgaacagtgtccagtcaattcaatttccttaggagatagaagaataggccaagttacagcccgttggacaatatgatttcagaaactttcatacatgattagcaatctgaaaacactgaatttctgttctatggattcagcactatatgataccattctaatgaggcttttaaaaaatgtggtaatttgaggtctgaagtgggttcaaagatgtaacaaagtttggcgctccagaacataaacaaaacataacacaggtgtggatgtctaaacttttgactgtacccaatcttaacatctggtttttgtgctcaactgctcacagtcatgtaaaatgtctcaactgttaatgactcagtgttaagtgagaaaaaagaaaaattaaactctgctgttgaataccatgttgtaaaatcctcatctttagagattctaaaaatattcatagactacacccttttgaatgctgtggcaacttatcccctgaaaggagcaggctaagccaagtgacatgaagatattttctctgtttccattaaggttatattcctctctgggtcagtcaaatcaaacttgtagcacgcatgtctaatgcagaatcactgatcaatcaacgtgctcttttctgaggagtcatggagctccatatgccttatgatatttaggacatattccaggaagctaacaatcaatgaaagcttttttcaaacagacttaattaaagagaagatgaatagatgaatgaacttggggtaaaggtgttcaaatgtctctccaattttacttcaagaatgtttaaccccattgaacttatcagttttggttttatcaaaccaaaattctggatatacagatgtagggttcatctttattgaagggtttaatattggatttcctatttcaaaggaatggaaactgaaaagataatattaactcagaaatcagttgacagatgtcaaatcaaggaacatttgtaaaaaaaattagactaatgttcaagtacagatagagacattttctgtaataaaatcttatcacagaatagcaatgccactgaacagacaagtataaagtaataccaaggacaaagataaaaagttatttctatttttgaaaagaaattagatgatgtctagtttaaaaaaatatgtcaaggtataagattccaatattttatttgactatacagtttaggttgtttttcccattaatgtagaagcacattacatatcgttttcaaagtctaaatgtgttcttttttaaaaaatgataaatatgaagggcaaaatattcatcttaaaccatgagataaaaatatagaggtttttcatgccgctatctttttggtaatcaatgattgaatagtgaatattggtttacagtgcagctatttaattattaatacatttgttttttcttagaaggatttaatattatttttacattttctccactaaatatatcatttcaaaattatctacaggaatatgcccaaaagaatgatcaaagcttagaaatattttgcaactctgtatcatattgagatataaaaacagaatcaagaatgatattgacaaaaatcaggttagcacatcatctagatgataggttttcaatctcctaaaaaataatgcattacattaattatgcatatttgagctttaatgagaaaacattgtaaggatgaacaaaatcctttaacatcagagctgacagagaggtgagagactgcctagttcaacctcctttcacaaatgaggcaattaaacctgtaaaagactacatgatttgtgcagttcataaccttcatgagcaggctaatgtctcctgtattttcttctgtaccctaatatctacgtagcatagaaaaaaaaatctctttgaattgttaaagtaaaatgtcttacattgaaaggcagtacttccacatgctaaagagtaagtaagaatttaagaaaaaccatgaaacaatgtgaaagaaatcaaactgagtggtaacaaaataaacacgcttcattgtggaccacaggatttcatgaaggataatgacagtctttcccatgtttctgaagttcgctgtaaagatacaggtttaaatctcagtaagagagattgagattcaggtataaaggaaaacttagagcgaaagtcagtatactagggccaaatgatttcctgaaaggttatgaaaatgataggcatatacctattagtgaattatgctaaatcactgcagaattcagtgaaaggtatacactttaaatgaaatcatgaagcaaattaagcttttgacataggccattaagtgacaaagccaaggtaagtgtttacatttttctttttttttttttttgagacagagtcttgctctgtcgctcaggctggagtgcagtggtgcgatctcggctcactgcatgctccgcctcccgggttcacaccattctcctgcctcagcctcccgagtagctgggactacaggcgcccgccaccacgcccagctaatttttcgtatttttagtagagacagggtttcaccgtgttagccaggatggtctcgatctcctgattttgtgatccacccgcctcggcctcccaaagcactgggattacaggcgtgagccaccgcacccggccttcatttttcaatttagaatctcggtctaccacctcctcttgatagggagtgggaggctgttacaaattactaggggccccacttttctcagtggcctcaaaatcattttatttatttatttatttttacctcactaggatctaaatctgtttttagtggctttgaaaactgtttctaggactgaactactgaattacatttaagattgaactagtgaatcagtgactaaacaaaacaaattttaggaaaccattctcttcattgttcaacagacaaaaaccaacgaattttatcacttactagctatgtgactttgggctagttatttaacctccatgtacctctgtttcttcatcagtaagatgctgattataacagagtgtgtctcaaaaactagtataaaagtgagttccatgtaaagagcttagaataagagggtatacacctaattcattctataatgaaacttaaaaacattaagaatcctcaaggattacatgaagccaatctgaatcataaagacaggttaaaaagtctaaaccaaatgttagcaaataaagcagcaataaatacatatttttctatgtacctatatgtgtatgtatatttgtgtgcatatggcatgaaaggctttaaacatgagatgttctaataattcacaatgttaagagattaaaggggaaaaaccacagaaaattattcaactaaacaaccattcacgataaaaatgtatggcaaatttggaataggaggaagttaccaaaactaatcaaagatatctaatcttgatggtgaaatgtggaagcatgctctttaattgtagacacaagtaaagaatgcttgttctctccatttctatttaacagtcttttgaaagcattgctttttttggacaagtgtcctcactgtcacctgggagcttgttagaaatgcaggttctcagtgcctgacctaccactgaaccaagatcttccttttaaaaggatccctcagggattcatattttaaagtcagagaagcatccgtgcagccagtcaataaatcattttaaaaagtggtataaaatatagagtataaaaattggaatggaagaaacaaatttttgttattcacagatgatacgattgtctacaaagaatacctaaaagaatcagaagaaacatcattaaaagtacatcaaagtttgaaaagtttctaaatatttgttcgatataaaaattattagatttggatatagctgcagcaagcatttggaaaatataactgaaaattgttgccattttgtaatagcaacagaagtctacagtggatgtgaataaaaaatgtataagatcttcgtaacaaaatgtataaaatgcactgaataacactaaaggaggcaattaatagagggatacgccacaattatagctagaaaggtaaagcagaccaactgtactgatgcgtgtcaaaggtaacactaccagtcagtggaaaaatgatggatcagtcaatcgatggtgtggaaataactagttagccatatgggaaacatacaaaagtggatttcttctcacactgcacacagaattcaattccatatgtaaaagaactttacggtgaaataaaaaacttgaaaaatttttagaagggaaacattattttaactgtgattcatgaactatatgatagaatgaaaacaatgacattttatatcatctgggacattactagatgtaaaataattaagtttattgacctctaaaccagcccaatagggaaaaagggagtaaaggggagcatcttctaggcaaatgatgttcccatacatagacttgccagagcatttgcaagattccctttagaatcgatgtttggtctcttgcctatccctcctccccaggcagtcactttctctggattttttttccctctttctttagcttttccttctcagtcctggcaataggccttcaacaccacaccatcaccactccaccaattctggagggatatgattttcaaaggaacaaagtttttggagttgagttccagcactaacatatgtatggacgaagataacagtctacagctttctgttttcctccctattgctctagaagaaaacgctgccaagaaaaagctacttctaattttttcatagaaaaaaactgctactaaagtatttttttaagaatcattcttttcttcgggagaagatatttccaacacttgttgtgatcaagagaaattgcagaatatttttaaaattcttaaaaatcaatcagaaaaaagagtctggaagaaatttgaggaaggcttagaaataatttttatagaaaaagaaacatgaatcactaacaatatttttaaggcttaaatgtattatcagggaaattaaaattaattaaaaaattagtatcatgttaccactagattgacaaaaaatttgtctttcaaaaaacacgagagcttttataaactacatgtgatcacatattctttctccaatactccttgagaactactagattataaacatacatacacatacataggcacacacataggcacacacacacacatacacagtcatttaaggttaaaatacggtaaatattttctaagtcacttaaaattattgcctgtggatttttcatgtaaaatattaaactcttccaatgtttgaacttaatggttattgagaaatacgaaaaactattagctttcttgatttaatatagttaatattgcttataaaggaaagaaaaaatgcttggctacaaggtcatctcattttaagattacattgattaaacatgtagtatagacagggcatctaacccccatttcactagccagcactgaaaacttctttaaccttgcataaaatgcatgcatattctttgaaagtctttttttgtaaacgaagtattagatttttaatgtaaattataagaaatgtaatgtttactaatgccgtcaagaatggcaggtcaaattcacctggtttttaaagatcaaatgcctacttttacagtcacctttcaacctttgttttagactctaggattcgtttgtcacaggtttgcctatttgggccacagcttccttatatagggtacagagcagcattcaaaggtagtgtttaagtatatggacttgggtgctagatcactgtgcactaacacccagctcagacacttactagctgtgtgacctggggtaacttaacagagcctcattgagctttggtttcctcactagtaaaatgaagctgaaaggaggatatatttcatagggttgtagcagttacatgagttaaaatacctgagctatttagagcagtgcctggttcatagcaggtgatctaggagtgttattgttcttcacgttattcacatttaatagcaaatcatactgcaaaaaatggtgtcaatgtaatggtcattacaggcaatctaagttgcttttgctcttgacagtattttacacctttaaagtttccagtaaaaaagataatgctaataccatttataaaacagaagaacaaagaattccttgacaatttaaatatctaaatttattagttaaatcaattaattatttgttgttgctgacttccactaaaatgtgcctaatcgttttatgaatgtcttcctattccagtcagtatttttagcaggtttaattctcaagcattccaattggatgtgctggaatttggctcctattaactcatggttttgtcctagtgattaatttatcctaccagattgaataagtatatatgtatgtacttgtgtgtttgtgtgtgtgtgtgtgtgtgtgtgtgtgtataaaatttacaccagtggcaaaaatagtgatttcattttgccagtttgcaaggcaaaatgatgtttgctattgtatttcttttgctaaaaaaaaaaataaagcacgctcgagtatttttactgtctgcacactatttaacctcatgtcttattgtgtagctgagtcatgatgaatacaacaagcaaacatccttaatgttctgttttgtcagtgctgggctgtgcactatggtggctgcccaggaggaggggggcaggacatgagcactcacatcaaggatcttatatcaatttaggaagatagaactaaaacacccaaaacaacagtgagcaataccaaatggtttcagttcaacccatgatagtgtacaggagtcgaataaacaacaggaatgaaagaggggaagatggcaatagtcagggaatgtttcatggctgaaggggtcacttatccccaattcaggcattcgactaccagcttcatgattctgccatatccacatttctacatcatgatttttgttgtttctgcatcccctatatactattattaattttaaaaattctgtaatagactagttttttaaaaactgaaataaaatgtcttcatttaaagaagaaactttatatcacaactataaatggaaagtcagtaactcttgccataaatgcagcataaacagaacaaccttattagtttctatccagataatgttgccttcgaaaggcactaggctacaggccggtgttatctctgtttataagacaaagcaggtgttaataagtgttagagacttagtaaagccaacatgagactttctgctgtccttccttcttccctaccatctttcttcccttcctttcttctttcaactttcctctttctctctctccctccttcctcctcttcccttcttccttccatcctttagcaaatattcattgagcacctattatgtgacaggtaccattctaggcacagaggatacaacagtgaaaaaacagaaaaaagcccttgcccttatagagcttacattcttgttggatgaaagcagtcaataaacagataacaaaggatacagtaggtcataggtgctatgaataaaaatacagcagggaacgtcaaggtggaagaaaaagcatgaataggaaaggattactgctaaagtaacatatgagcgatgatctgaagggcaggatggaaccagccatccagatacttagaggaagagaattcccagcactgggaacaggtagtgcaaaggctgtgatgcagaacatgcttggcacattcagggaacaccagtgaagtcagagtggagaagtgagtgggtgaggcggacagtggtttgagaagatgtcagatccaggtcacttgaaaggggcggtagacatagatcatgtagaagtttaacagacatagcaagaatttgactttgactctagatggcatgccattggatggctttgagcagagagcaacacgatgtgaactaattactgtttttgtagaataactctgctatgagattagactggatgggcaaaagcaccagtcggaaaactggttaggagggtatttccattaatttaagagaaagatgagagaacagtcatgtgggaagcacaggaagtagtaaacaatattggatttgttgggcaaagtgtatccaccaccccccaaatacacacacacacacacaaatctctatctcagcacttatgtatttatggtttataaatgaggctgtttatgggcaggacacggtacctcacacctgtaatcccagcttttttggaggctgaggtggggggatcacttgaggtcaggagtttgagaccagcctggccaacatggtaaacctcatctctactcataatacaaaaaaattagctgggtgtggtggccagcacctgtagtcccagctacttcgaaggctaaggcaggagaattgcttgaacctgggaggcagaggttatggtgagccaagatcacaccactgcactccagcctgggcaacagagtgagattctatcaaaacaaacaaacaaacaaaagaaacatgagaccatttatggggatggggctgttctccctgccccaaatttgttgtcagtgactggcaatcatgccttattcatctgtaaaccttactgaccacagtgcctgataaaggtgcttaaaaagttggtgcgactgaatttcagatgagtggaataatgaaaggcacagaggaaagaaggctcacagtaggtatttggggcaagaagatctacgtgggaagtgcagaaaggcatgggcattgtggtgaggcacctctcagagaaaccgaggttcacattagaatggatttcacgtgaaagaagtagaactaagagaagtataagaggagaacgatttaagatgataggaaagaggccaagtttcatggaacctttattaaaaaaaaaagaaattccatataggttagatttaggaaatcaggattcggaaagggctaggatttactacataactttcattctgaaatccttacatttcaactatcaattcactgaataatgtcaatattttattttgctgcttttaagagataaaaaagagctgttcataactaatggaatatgtatatgcacacatacacacacacatatacatatatacacatatatacacatatatacacgttgtgtgtgtgtgtctgtatgtgtgtatatatatataatgtatatgaaattcctcaatttcaaagactggaatagaaacgttcctatagatatacaaggatcatttatactcctaggatgaagagacatgcatcatgaaggtttacttgggttaattaggtatatttcaagggtgattaaggaacaataggagatcactaaaaaaaaaaaaaatctctgctgcaaaataaaactaatggaaaactgaggcaggactaggacagcagtagagaatgatgcaccactgagaatgggggaagaggaattaaggcagatagacctggaagaaaggtggctggaggagcagatatcttgtctttacatcagtgcattcctgatgtataagggagacttggcccatcttgcataaagcagtcaggtcagagtaaaaataaaaacagatgtataactgcccagtctcttgctggaaacgtggagaccccaagtcttgtatggaagggagacaaagtcaacagctatttttgcaggtaaaagagaggatttttttgtttcctaatccaggtcatcctcatctcttgcctttacttatagacacagctttctaattggccttgcaggtcaacacttgcccatctgtgcaccattcttctcccagccaattactggcctctaaactatttttgaataaatagcaaatcttatattatctgtttcaacctcatttcctgacactctttccccactttaccccaaattgcataacttcctggttaattctttaaaagttgcctgttctaacactaacttcttcctccctccccaacccatctctacagttaagtttatgtcctcttcttatttgatcctgtagcaccttccacctgtctgttataatatttgatacacttgtaattctagatctgtcaccccagaatgtagaaaagtgtctggtacatggtaaacacttaatatttgttaaccgttgaaggttgaatgtttactattgatgaacatgaagataaaaagatagtagccgacaattattgagaatgaaagggtttttacactaatttacatttcagataaggtacagctttcattgagatttaaaaaaaactcaggtttgaaattattatagaacattgtataatttcccatgttcacaaatttaaaaaatacagtacactttaaacaaaacagagttcacataaagcatatttgataatcagctcagctccttggtgaaaaaaactaaaatttggaatagttaattgaatggctatcatttaaatattttaaatacttgttcttgaactataaataaccacatagaaatatgaggaaaattaaatttaagagggtgtttatttggagaggaattttaaaacaagtcttatgaatcatggtaaatacccttacaggtatactcagggcactggagtgcactttatgctccaacaaacccaagacttagagacagttgctagctgcacacaaacagtgtcactgtccactattttacacaaacggcaattgagtagcaagggaaggtgaattcctcagtcctgagttacttctgggtgtgcctcagatgtttaagctgcacattaactaactcatttaggcccccagagtaactattaatgtaccaaagctacaatttgagaagaccctttatttccaagagagctggaagaatcttcaacaattcataatacttgttcttattaaattgcgaattctgggcaaagaatcttgaggagtaaaattgcctatgccatttcacatgaatgatatacagaatgtgactctgaaatgtctgccattttcagagcattacacatggagagcttcctcaattttcagaggacctctactgctacagggaaaatttcggttcacttgagttagaattatccttaaaagggatagaaaaattcaggaatgcaacaacattgacttaccaagactcacaagttgtatacaccatttagaaaaagtttttagccttgaaaaggaacatcttgtattattgttaatatgaatatttatgaagcactatcagtaggcttaactcagtccctgctcaattagcttataatttaattagtcctaaatgcaaatcctctaaattggggtggttggcttttgaaatgaatgccaactaatatcattattgatggctcactatcttctgcttctctctctcatttctcttttcttcttaccttatacatacattttgctctcaaacacccacccttcctcaactgaaaggatgtaaatgaaggtacacctgcaaaagcagaagccctgtggtccacattgaactttaaaatccttattagcattttgtatctgaaaattatagggatgttttgtgaatttttatagatctaacacaattgtcaaatatcagctttgaaccatgaaaacatttctaagatattacgcaaactaaactctaaattgagttttctatttctatttgaatttcacatatctaaatttcctatgttgtttctgagagagctccatatctgtgctggagttggttcactgcacaacatttcttacaggtttagatagcacaccttgttttgtgctacattctctcttgggagacctcagttgtattacaatcatagatggttgcttactaatacagaaagtagaaaaaaaagctgcccctttgaaaactatttaataactttaataagctgctttgtaaataagtaaataaaaagatacacttccttttgtcaaagcaaactctttgatatggtctggttctgtgtcctcaaccaaatctcaacttgaattgtaatgcaaattgtaatccccacgttttgggggaaagtcctcatgggaggtgattagatcatggaacagattcccccatgctgttctaataatagtgagtgacttctctggagctctaatggttttataaggggctttttcccctccactctgcacttctctctcctgctgccatgtgaagaagaacatgtttgcttccccttccaccatgtttgtaagtttcctgaagcctccccagtcatgtggaactgtaagtcaattaaacccgtttcctttacaaattacccagtctcaggcagttctttatagcagtgtgagaacagattagtacagtcagttggtactgagagtagtgtggcactactgcagatacctgaaaatgtggaagcgactttggaactgggtaacaggcagaggttggaacagtttggaggcctcagaagaagacaggaaaatgtgggaaaatgtgcaacttcctagagacttggagggctcagaagacagaaagatgtgggaaagtttgggacgtctgagaaacttgttgaatggctttgaccaaaatgcttatagtgatacgaacaatgacgtccaggctgagttggtctgagatggagatgaggaacttgttagaaactggagtaaaggtcactcttgctatgctttagcaaagaggctggtggcattttgtccctgccgtagagatctgtggaactgtgaattagagagatgatttagagtatctggtggaagaaaattcaaaaggaagcacaccataaaagtttgagaaatttgcagcctgatgatgtaatagcaaagaaaaacccattttctgggggaaaattccagccagctgcagaaatttgcataagtaatgagatgccaaatgttaatcaccaagacaatgaggaaaatgtctctagagcctgttagacgacttcacagcagcccctcctattacaggcctggaggcctaggaggaaagactttattttgtggggtgggcctagggtccccctgctctgtgcaaccctgcatcccagctgcttcagtcccaaccatggctaaaaggggccaacatacagctcaggccattgcttcagaaggtccaagcctcaaggcttagcagcttacacgtggtgttgggcctgcaggtgcacagaagtcaagaactgaggtttgggaacctccacctagatttcagaggatgtatggaaatgcctggatgtccaggcaagagcctgctgcagggacggggccctcgtggagaacctctgctggggcagtgcagtaggaaaatgtggggtgcaagctcccacacagaattcccactggggcactgcatagtggagctgtgagaagagggcaaccatcctccagaccccagaatggtagctccaccaacagcttgcactgcgcacctggaaaagctgcagacactcaatgccagcccatgaaagcagccaggaggggactgtaccctgaaaaaccacaggggtggagctgccaaagtggtggggacccaactcttgcaacagcatgaactggatgtaagacatggagtcaaaggagatcattttggaactttaatgtttaatgactgccctattggattttggacttgcatggggcctgttgcccctttgttctggacaatttctcccatttggaatgagtgtatttacccaatacctgtgcctccactgtatctaggaagtaattaacttgcttttgcttttacaggctcatagacagaagggacttgccttgtctcagtcgagactttggacttggactattgagttaacgctgaaatgagtcaagactttgggagactcttgggaaggcataattgtgttttgaaatgtgagaaagatgagattttggagggcaaaaggtggaatgatatggtctggctctgtgtcctcacccaaatctcgaattgtaatccaaattgtaatccccatgttttgggggagggaacctcatgggaggtgattagatcatgggagcagatccccctgctgttctcatgatagtgagtgacttctcaggagatctgatagttctataaggggctttttccccctttcctctgcacttccctcccctgccgccatgtgaataagaacgtgtttgtttcccattccaccatgattttaagtttcctgaagcctttccagtcatgcagaactgtgagtcaatgaaacctgtttcctttataaattaccatatctcaagtagttctttatagcagcatgaaaatggactaatacacccctgcagtgataaacattttcatcttttgagaataatcaaaaatagatgtgcagcaaaaatgtcataccattgcttcctgtgccctgtgatgcacaatggagcaatgcagcactcctcactagataaacattctgaaataacagtacagggcaagcagtcctaggaaggcagaccacagagcttagaaaaagtacacgctgcagtttgaagtgcaaaccacaatgaggcaatgaggagcttatgtccactctcaatataaaacatatctctgttaagtcctcaaatgcctatggttctctgcagtcacccattaatgacaactaagggaccatgaagggggagacatggactggcattgtctgctgcaccattcctggtggtttgattaaaaaacactgaaactggagaggatatgtttagaaaataattgtatgcttgcttcaattcagcttttctctccacttttaaaatcaggtaaagccaaactcatatatattcttattatctacaacaattactgtttcaggaggttgacatgtcttgttacctaaaaccactgaaaatttgaatgttgatcaacatttaaaatagcaagaggaatcttttcccattgcttaattttatttttttgagacagggtcttgttctatctccctggctagaatgcagtggcgtgatctcggctcacagcaacctctgcctctcaggctcaagcaatcctcccacctcagccaccctagtagctaggactacatgtgcatgccaccatgcttggctattttttttgtattttttgtacatatggtgttttgccatattgcccaggctggtctcaaactcctgggctcaagcaatccaccagccttggcctcccaaagtgctgggattacaggcatgagccaccaggcctggccaattttatttcttacttgactttttttgttggtgtagccattctcctattgatagacactgttcattttaatttttgactattacaaagaatgtttttgggaaattttaaaatttttttcttctcatgccaaaataaaagcttataacagaaaatataggcaaaacgtgaatatgtaaaagtttctgcaatcctacttaccctgaaataaccactgaatggcatggtggttgttatggtgtgtgtgtgcatgcaagtgtgtttacaacatttatctttttctgagtataagcttatatgtaaattttaaatttacatatatgaataagcaaatgcataaatttgtaaaaattgaatggtactaaacatactttttataagatccttttttaaccctgtaaggctattaaaatattcaaaacactatcctttttctagtactatgttcacaaagtattcattttaaaatatcactatagaacagtatattacagcaggcaaagaagttcagttgaaagttatactcctaatatttgagagagataagaatggatgaagtttgatgtacttaatcctattgcaataaagtgaactttcaaatatttcaagccttcactgcaaagtaaaataagacctattcttatttcttcaaaaattttatatattataagtaggtaaggtatctccagctgaaagaaataattttatggccagctttccaaaccttccaaattgtatatcactttcttctcttttaattctgctgtctcagatatttaattaataagagctgctgtagcaaggggcttgtccataattttattgtcaacatttctgagtcatctacttctgatttgttttaaaatcaaatgcaagatatttggctaacatacaatcaccatgagctaggaatataacaaataaaccaatgacagccttctctgatgcacccttactttcatctgaaccattgtgctaagaaaaattagttttttattccttaaaagtcttaagtatccttctgttatatctgaaacctcaactcctcaactccttttttgttagttgaccatcagccatcaaccaccatccagttaaagtcaatgatgtgaactgcacgcttaaaggtaagcaaaattcttttaagttctgctttgaaaagagggaacaaaacccttggtgacaggagtttgtaatctaataggggcactgtgattaagtgacatagtgcatacatgtgtgccaggaaacaaatctatactgagtacaatcagaaacagagatcctatcagacatatgataaagcttgcttaaggaagcttgagggaggagtgacaatctttattatggaaaagggtgtagtttgggaaaatactattacatcaagctgggaaggacagctaagagaatggatgacagaatcaggatataaaaagagcataaggtcaaaatataaccagatggagttaaatagggtcacatttgaagtcctgccctttggttaaaacaaaaacatctaactgagcagctgccaagagagaaggagatggtgcctaagtcaagcccttttagttaagtgcaggatgtcacaacgatacgatgtggcagccagtgtctatctaatctaaagtcactttcattgataaataaccccaggatgaggcaaagaaaaaaaaaagtctctatgatgttctgagctaattggattactttaggaatttctggaatttgctaatctttgggccattaaattacaaaaggaggttatgagataggagctagtctaatggggagtcactagaaaaggaaagagatgtgatggtataatggtagccaagttaaggaatagaaaacatagggaacagacctgatggttacagatacaaaagtgtcacatgaaaatggaatttcaggcagttgtgtgctgggtcaccaaaatgtcattcccaaagtttactccatcgcacctggccactctgcccttgaccctcgactcagccaaatatgacatatctctggaaggctggcagatgcaagctgaacggttggccataagagcccagctgaaacaagagtacctgcttcagtacaacaaccaactctaaccaccaagggctcatcgaagatcttgccttaattcgttggacctatgcaagatcagcaaatgtctattctaatttcagactcactcctaaaactcactcttgggagctctgtgtggaattgggcccctcttcttctggtattatgttttcaaaactgacagggataggaaagaaaaacttatccaggaaggaaaattggatggaacatttaacatctcatattaagtctggcaatgatgactataaggatcttgcttaaataaattgtctattaatcattaaaaaaagaaagaaaggaagaaaatggaatttcacttgccctgtgtgtttccaagattcacaggtaggagcaatgctacttagaagtttcacggaggccaaagttcagtgaaagcaagaccaagccaatgacacagagccagccaatgacacatcaacactgacaaggagaaggatgtgcagcaataggggcacaagcattgacctttgaagagtcacatcatagctgtgttagcactgaaccacagggcactggtgtcttttttcatcctgaaaattctgattcaacaaaaaagtttgtttccttcccaatttaccttcctttgaactaattaaacttctatcctcttcatccctcaactattaaatatttaaaaatatgttgaccaatttaaggttttgaaataaaaacattatatgaccaaaaggtttgataaattctcaaaagcataacactgtctacttctctgtaggtatctcgtgagcaccagatactaagctcccttgatgaaaatagcttttcaaaatatgatagatatgctagtgcactgtattcggaaaaatgtgagttcatatggacctgtcaggatgtaaaaaacatgcaatacttggtgtgtttcctaaggagggccccgggtaaggccccagtgctgtgcttctcacattgaaaacacatatgaatcacctgggatcttactgcaatgcagatggttacccactaggtcagggtggggtccaagaatttctaccaagtccaggtgatattcatactgctggttcatggatcacattttgagtagcaaggtaaggcgtatttcccatgaagcaccattgcagaatgtttattactaggccaatattcacctaggcatttctttgctttatatattaacacttctattgacacagatcataaaatttctgttttcctttctttgaaaattaaaatatatggtatactaaaacttaaaaaaaaatcagacagttttttcccccaggtacttaagaggatacaaacccatgaaacttggcctcaattagattacagtggtccctcaggatctttggggattggttccaggtcttcaggcagataccaaaatccatggatgctcaagttccttatataaaatgacatagtatttgtatataacctacacacatcaatatactttaaagcatctccagattacttatacctaatacaatgtaaatgttatgtcaatagttattatgctgtactgtttagggaatgacaagaaaagtctgtacatgttcagtatatacacaaccatattattaaaaaaaaaaattggattgaatacacagatgtggaacccatggatacgaaaggcctactgtacttggaagtatcaataggaaatttcatcaaaattgatggtgaatttcacatagaattaactctcattttgtttttatttatttagcatatgtaagccggtctctaataacaaaataattacaatgactatttttctccagctctaaatttattatagcaacaactcaggatcaaatataatttgagatccctttgaaggggtataagctgttggttgataatgatgttgagtagatggtccaaaaagactcagtctgaacatcctcaattgtttgccttagaccaaattctaagtgattgtaagaattcatcttctttgaatacggtgtattgaatttcttaatgaactctccagcaaacatgaaaaagtaaatgatgttatttgggcaagactgtttgcttatagaaaaataagaatgtcatctgtggagttttgaaacttcatcctaaatcatcacacatggttcccaggtgaagcttgtacatatattctgaagtagaaactgctcttttaatggtgatattcagaatctagtcaggctgatcattgtcctagtctcagcttttagcctcctgtttccttcatctgaaatgttcttgcccttcatctcctttgagtctatgcaaatgttaacctggagggctaccctattcaaaattgcatccctactgataacttcctatgtcattccctgacttttttccttagcacttatcactatccaacatatattttttacttatttttcttgaatattgtctatcttttctgtagttttctgctgctggtgtaacaaattatcagaaacttagtgatttaacaattaaaatgtatcattttatagttctgtaggtcagaagtccaacacaggcctcaatgggctaaaatcaaggtgtcttcagggttgcattcctttctgagtgggctaagggagaatctgcttccttgccctttctagctgtccacattccttggctccaggcccccttctttcatttccaaagccaacaaagttgcatctgtctgaccctttttctgttatcacatctctctctaacctaaccagggaaaagtctttgcttagaaggacttgtgtgattagattgggcccactgggctaatacggacactacatctcaaggtctgtgcccctaatcaaatctgcaaaatctttttttgcatgtgaggtaatgttcatttagtccagggattaggcagtggagctctttgcaggggctattattttgcctatattcattggaatgtaagctccaaaaggtcacagatttttatttgtttgattcactgttatattcctagcacttacagcagcacctggtatatagtataaactcaaaaaatatttatttcagaaaattaatgaaagaaaattggattgggctaatgatgtcatgacaaacacatatttgaagtgcaggcgctagacatagacccttactagatttttttgttttgatttttgagatggaatatcactctcacccaggctagagtgccgtggcgttatctcagcacactgtaacctctgcctcctgggttcaagccattctcctgcctcagcctcctgagtagctgggattacaggcacctgccaccaccatgcccagctaatttctgtatttttagtagagatgggttttcaccatgttggccaggctggtcttgaactcctgacctcaggggatctgcctgcctcagcctcccaaagtgttgagattacagatgtgagccaatgcatctggctagcctctactagatgtttgaagagttaatcacttgaattaaataaaccttagtcctcatttgaaaaatgagaccatcactttgcccacttcatagagtggtttagagaatcagtcaatgtgatctgcactgaagtggtctgaaaattcttagctaaagaaatgtaaattattgatactatactttttaagtcggtcttagtatccttacctaaaaatttaagtttctttgagctcaaaatatcagccattttggtcacagttcactcctcagactttcagaaaccccattcaagatgctgaaaaagatatatgggaaaatcttaaagcatggcagtagccttctttggtttcttttttgccaaacataccattcctcagggtcattgccctagactgagtgtagcatgattggaccatctgagaagatggtgggataacagaaagttatttggagtcttcagacctcagtctagtccaggctctttttgactgggcatttccattagtatctccaagccaccctgctgcctagagtttatcattctcagctacatgttattaaaacatgttagcaagtactgcagtggtgcagaagaaaggccctaagagccttattgtttttatttccttaaggtaggactagaacataatttaactaacacactgtcttcatataacttaagtttataaccagtatcatagaaaagataacatgcccacaaatacttgtagaattattttgctgatctttcaaaaaatggcacttagaacttttatcatctatttttagaatatttgtacaaggaaatgggcctctccaattttattgaaaacatttgtcaattttattaaattttttaaaactcagaatttgcttggaactcatatgcttatatttactagaagactaaaaatctaaaggtttaagatagaattttctattgccttagcaaatctgtaatgcccaaattagaaaacagttatttttctccaggattgatgtaattaaaacactaaagggtgggggggtcaaacaacaacaaaacagtcttaatatagatgtggtttgtttctctgggcctgtgactacatatggatatttggaaacattacagtgtttggcgacaacaaagctattcattgttagtcaacagatatgcacactgtggtgaaaactcaaccaataaaattgttaatttaatgcagtgattctcaaagtgtggtctccagactagcagcattagtgtcacttggggtcttattagaagcaaaaaattggaggctgtaccacagatctacagaattagaaattttggggaaggggcctggtaatgtgtggcttattggcccttccaggtgattctgatgatcattagtggatgcccttttactttcttaccttaaaatatcttataatcttgtttgatagtgtatatgaaaaagcacaattgctttttaaaaggtgaaaatctgagtcagcaattaaggctaagtcatatctaaaaatcatgtgggcagagtattttgaaaactagatatttgaatcagctgaaaaagcctctgctgcaacccaaacctaaaacctcccctaaaacccaaacctaaaagtattatttattcaataacttacataaattatccatgtaaaataaacattgtatatattaagaaatgcttttcacatgttaattgaaatctagcttattttcttggaattttctcttgcattttagacatattttccagagattgattttcttgctctaaaattttattggcaacccaaaaaaagcaaaatcaaacagacaagccaacaatattctcatataatcaaccagattttttaaatccagagtcttaaaaatatgggtattttcccctgcgagttaaataagcacaaaacaaacatattgtatggtctatagttttattttagtaactggaaacactattttgcctgcattccaattgttataataaaggtgaagcaaaagtcctgagacagcctcaaggatctggtggctaattctttcaacagaaccaagggcagggtccgagatgacaaggtctgtttcagctgggtctcaggtgagtgtccagggtatacagaatggggttgaagactctttccacaagagcagcagaatagtatgcacatgaaagtaccccattaccaagaggccttgtgggatgaacctgtgtgcaatggagttacaccatccaggacttcctgagtagaggattttgggttattggtaggcaatggagagccaatgagatttcaggttgtggatttacatatcacagtctctttttaggaagatgaactccagccaaagtgtaagctctaaactgaatcttacagagcctgttgtcaggaaattctggcaatttctagcttgacaaaaggccaggccaaagcagtagtggtggtgatggaggccagaatgtgagaaacctttgggccaggtttgaatgtgatggctgaaggaaaaaataggaaacaaggtaaaatcttgggcttcttgttaagtatttattaatattgggtatgatgcttattctgcattacttatccatgcaaactattgaggacaacaagataattttgtgcttagattggtgtgtgtgtgtgtgtggggggggggtcctctatcatgtatctagctgattcaaatcatttttttctaaatgataggaacaggtgaaaagtgatatccctgggagtccgagcaagtagggatgcatttcttaaccagcagttctttaagtggaagtctgtgaacctctaaagcagcggagtcatgaaagacatttagaaaaatacagtcacctgggtcctgtccccagaaagtctgatgtcatttttctgggtgtctggcccaggcatcagattttttaaagttccccaggtgattgaaagtggataagaactaatgcttgaaaatataagtgaaggcttttttcaattagataatataactttaatttcattctgttgatttgcctaataatctgttgtgatgctaatgaaaccaaagtgttacatatttacctcctagggatgatgcaaaaacaaaaagataatatgtgataaagtacatcaagctgatacctatttgggccctgttgtcaacaatagtgtttcaactttttcctacagggaataaatacttacataaatcactgggaaaatacagcaaagtagcataatttctttgcttttacctttaacacgtgggctataaaattgtctataaaacactatctgccacaacttataataaatacatcctttttattgacataagatgggtaaatatagtttttaaaaggcatcagaggagctataaaggcaaactggatgtcaacacccattttgagggggttaatttttcttccaggaagtttataaatggcaggtcctggaaatcctaaaatcgctagatggactttgccttgcacatacttgacattcaataaaaattctggaaatgcctgaaaaagatcagcacatgtgttgtcttaatatagcacagtaacattacattgtttgggatgggttgtgctgaaaaagttgatctcttccaagacttaaagaatagtgtctgaaatttagcaacaggaaatctgggcagatgtgtaatgaaagtgctgtgaaatgattagaatatctaaaacaaagaataaaaataccatggatttggtaatattggatacacgaaaatggaatatatcaaatacacatgaagttctatctggaaaatttaaaaaattagcttttgggccaggcatggtggctcacgcctgtaatcccagcactttgggaggccgagatgggtgaatcacaaggtcaggagattgagaccatcctggctaacacgatgaaaccctgtctctactaaaaatacaaaaaattagccaggcgtggtggcaggcacctgtagtcccagctactcgggaggctgaggcaagagaatggcgtgaacccgggaggcggagcttgcagtgagccgagatcatgccactgcactccagcctgggcaacagagcaagactcagcctcaaaaaaaaaaaaaaaaaaaaaaaaaaaaaaaattaccttttggctacttttaaagattttccacatgaatgttggaactacccaactttcaatgaagaagtcttagctctatgcatttgcaatatttaacttctcccactttttccaaatctcttagatttcagctgttatgacacatttctaagacctttattcagacccttacaggcttttgaaaagactcttttttctttaatatgagatgtattgtgtacctattacactgaatggcactatagaaaaatatggctaatctgtatttctgtactctttgtgaatgacctaaatacaatgtttaccaccacaaatttggtacaacctacatgaaataagacttcagttttaaatataatactgttccacatagtatgacaaatatatacttggtatatgaaccatttggtatgctacaatacgacccacccccaatttaaacaggcttatctgaagtttacagaagatttaatatagtttactagatgattaaatataggtatggttgtgcgtgtatgtgcatgcacacatattttgctgagtggttaatataaaagctatgatagaatgtgaggataaacactgtattagctaagtactgtagagtaaaagaattcagaggacctggactaggataaagagcacaggaaaagaagatgagatttccataaaacaagctttgacagctttgaccaactcttaactgtctgcctgtagtctacattatgtatgagcagaaagtttgtatttcacatagaagctttccagttattaattaggaaaatgtttacatatggtatgtcacatgagtaggtttatctccttagccgaccaaagtaatgcagatattaaaaagaatatgttgtcagaaataaattattcatgcttcctaacttttctaatttggtaatttgaaaacattaataggatttggtcattcttaattgtgttgatgactatccttgctctctttattctcaaggctagttgaaatttatctcatttatattaatttttctgtctgtggcttctcaaaagtaaaataacttcagaagcttcataagtatggagaaaatgttaggtgaaactttgcagaatcatttataatttatatgagatttttctttagtttttgagaactatcacttgaatatgtaatcatcaaacaggtggccttccacttatttgatatgatagaagaaaacttctaacattccaatttaaatattttatttgaaaattcactgctataataacactataacattaaggagagctgtgttgtaaacatagtccttctttttaaaaatgggaactcttattttatcctgtagctgttatattcatctactcatttttagtgttgctttcaccaaacaacatgtctacagtaaatatatttccattttatgattacagggaagtgattcctaatgaaaatgagaacagagtgctcaaattggggttagaccatccctgttgtgtcatagtttccactgttgaagtaaaatcccaactgaaaaataataggtcttgttagttggcaggcaggtttcactgagtaaactaagttgctttctaggattttgtgcagaaaaattctgcaatgctaaaattctgcaacgctaaaattcacataacacttaaaactgacatcgagagtagtggcccaatcactatgggagtaatcaacaactgtaaaagttttttggctttagcctctgctgtgaaaaagcatgagaagtatttatgagaataaagaggcctaagggattgcattttccacagtttattggacatctctacttggacaaccacagacttctcagaccctactagcccaaatggaacacataatttcaccctcaaactcactcctcttgctggaccccaaactcagtgaatggcctactgttcttctagttgtcccaagtgtcttcctgttcctcgctgtcacacatattgaatgccagttcccgttcaatctatttcctaagtagctatttcctaaatctctttacttttcattctccccttgctgctggtccaagccatgagtaccggtctgaattattgcagcaatgtcccagctggtctcctttccttcagcactgtccttccccaatacactctctacagcacagccaaatactacaacctcaaagactttcccttttgttggaatgaagtccggaattcttaacatggatagcaaggcctgttattttctcttccttgtattattctcagcttcatctcccatcattctccagagcatgtgcaactgtcctctctgcaccctaaactccaccatatgcacattcagtaatgtggtaatgtcaagaactctccactttccaactttgcatatgctcttgtctctgcctgccctgtccatcatcttgctaatttctattcacactgtaggctttagtgcctcttccatgaaccattcatgaactccacatcacccagtcctaaaatcaaggatgactgcttgcataacatcctatattctgcctcatcctggaagtgattatacttcattgtaattgatgtttactcatctagctttaccactggacctctggcttcacaagaatcacatatgtgagtatcttgctcactgtacaaccttagcccattatagtgataagcccatggtaggtgctccacaaatatttgttaagtgaattaatctgaatgcagatatgtacaaagaccacagagttcagatttttgtctatgcccttagctatcatgtcaaagaactggagggtagtgcataataactagctgtcttattacaacgtacctccctgcaatacagtttcacccaccctaccccccaaaaaattctaatcactagccagatttaaatctatttgactctacttctttcagtgttggtaagagctatagcagccattacttaagaagagagttaaattactaatatctgtctacccatttctctgagaaaatgaaattacttctctacataattaaaacaccatttctttgaacttgatgaagaagccaattttcttttgtgttcctgcctcaaaaaagaatatatgtctagagagaatattagagaagttattccataagatataactttctgctagaataaacttcattattcctacaaaattatggaagtagctggctatacttctctgcttacctcttaatttttcaaaaataacaaaaataacaaaactaaataaaagtctaccccatattttctaaaatagaattctgctaaaacacacacacacagacacatacatacacaaacacacacacacgaactatgaatttctataccattcttcaaaattctaaatattgtcaaagtcattttaagagaaacagaactagtttagttagtgtacatctgtcctatggtattctttgcaccagtggatctcagactctagcatacatcagagtgtcctggaggtctttgtaaaatgcaggttgctggactgctcccttccacctagagtttctgattcattaggcctgagatggaaccagataatttgcatctccagcaagttcctaggtgatattgatgctaacctggggaacacgctttgagatgtgacttatacgtgtaactaacagtagggaagcacatttagttctgtccatgcagttctatcaggcattttgacatgtgctgtcctcttgctctctttctttcattttttttggtaccaatatctaactcagcattactgcctaaatacataaagcctgtattccatgctgaaacttaacagcacaagtgtacatcatttaaaaaaacgaaaacaaaaaaaaccaaaaaacagaaaaaaagagggctatttctgcaagttaaaaaattaaatggaaaaacaaccccaaaattgctctaaggaggttttgccttcaatagcaaaacatgttttgcctcaattgtgatttctttgttcgggagccaaggtggcaattaagctggcacaaggagcaggagccatttatttaatatgatgacagcgtagccctttgtaaatcctggaacaatgagggcccacacacaggctcattccaagttctagttccttctcttccctgttgctcagtgtgaattctcatagccacaaaggaaggggaagattttcaatcctgtcacatcctcccccatttaaaccatttatagtcttaacttataagatatgagtaagaaatcttctttaaacattttgcagagctgatcatcaaatctaacaaactggtggttttgaaatctcctttgctccaaagacattccattaacctctgtgtcctctgttgtgtcattgtgctgagaagagcaagttaaaaatccagtcttaattggggcttggtggtaggattatttttatcttatagatttatttcaatattcattttaggaagaaagaagaccttaggaaggtctaattctcatcagttctggcataagctgagttagggatctcagaatttaaagaaacgacgcccttaataatggcatctgaagaagcaagtgtaccatgctgtgacaattacaagatactacatcagttcccatcctctactaggctcttttaggatggagactctgtctggttcactgctttatctctataatttacaatagtactcagaaaatagaaggcgctcagtatgtagcaattattgcctgactggctgtctctgtaagcattacagggaatgtacaaccaaaatgtataaagtgtaacatgacaccaaagttcataaattaaatgttatcaaaatagattgtttttataaatgaagaaaattaatcagaagatatctttttagaatataacaacctctaacacccagtctacaaatatacccatcatcaaacttctggcaaatgttcaaagtaaataaacacctatcatgacttaaatacctggctttatacttcaacagtgttcatatgagtaaaaacatttttgcttaagttgtctaccagtttataatatgggaaggaattccccatgggatactatctcctccccctttatatagggaatacaagtttggctaaatactttatcataattgtgcagaaagcacatggccttataaaagggcaatcacatatattatcaatgggattgatactattatcaatggtttcctaaaagcagcctctccattttgcaagtctatcaacttatagttctttaccttcccttcagctgaatctactcacttcaggctcagcctgagttcctgaaagaatcctgccagggtgggacccattataaggattttaattgcatctaggtcatgacactcagatctggatctaggggtgactgctggcttctgcatgatctactcttcttctcaggctgcccattccctgagatctacttcatggacactagatcctgtgcctgatgttcaaattaggatggcctcataccacaatgttttgttgccccttctagctttggatctcctgtaaccccaaatagcctaatctatgccgggccctcttatgcccttttgatactatttctcaaatgactcacaagaccagcctctaaggtcaagctagttctcccaggtctcttctagtatcctagtgctatttttttctctgccaagttctgatttcttttccagtccctgttgctaaaatcctactgaatccctcacagccacccaaatcctggcaaggtatgattttaccatcttaagttcattttcagggctgagcgtataataatgactggtcatgcagcacccagtgatcacactgtacagagagtacagacattgggatggaggaagggcaaaaagaggcccttgatactgaaacatattttcagagagtaatataattggtgaattctcatatgctgtgaggatcaaattgatgaaccattttagcactcccacaagaattctgctccctcatttctgcacagaatttcatcttatgaaaaagttccacaattgttaacatactatagcatctcttcatgccaagtagttttgtattttaagaattacaaaatgcactcatcaaataattttggcacataatatatatttctaaattccagaacaaatctctctcttgaaattctatttaaaatacaacctgggcttgtacaccatccagtatgatagaaaaacatataatcaattcatagaagaccaacacctgccctacaggtgctagaatttgacatcttgttgaaattagattgaaatttagtatacagtatgtaagaaaaaaggcagactacaatatttcctgctagtggacatcattcaggcctcagagatgaaatgtgcaaaactcttctagaaatactaatcaactgaaacaagccgcctccaaaacagtaatgtggtcagtctgcatgctgccaggtaatttacaatccatgacaagcagagccaagtgaaagttatttacatttattctactggtagaatagaagagatgagagtgaaaaggatctgctgaatcagatcatgtttgactgaggagtgacagggaagttttcttcaattaatagccagctgcataatttgagctaatgccagctggactttcatcatgaaacgacacagaaataaattattctgtactcaggtgctggcatagtgaagtgaattaatccacttaaatctggaggagggagagagaaagtagattacactatctgaattttttgagcctgttttagccacactttaaggatactgaggttcatgataattattaaaatgtccaagtggatccatttagactcaaatacttgcttgaatgaacaaattcttagaagggaggaaccagagtagaaatggctttatcaaggtcatggtggtttctttcaccaattagtgaaattcatattcaactcagaaggtcagggggaagtgggcaaaaagagtcttattaagaacaactttataggggaattcttgagggggtaaaaaggtgactacaaagatataaaggaatccaggacaggtttagagaggtcaactgcctgctggttcattcagaaaagattaacagacccagctgctgggacttttctggctaggcatccttcccagtggtcacaagtcaatgtgtctcctggctgcttggctatgttcccatccgtctggatggaagagcgcccacccctacacgccagaacttttccttaggggaaagttactgaggttccacgtcaggcaaactttgctcacccatcacttcaagtaaacaactcttctatggagatttcttagagaaaaaatgcacttgaaagcatctaaccaaagcaatgaaggtggaaaaaacaagttatgtgggaatctgagtatagaatatacagacataaaataagctctccaaatgaggaagcagtcacagcttgacctctgaattgtttgctgtttgttccttcaatattcaaactgtagccctggaaatacaaacacaaacttctaaacactcacaggcctgtggcaacaaaatgctacatgccagcttcacaactggggcatgcagaccataaatcctgtagtggcaggaggggaggtgtggaaatagactgtcatcattctgcagcaaggaaaactaggtacaaggaaaaggcaactggcaacacattcctggattctctcattcattgaagaaggaactcagggattgaattacccaattgacgctagttctacccatgccagagggcaaaagttccaagactgccacaggccatggttgcttggaatttaggcagaggtgcttggtccttagagtgtagcagagagaagttctggaaaaggagctcctcatcgagtctggtaatgagcacttctattctgacatggatttcagaggactcaggggacaacgtgcccagaatttaacccttttaatcagtcagcatgagagataaatctaatttagctatatgagactgatgagaaacagtctttgccgtctataacacaaaaggaaaaggacaaaataagaagcccattacttttagttaacattcagagcaacaaataaattcctacaatcacatagcacctggttccatcaatggttggttagtctgggagattctaagctattagctggaagctctctccacagtgagtagtggggagaaggggagaagcgagctgttagctgaattagcaagtgtttttacaaatgtcatatgtagtgtcaatgtgtgtcctaaatgtaacaccctgccaattcatcaatttatagacagaacataggcacaatttctagatatgagattgcatgacagtgtttctcaaggattagtttatttctttcaacacaccctttttgatacgaactgctttattttctagcactcactacatctcactcaaatgtgtggatggcaacagaaaattttgatcattactcagagtactgattttatacattatcatctttaaccttacagtcttctgaggttaaaatccaattacataaaaagcaaaagaacctcagaggtaaagagaccagccaaaatataactatgccctagttttacccctgtatttttattattttgtggggtaacttttatttgccagtcttccttaaaattgtaacttctttgaagatgggaactccatattattcatcttttcatcttcagtgcctagaacagtgcctggaacctggtaggcagtcagaaatgtgagaagtagatgcaggccatgcagccagtcagcaacagtgctgggttttcaatgcagaaatgtctgattccaagaccactcacgtaaaaaaaaaaatgttgcagtttatcagtgatgtttggcaaaagaatggatgttgatattagtttacccagtttcattctaggtagttcacaaccaggagcttctcaagaaatacttgtttacagaattcatgaatccaaattagctctgtttcccaaaaccatagataactggaaactaaaaattggataaaagtcagcttcaacagaagaaaaaagagtttgtattaaatatgaatgagcatttactttgttaaatgatatgtgggcttttcacctagattacaggaaaattactctagcatcaatttttactttgaactttgaagaactttgaagagctatattgagtaaaacccaaagtgctctccgcatgaaaaattctagtttgcccctactgtaaaaattcacaatataaatataatcatgagggtattttctttcatagcatcagtcatttaaaaatacaaatctttgaagaaaaaaaaattgttgacgaagtaaaatagcattaaatcctgtaaaaagattacaggcacaaaacctgaggattttacttgtaaagttttgttgatggagtcaaatactcacttgcattaactctctttccaaaccctgagtccaccccttcgtattccacttgtaataactaatgttaatagcaaaaatatatttatactggaatgaacaataagcatacaacagttgtttggtttaccaaattccctttcattcacagcttaaaatgtaaccaatttagctatgacaatgccagcttagtttatccaatagcacagtaagcactattcctagagctcataattttaggagctcatagaaatgttaaatctcttttaaaatctgaaaaaatgagtacaaaacagtttagattatatttatctttacataaatgcagctacaaaatataattttgtattttttatgaggaggggacccacaaagccaaaagtgcgttgcgctcatcaaaatcatagtgagctagggtatttttaatctttataaaattgctatggcattattcgttgctggaatgccaggagcatgttaatattatgtgccttttatttcttctcacccactaaaaaaatctaatctcacgaaaaatatggaaaagtcttatgaattggattggatatgaacaggatggatatatgacagatgtatacagatatatgatgggtatgaataggatgaatggatataaatcacaaatccaatttaactgggcaatgaaagaaaaaaaattcctaagaaagccttcctttcccctatctcacatcttttacctagaaagcaacaatttagaaatgattacaacttcagagaactgaaggaaaagacgaactaccagaatattgtggcttcataaaaacaccaatttagaaatgcttacccacaaagcttctttttccccttaacactggatttgctaattgaattgagcaaatcctgaatccagctggatatctcagtatgtagtaacaccaaattactgagttagtactgaattaataatctgaactgggtgagtatactcactaactttactcagttactaaaaggctagtatcaaagctaacgtcagaaatgcccttctcatacagtacagcataaccaacaacagtagttcttgtgggcattatgctttcatgccaaccaagccacaccttgattttctgactgtgttgcctatgagttggttctatgttcatccattaataggatgttgacttattaataaatatattatctaattcttcctctacctctaactattctgtggaatagataaaataaggagtaaaaatactttcaattttgaagtatttgttaagtatcttggcatagaaaaaggcaagaagtaacatttgaaataaatttgtaacattatctgtgaattttatttatctatgaacttctatcagttttttataggaaaaaaaggggcagtatatacataattcaaataccaatagttggaacagaaatttttaggatttctagcacattctaagtctcttttgaaaaattataaaatcaaattagaatttaacaccttgcctatatgaatgtcataataatatagaattatatgaattatataagaaggaaataagtaatgacaacctcaagtaaacgttcacttttttcacagccaaattttgacttttttgacagttttatctcagataagaattcctttttcctttcaaaatatcattttcacaattatgctgtgaaatatgtggtcatctgatattataggaaagcagaactttaaaagacttagaactacattcctccctgttgtaatgagatactcttcacatatgaccattttttctggttacagtgtatctctgaatacttgtcatgcatcttctcctcttattctgataaagaattctgattttcctttgattaatccccctcctactgatggaactgacctccacaaccgggacacacagaggcctggtcagtcagtcacaattgactcaaggttgacctgtaatccaagtgcacacgtttcaagtcagccctgggttttccttggaactactgggagatgtatgctctcatgtcacaagaattactacaggcagccttgtgctgtctgagctttctttgctaccacatagagaaagtcttagaaacacagtgagacagaaggagagaaagagaaagacagagacaaacgctcaatcaaatcatgagagggcctgcagcaatcctcacaaccattaaaactagctgtatcctttgaatttttgagtttcaagatcctgcaaactgctattttgtttaagtcggcttaaattcagtttctattatttgcaactaaaggagaaaactctaatactgtatttcaccacatgaatattttcaatgttaaggaatataaaagaaatcttgatatgatgcaagttcactcttgcttacttactctttgctatctttatatttgattgacaacaagggactccaactgttgcttgttgctccactggggaaaatttatttattcattcattccttcgctcattcattcaacaaatgcttatttcacacccattaggtaccaggcacccacctaggttctaaagattcataactcaacagaatagacaaatgttctaccttcataaagcttacgatctggtgggatggagtcaacccttaattaataaataaataaaaatctaagtgtgctgaatagctacatgtgctacagagaaaaataatgcaggaatgaggatacagaaagtctgcacttgaggataggttttgattagttgtttttaaaaacagatggtcatgaaaggtcttattaagaaagtgatatttgagcaaaggcctgaaaaaaaatggagttccttactggggaaagtatgggtcctacaacagagaatagtaagtctcagctctgcagggtgcatggcaaattttccttacaggagttcacctagttacacaagagagaaactcccatgacaccccactagaacttttttctgctagctctctgagggaactgggcatatttgttctgtttcactgggcaaacagaaataggagttaggggtggctgtaggttccacgaatcattattattttcaatgttcactctctggcgtaaaggctgtgaggtgaattgctgactaattttataaagcacctggagctcctcagggcaaaggcactatgtcaacaccaacattaaataaatagcaataattggccaagtcctctggtggtataaggcaaataaaatatgttccctcttggaagttcatgacgtctgccaggttaagcaagaatgaggcaaagcacttttagaaagctactttttctaccattgtatatggcctccaaacagccagccactgtgaaatgttaagtgttcaacagcaaattaaaactgagtgtgtttttcattcactatcacaacaaggtactaaataaccacttgagatatttgttgtacgttatcattttccaggcagttttactgttagctagaaataagagtagagtgacattcgtttgattagagcagaaccattttccaccaatttttagagcacatgcaaatctctttagcaaaaggactttttcaagggttgaatctcttatagtttctcaatgtgaatgttaattaaagaaacctaccaaaaccaagaatgatttcaaatggttatagggtttcaaatggtagatgaaacatgaaaatatatataacctattaacaagatatatttgtgtctctaagaattctataggggaatatacatttcagtgaaactctgtacccacccaacccactccacagcaaaacaggcatttgtgagaaagcgctatatatatacacacaaacacacacatgtacacatgcacaatttataaataaacatcaggatgttaaatttaactaattttaactaaaacaagggatagctcaggataaacttggttttactctactaactccaaagttcaataaataataacaattttctcaaggttattaaccatcaatactcatagaattatgaaatatttttgctaaaagcatttagaactaatctagtatgattcctttatttcacagatgaagaaacgaagtgtcacagaggtctctttgctaggggtaatctatgtgctgaaaaccacctataacactttgaaccatacctgttgttggtattttgtgatgtccgtctacatgttttccttgaatgactatatattttttattataaaaatgggctctcattttatgtattttttattttttcatttaacataatgaaaatctaccatgttaaaaattatccttatgcatcagtatcctatcatacacatttaccttgataacatatcaaggtatattgtgctaattcccgctgctgaatatttggctcattttttttcttggcacattttcagttttccactataataaacattgatgtaactaaatcttttcacatattcttaatttttttcttaggataaattcttcaaagtaaaattgttggttcatagtgtgacttgaattctcttctagaaagctactcaaactttcactttcattgctaatgaataagaatgtcctgactttagtcaatacgctgaatttgttatcatctagttttgactttgttttttaatcttgaatactctttagagaaaatgttagttcactattgtttaatttgtatttctttaaagttggggttttattcatgtaactcaccaattgtgtttcttatggattgtgttcattttcctggaagaaaggtcatttttttccttattaatttctaagaatttttttttttttgagacagagtctcactctgtcgcccaggctgaagtgcagtggcatgactcagcttactgcaacctccgcctaccaggttcaagagattctcctatctcagcctcctaagtagctgggattacaggcacgtgccaccacacctggctaatttttgtattttttagtagagacggggtttcaccatgttggtcaggctggtctcaaactcctgacctcgtgatccacctgccccagcctcccaaagtgctgggattataggcgtgagccaccccacctggacgatttctaaggatttttaagacattaaagtcaatgtctctttagtaacactggaaatagaatcccacccttttcatttgcctttacgttttctttatggtgtttttgatgtgtagaaaaatttgattccttaatgtatacacatctatcagacattttcttcatgctttctcgctctagtgatatgcttagaaatatcctccctatgttgaaatttaaatactcatttttattttattttagtaattttaactaaactactttttagttgttacattaataaaattatatattatatattaatgaaatctttatttaaataaatatttaataaaatatatatccaatgtatatttttatataaggtttaaagaaagaatctaactttatattattttcccaaacgatagctgttgctttcaacaccatttattgaataatcatcccttttctcattgaataaaatgctacttcagtcacacacacacacacacacacacaaatacataaatgagtcttatttgaaatctatagtctatccaaatcaactttatctaattcttcatttgagccaccgtcctaattcttacaatattatatattacatgatatatgttactgtaatttttatgatataatctctggaatggtgtgttctacatccttccaacctttacccactgtgctttatttcaactttttcttgattttcccatgttagcttgatttttgaaatactttattaaaatcaaaaataaaatgtgattggaattgcctatagtggaatgaatattgtggattgtttagcattagttaagacatttttgttttcttcacaacaataccaaaaaaacccttctaatttcttattattttcactcataaatataggtgtagtatgtttttgtgactagaatcttgtgctatttaaaaagaattggccgggcacagtggttcacacctataatcccagcaccttgagaggtcaacacaggcggattgcttgagcccaggagtttgagaccagcctagggaacacagcaagaccccatctctacaaaaaatttttgaaaaactgtccaggggtggtggtggatgtctgtagacctagctactcaagaggctgaagcagaagaattgcttgagcctaggaggtgaaggttgcagtgagctgagattgtgccattgtactccagcctggacaacagtaagaaagtaagtaaataaagaggtattttatttttttcattataatatctaactgattattactttctataaaaaagctaatagctttcttatatgtaattttgtatttggctacctatctgaattactgaatcatttctaataacatttcaactaattcctttggctcttccaggtaaatacccacatagctataaagtcagttttcattttatattttatgtttcaagttgttgtactagaacaataacttgacaataactatacaacttcccaaacaaatattacatacaaatattatgttacgtcttattgcttataactaagctgactttaatagaaacgactcacacttaaaaattggtttcaccattgaaataaacactatattcttctgttgctatttcactgcatccttttaaaaaaaactaacaacaaatggatattaagttttagtcaaatgccactgtggcacctgtcaatacaagtctattgctttttctttcaccatattaatatgatggattctgtgaccagatttgatcaaaattaactatatgtacatttacagactcggccttatttgacatgagcatgaatcttttaacaaaatgcaagattcaatttaccaagttgtatttaagattttatctaccgaaaagtaagattggttgagggacttccttcttattgcaaataggtctacttgatagaatgaattgaaaagttgattttcttttcacaaactctagaaaatttatataacatactatttgttccttaaaagtttggaaacattttctcagaaagtctctgtgcctgacatcttttgaaggactgtttatttaaagcaatttttctaattttttttctgacagatatcgctttgtcaaggttatatacttcactttgtatcaaatgtggaaatatatatatttttgcaagaaggcacaatttaatcaggattgtctctctccctttccgtatgtacatgtttctgactcatcctaggcccctcactttccctcactcccatagaactgtttcaccaactgttaggtatgactgctgtctcattctctctcaccacagaaagctgggaaaggcattttaggaggtgagaaataaagcatcctctctcaagtttttgccatcccccaagagttatatgtggggtctccatgccaacagtccactcctctgagatggttttccctaatcacccgcaagtaacttttcacttttaactttaaaagagtgagcagggctccccttcctcataacctagctgcgaagcaatttaataggtgttccatgaaatttaaaagcagtagtaagattcctaacagagacactcctcaactttctccattctcacagcctgtctctagatatagggagttctttggaactaatttctgaaagaacacgtactttttcatattatataacattctaagccacattaaaatgaatgcttggtgagatttttcaagcagatatttaaattattgtatgccactgagaaagattaacagggcataataagctatacttaatattttaggaacgagtatagtaaactattgtttaataaatacaaggcaaggcaaacattacaaagtgaaatgtggaagaactaaagcttctaaaataattgaaccttccctctagcagcccctcacagagctctccgtcattaaccaggagtataaaaaatagagcaaagtatataatacaataatagctatagttttttgagctctggccacatacctggcataatgctagatgttatacacattagctttcttcctcagggcagccctaaggaaaaagagcaaaggagggctgatgtggtttatagctcccatatgccaggccccaggatggatgagtttgtaggaactagagtctcagatcctaagtccatagagttaggaagacacaattaataaggcaaagttcctgctcttgacattgtaccactgtttcaggtttgactcaactttttttctgaaaataatgattaactttttatagttgtttacagcctgccaggcactgttctaagaactttatatgtatcaacttctccttgaatcttcacaaccactttataaagtaagtatcatgatggcccccatccccctccattttttaggggagaaaattgaggcttaaagaagtggcctgcccacagatggcaagtgaccaggccagagtccacacccagactatttaactctagactccatttaactctagactctaagcttttaatcactaaactttcagaaatgtctaccaagaaagatggctaaatttggcgagcaatatctaaaatcaagtccaaaggaatatgaataaaagcatttgaaagagaaggctatgatttctcacactatgactagcatttttccttaggtgtcatctatgctgaatctccactgggcaggaaacacaatgaaatacaactgaaactgaatggaaagttaaccatgaaacgactggaggaatctcagtcagaactaggtctcgctttaccaagagaggtcagtcatacttgacaatagaggctttagggcccttttcgatgttccacaccataatttaaatgatgcagtaaaaacagaaaaagcaaagagttaataatcatctgaagaaatgtgcttccattctaaacttccaagggggttgggggtgtaagaagactaaatattgtggaaagcagcttggtgacatctgaaaaggctaaaaacagaactaccattcaactcagcagtcccattcctgggtatatacccaaaggaatataaataattctaccataaaggcacatgcacacatatgttcgttgtagcactattcaccatagcaaagacatggaatcaacctaaatgcccatcaatggcagattggataaagaaaatgtggtacaggtacataatggaatgctatacagtcatacaaaaatgcaatcatgtcctctgcaaaacgtggatggagctagaggcattatccttagcaaactaacgcaggaacacaaaaccaaatactgtatgctctcacttgtaagtgggagctaaataatgaaaatacatggacacaaagaggatcagcatactggggcctaccagagggtggagggtggtatgagggagacaaccagagaaaataactattgggtagtaggcttagttcctgggtgatgaaataatctgtacaacaaacccccatgacaggagcttacctatattaaaaaaaatctccatatgtacccctgaacctaaaataaaagttttgttttttaaaataagatgaaatgcatagggcaaaggtaaatctgtttgtggaaaaacagcaaaaggaagcactgtttcctggcaataagtataactcttttcttaaggtctgcccttctccttaccccgatctccaacttgttggaaagctaagattattgaccttctgtgaactctgtatctagttaacttctttcattcaaccctttagggactcaagcaaacagcatcactgacaccattgacagtttgggattccaaggtggctatgcaaattaatccctgtctcttgctccactcctaccctcatcactaatcctcacttctcctacaaaaggacattgttatgaagcatcctcgccttgttttcagcttgtgtgtttttgagccagagcttcattagaatatgaccatctgtgctccctgggaccttggtcacctcaatttatttgctggaagatgtggaatgatcctatttcacgtgaatatctagctcagtttcctctatttctctaaatgtatctcaatgtcttttgtgctttctggaaggtattagagtttatggaccttgctcttggttaacattaaaaaataagctttctacataatatagtgtaaaaaagctatgtcatttcttcacttttctgactactaagttctcttgagaggcagtgagtgtcacactgcactactagtggcctgcacatctgagacagagtatctcttacacacttgtgaattaattcctaacttctgtataatattctatttacattttttattcaaattctctctcattctctgtacatttctttagcacacactagatgtctgctgtgccaggtgactctcacttattcagcacagcaaccctaagagacacacacatttagtactgaaatattagagtggagagaacaatggtgaggcaatgaggttacatggtcacattcttaccttgggaattctgctttgctgtgaagcagtgggtaaagacattgactattacagcactcactgtttatccaaacagtatcccaggggagaatacatttcagggttctgtacgaggaaaacttagtctttcctgagaaatggatgttgtgttcttctcgtctagcatttcttttgttttcctgctaagtttggccaccacgtaactatgagatgggtttctgggctccttcagaggaagcactatgactcttattattgaaatattcactttctcttcacccaattttctctttttaacattctgaattaaaaaaaaattattgactttgtactttttgtaacttactgcaaatccttttctaaataggcagggcatgaataaagaaaggatggaaggatggaagggaggaagggaaggacaaaggaagaaagggagggtggcagggagaaaacaaaaacaagtaggcaaatacataaaatgacttaccttttgtaattttaaattattcaagtttgttttctaataaatataaccttaatgaaatgccatctctaaaaatcctttatacaaagcttttcaaataataaaaggaatacgagtaaaatgatgaaataaataaactttttgcagccaagaagtctatgatctaacgtttcttgttcactatctctcaaggttccccaagagtaaacatatgccataaggatttttgctaaatctagtcttaaaataggaactattctaaaattaaacttctacttttatccataaggccatttatatcattttaagcaatgttgtaacaactattggaaataccacatggtctggttttacataaatttgcaatgtatattatcctccatcaccccctacattggtatagaagcttgttccaatggtatcacatagtgagttttattttctggccaggttggcattttgagatctagaatctttatatgccacccctgccgccattgccgactggctgtgtgcctaaaagccagagacactgggcagggttaaagattgtggccaggtttttttttttccactttgtcaaatgtaaaaatacaatgatggtttgtagagtatacttcagaaataatttagtcagtaggtttatgtctaccaatatatatcctatgagttaatataagcagttcacactaacaactgtaggtgatgtatccttcttttagttgctgatactgtgagagaataaggcattttatttaattaaagaatgagctaaaatagcaatgtggaaatacagaaaataaatactgaaaccacacaatgctaaacatgaatcagcattcctatatttgtaagtgaagtcacctaaagggaagaaagtataaacagaaaaggcaataactgcatcagggaaaatgagaacctatggaaggaaaaagaccagcagtacctggattcagcttttctggttggaaaggtctagagacattaaaatcacacctgtttataaaattatgtatatttaatattggaatattattggtggctctagagggcatacacctggttgtacaggaaccgtaaggtttaacaatactactaaaaaaggaatgtttatagatttagatttattgcaaaccatgctttcattttttcttcctataaatctttcctgagcatctactatatattaagtgctactgtagctatggagatacaacaagacaataaatatgaacttttgttggagttcacattccagtcgaagggatatgaatattaaacaaaataaataggtaaattagaaggtatatcagaaaatgacaaggacaatagagaaaactttagcaggggagtctgggagtggggttagggattaaaactgcagttctcaatctaatggatagaaaatgttacattgaagtagctttggggtgaagccttgaaggaagtgagccacgcagataactgggtaaaagcatatcattctcttgtttagatataaatgtgctgagaaaaaaaaagtattttctatatataagactattcctctgaagcagtagcatgcagatgactgggaattgtagaagaggtgtcaatgccaacaatttgaagaaaaataacatattttaatgttgaaacaaatagagaaaagtaagggattgaagagatattttaaagagaaaactgaaggtgttaaaaatgtgcatctgataccataaatccaggctactcttccagacaccaggctcacatgttcaatttcttctggcatgaaaaattccagtggaaaaagtcaaagaagctcttatctcttcgctgaagcagtcatgctagggtaacagctgaattcaggaaaacttaaggaaactaactttcactgcactcatactatatgtaaaacatcatacacataatatgaatgtccaattttagaagtatttaaaaaacatggattttatatagctctaagccacatgaggtgtgtatgaggttgggggtagtgaagctcaaaattgtaagctagacacttcttgaaaaaaaaactaaatgcagccttcactaatggcaataggtagaaagagaaagagcatgagccagaaatactcatatttaaatcaaattatggctctgtgctctgtggtcatgaggaaactgcttaatatcatttacttcatttattaaatgagtctattagcaacaacacatgtcaaattcctaacatggtacctgtccatccttcaccttatgagattattaaattattaaattttgccttttgagcaaaaatattgatttattgaaaatacggcctaaaatatatgccaattatgctacttactataatagtttaacatacaacagcttgaaaatagtataattctttcttcacatgagccatgttatgatttccagtaatttgggacccactggtatgtgggattcattacaatgttcttcaaaattatttcatttattacatggactttgtttaaggaaacgaacagaaaaaaattaaatgtttgttttggagaagtttcatgctgttaacttcaaagcccctaagcctccagtggccctcttggatataagccacagatatgagcgtgaatgacgctggttgttctacatgaaacttcctgatgtgaaaacttttcacctataacctcaaaagtcagctatagctaatagctcatgagtatgtttccacaatactgaacattttgataaaatacactttaaagacttcctgattagaaaagattaaaaaaaaatgttttcctaggattatactggaaattttgagaagcttcttacagcactcaaaaagagttcttgtgtatttgttgttgtctggaacgacatcatcaaggatcaatcacattctttaagggctaagtacgttcacaaaatttccatttttctctccaaagcacatggaaataatttacatataaatgaagaaacatgccaccctttaaaaataccagtttcttgacatatagtccaatggattgctacaatttcaagtctttaatagattcaagttgaaaggaatggcatgtcatttgaaagcgtttccaaagcacaagggcagccttgttttgcaatgtttctgaaatatttggtttaggacatggcaccagagggcttggcagtgaatactccgaagaaatgtaaagtttaatcaatccatgaaaatcagtcccagatgtggcttacgagtgacaccatgtttttaaacataatctggcataaaaagttcaaaggtaatagatatcagaaatatattcctagtgataaaactgtaggtaaagtttatttaaacctttattatgaacccactacacgcattatctgttttatgtcttatagcatgtaaaaaggtgagaaaaacatactgtcctgaatatgctaccaatcaggtagatgaaagcacaaaaaaaacccattcattcattcactcactcattcattcaacaagtatgtattgaactccaattcagggttagatactcttttggcaccatgactgtgagatctggttcttgttctccgctatctctgcgacttttcatctttagtggggagaaaagacaggtaaacagttgattaaaacctagtaagaattaggttcaagttttcacaggatgtggtgaagctcagaggagagagcagagcactggtccagttctcaggtctggggcctggaggagaattgccaagggagatagagattgagcatagtcagggaagggtaatcccagcagataaagcaaactgtgtaaatacggggaaaagctagcaggaaacaggcaacaataaattcattgtttctggagacagtcttaatgggacatggcaaacagagagaggatactagtgagagagccaggtgctgcgttcctgatggccaaaaggtcttgttggagagtttgtattttatcttcagggatctggaaagccttgaaagatttcaatcaaaaagatatttaaaaacatgacagagtaagagaacactaagttcctcacttaaaagttatggcagacatttcaaaactgttcaccaatttccagttttcttcttccaaccccacaggaaaattgtacttccctgcctctttgaggttaacaaagttgcattgctttggaaaatgaaatatgatccacttttcggggtggaagcatttaattgtgacttctggaatctctaaccctttcttctgtcatggtgaaggtagacacctgtggtttatatggcggcattgcttttggcaatcacatggagactgctggcctgcggggttctcagatccacagtggggtcgtccgttattggagtattattttgcctaccatgactagtacacgtattcaagtaatggagatattcttataattaacaagctactagctctgatttgtaatttgctcaattagacaaagttaagtgtgttccttgttaaaagtattcacctgtctaaagtttcttgtcttagtaaagcaagtcaccgcttccagattttggaagtggtaattaacagcgttttgcttatggatttacttataattagtttttgtttttggaaatttgaaaaatgcaaagtttaaagaagagggtgtacatttattctaattacttttagaaagaagtagtacatcagtaatatggtctcagtgttaaaatattttaaaagggaccaggcatggtggctcacgcctgtaattccagcactttgggcagccgaggcaggcagatcacctgtggtcaggagtttgagaccagcctgaccaacatggcaaaaacccgtctctactaaaaattcaaaaaaattagccaggcatggtggcatatgcctgtaatcccagctatttgggaggctgaggccggagaattgcttgaacccgggaggcagatgttgcagtgagctgagatcgcaccactgcactccagcctgggcaacaagagtgaaacgctgtcaaaaaaaaaaaaaaaaattaaataaaatgtagattaactcctgaaagtgaatactgtacatgtttgcatgcattttattctttgtaccttgtgactgctggctacttactgccttcctcctgataccagtttttctctactgcatatgtcaataaatgtttagaaatgcttgaagaatacagagaaagcccaaagtgttttttgttttgttttgttttgttttgtttttttcagaaatgcatctaagtgtctccttacaaaatgagagaattcattgattagccattctttggacatgctcttaaacgtcctctaccagaaggaatttcatattcctatcacaaaagggaaattgcttattcttatgtttataacaccagatcttttatttgatatatactatgtgtatatattatacaaataagctctttataaaagataaccatgaaggaattatttcctgaaacggcaaaatataaatttgcctgtaaaatcagaatgccctagccaatcttttgagatttgaccaggatgatcctgtgggtaaggaaactaaccctttcaaattgcatgaaaattagaagacaaatgaagatgttgtgaatggaaattcatttccaaataaaccactgggataaaaatcattagaataatgctagtttcaaaatctatgtttttccgtctctttgtcactcacaattatttcaaatatgttcactttaaagtacagtatatatacctagttaggttgagtcatgttttagaaaaattccttagagtttgtttttaagcaaaacaggactgttttaaacaaagcagaaccttaacaggaaactgataacagtggccaagaaaagcatcttattttctattttctgtgtattagaaagaaaccctatttctcacttcctcatatggtaattatatctcggtggaattgaatcctcaggacaacagggcatgttattgtgagatattttacacctggcttaaccattctgtaaaatcagagatagtgactagcccagaggctctgtctcacttccttccggtgttgcttagctattgataaatattaaggtgcatgtgatttggctgctaaaatgaagaaaggatgtcagaaggctatcagtttgctgaatcaaacagcattgccacagggctccaagctggcagggcccctctgggcattgccaggtcaccaaggaagtggctgggtgaggtggcaacaggtgtcagacatgctgctgagcagatgatctcagcaggcctgaggacagaagagaaggttaccacacaaagtgcttagctgtgaccgcagaggaatttcagcatcaaaggaatttgagtagaaaaaggtttcaaatttcagttaacccagggttgaagcagcaggactcattgatagaaagagagaagcaaataaaagcccacactagttaacataactctcaaataagaatgcaattatctgcagccacagtagcccatggaaagatatccctaaccagtcattcagttgagacatagggacatcacctgggtggaaaggacccttacaggttgtgaaggaattataagtgaccattagtgagtggtcactatgtaccagacacagctgtaagtgctttatggccattaattcattccatcttcacaacaacactctgaggtaagtattcatatttgccttattgtacagaggtagaaatggaatcataaaaaagtgaagacatcagccctagctgatacagcaagtacagaggagagccagaatataaacctaagaagtctgtctgtataaaccatgctcttagccaccaagtttcaccatccctcacagggagaaaactgcagagcagaaaagttctggtcttactcctaagaagagatgcacattacatacatgaaaagataccaaacatgacaacatagaaaatgatggatgccaagtgagtgccaggaactatagagctgttgaaagagattcattgcaaaacaggttggaataagcaagacaaacttgagaagtggattctcacattgagtgtgaacaagcaggggcagtgtgatgtggaggaagggagcatgtactctacaggctttagcttcagaggggcttgggttcaaatcccagctctgccacttacaagtcatgtgagcttggggaagttacttattctttgttttctagttttcctatctgcagggatagaaaaatgctatttcaaaacactattcatgaagatcaagcaaaattagttataagcaggtctcagcatacttggtacaaggtacacatttaatatgtgtactattatccaactagggagagatagaaagggagcttcaggtgagaggaacagcataaaaaatgatccgcaaaagccagaaataaaacttctatgagctcagttcaagctgactgggtaggtaaatgtctgccatgaacttggaagtgagagagaatctcccttggacactcattaaggggcctcaaagccatgaagagttgccatgtggtccttccagtcaataaataattttgtccaaacacgagtggaagaaaaaattaagagacacccggatggggaaaacccattctctttttggtgagacaatctagccagaaggacactctcgccagctagagctctgcatatccaaacaagcacaggtaaagtggaagaactgaccagaagaggagaaaacatgaattaattaattaatcaaagaaacacctgtaaggttccaagtaggtggcaggtaggctgagtgttagtgtatccagtcaggcaggtggtgatgacaaagggcccccaggaaactcccatttgtgtgagtgagaaaggcaagaaaacagcatgcacaatgctacttgaggagcgatgtttgaaaaagtgatgcacaggttgcaggggatgcacagaaactagggatgcagcactggagtggggtgagaagcttccaagaagagacaagccttctgatgggtctcaaaggaagaggagggtctcaccaggcaaaggggttgggggacacattctagtcagaaggaacaccatggacaaaggttgatgaatgaagcagaatgatatctttaagaagctgcaaaacactttccaccaggagggtgcagctggggtgtggcacatgaggttgtgaaatcaggtcctaaagaggctggaagaatgtgtaggaaggagatgggctccgcttggctcttaggtctctgcagaaggaaagagaaggagaatgggacaggtggtgagactggaggcctgtacactatttagaaagttactgggccaggcacagtggataatgcctataatcccaacattttgggaggctgaaccaggaggatcgcttgagcccgggagatcaaaaccaacttgggcaacatggaaaaaccctatatttacaaaaaaataaaaaatgagccaggcatgttggtttgcacctgtagtcccacctacttgagaggctgaagtgggaggatgccttgagctcaggaggttaaggctacagtgagccataactgcaccactgtactccagtctggatgactgagtaaaaccctgtctacaaaaatgctctaaaacaacaaccaaaaaaacccagaaagttactgcatggagcccagaggagaaatagttgcagcatcactgggaggtgtgggtagtggggtgaaaaggctatggcgtaagcctggtgaggaaaggcaaagcacctgatgctccttggcttcaagtacagatggcaaagcaactgggcaaggaagtccctggacagatgctcaggatgattacagcttcagaatgctgaagtgcagctgtgcctatgttttcttcctcctgtcctctgccacactgtccttcgtcaccctctggggcacctcccctcatatgagaattgagaaatggagggagagtacatgagtagtggggagacaccaagacagcagagcatagtgaagagaggaggagaggggaagcaaaacttaaaagagactcaatgaaactgggagtgcttttgctaatgccactaggaaaaagaaatgtgaaaataaaattttatatataaatacaaacacatgcatatgagtgggtgggttaaactactataccacctcttagccagaatgatcttttctaattagattaggaaatgaaagtgttagaagactgaatgggtaacatttgaattttccttttgaaagatgggccatattttgactttagaggaaacacagatgggaagtgcattcttgatcttggaaatgttgtgatgatccatcactgtcagggtgaagtaaggatctttagcatggccaccagagccttatctcccacctctgtgcctgcctccaccctggctcttctgctgcctttatattaaacatttgttcattcaccacataaggttctctctcttgccttcttttcctggttaattcttactgatcctgcaaatcacagcctgaactactcatcctcagagaagacattcctgattttccctgaacagataaaaaaacccttcacagatttttgaaccctgtgtgtctttctcccgtagcatctgatccagtcacagtttcatgtgtgtgtgtgtgtgtgtgtgtgtgtgtgtgtgtgtgtgtgtgtgtgtgagagaatgagagagagagagaaagagaatttgattaatgcatgtcttccccagttaatcataaactccataggggcaagaaccatgtctgatttggcatctacgaatgagtgatgaatgcaaataatgtttggctatggggggatgaggtgtggccatgtaggaagatgatgtcagggtgtggtacaaggttaaggaagctgcagctaaaaaggatgccaacttaatctattttggccattttgtctaccctaagtattatgttcacactgtatttcttctttctggactaagaaaaaaaaaacatgtttgcttgtggggtctttttttccttctaaaatattagactgcaaacaaaggcactgttgggtagtatatttttgttagcacccaaggggaaatgactgtgttcttgggctctccaatttttacattacatgttttctacatgagctttcaacctaatgtaagaattaaatgcaaatttgaggcatatgaactattttatgcaagatcttaaaattgttttccttgggacgttcattgaaagtatggctcattactgaaaatctattcttcagtgtgttcctaaccatctagccacgtcaaaaaaagttgctttaatatctgaagccaaatcgctgctttcctttgtgattacaaggactctcttggtaaatcagagtatggccaatgtccagttgctaaaggtggaaactacaagttactattctccttaagttaccagcaagatacagtcaacatgtagttctttggtgtctgtcaagaaagtacagagatttataggtaaagaagtcaattttcttatcatagatatagttgtcatatggagagtatgctgattagaaataatgaaagcaagagataaacttaaattgtggaattatctgagaatttccattatccatgtcccaagttaactgcaaacaatataaagttgactatatcaatttttatgtacagaaaaacatttgggacacaaatacattttaaaatcttaagagtttgcagggtaaaaaacattttgggggaaaaataatttttctaagggtttgagaaaaattcagcttatatttatgtatttcaacttcagtaaggataaatggaacagcaccactggaattgaacaattaagtaagcaaatgatggatggtagtttttcactgttggagtggaagattatagataagcaagaggaagaagctagaatgacccatgtggtaatgagttagatttgaaaatatcagtatgaactaatgcttatctatctatcatctatctatttatgcttcctgattgttagatatgtgtacatacacaggttggtatacacaaatatatgtccttgctctgtcagccaagaaggccaaaaggaaatgacaacccaaaaacaatgaacacacctattgctcaaatcttggtttttaataccattttccaatgaaaggaacgtgtgctccttggagaaatggctgaatctatgatgaggaaggagttatattgttgataagcctcaagtattgtgtaatgctagaaaggatgaaagtgcatcaaaacaaaacaaacaaaaaacagaaaacaaaaccaccacaattgtggggatgtatcaaagggacacaagaaatagtacccaatggccaaagctggaacaatttcacagcacgattagtatgacagtagtggattataacctaagcataaaataaatatccatgagtccatactgatatacataaatgctgaataattaaatgagggagaataagcaaatcttctgtggagaagaattgcaaatattttatgtagattctctgccttcaaggagatggagtataacaccctcttaagtgtgggttgtttatcatgacttccttccaaagggtaggtatgaaaataataaaaataaggaaaaataatacatttatagtggaaaaacctgaccaaatccacctcgatcaggtgatcaaggttaacatctttagtcatgttgacagtgtgatggaaaaatggcacattaccctctgtggtctctctccccaaaacactaactacagtctaatcatgaaaaatcaatcagaaaattccaactgagagacattctacaaaatacctaatcagtactcctcaaaactgccaaggtaatgaaaaacaaggaaaatctgagaaaattctatagcaaagataaatgaaacacgagaactaaatgcaatgtggtatcctgagtggggccctggaatagaaaaaaagaaccttaggtaaaactaaggatatatgaatgaatagggactttaaataataataatgtaccaatactggttcattcattgtaacaaaagtatcatactcatataagactttaataaaaggcagtgggtgaggggtatatggaaactccctgcactatctttgccatttttctgcaaatctaaagctgttttaaaataaaatttatctttacaaagccctgaaagcctagaaatttaaagtaaactcgtacaatcaaatagtaaggcctaatcttactgacataagccaatatttaattttctaacccaaaatacaaactcttcttcacatgttaacctctatctccattttctatgtctacatttctttagaagaccataaatcacgctatattatcattaattagagccaagttaaaatgttaaaattgctaaacatatgactcatttaaacaaaggtttactaaaagacaggaaacaatttacaggaggtatgcattttctgcatggttgcatctttcaagaagacaaagaaagggattaagaatacctttgtcctaagatacaaaaaaaccacaaggcaaaaagtacgacatataaagttttacaccaaacaaaaaagagaaaaatttcagcaaatcaatgttatcatctacttatgattttttatcattgcaaacaacgcatgtttgtccatccttacttcgccacctggaccaatgcaggccatgtcatatgaaatgcctgttctgaccattagaacatccagactcattctggggcttaatctcttttactgcaggtgcatccacttgttatatttcagattagcagcctcaaagaactagcctcttcccagtacccatccttcaattactgcatcattttctctaacaattgcagtctttcaaccactttatatgtgacaaggcatgagcttgcttcctctcttgtcactctcctgagtcctcttctgtttgtctgcagcccaaaaggaagcacaatattccagctgaggtctgaatgatgcagggtcaagtgcattcattacctctttattttgggttattctggttctattaatacagcttaagatgttatgtgaaatttccaaaataggttccatattttaccttcaaaactgtatggcagacacaaatactacattatctgtgattaccgtgaatgaggttagcacattattatgtggttgtgaatatcatacttggcttcctggagaccgaatattcatgtatcagggccctcctgtgatgacacagtcagtggcgccctcacaagggcataccttctagccttgtcttattctttaaaaaaaacccacattctttctttgttctagctacacagctggaaaatcagaactgaacataatagtgggaagagagtactctttaatctcagtatttaatctcctgatactttctggacctctgaaagtattaatacatgcattcccatgagaaatattattgcttctctaataaataaggatgtcatacaaaattaacaaattaataattcaaggacacattcgggtgccaaagaatacagttttctaatttttacaggaaaatatgtaaagtaatataaaattttcacttgtaaatagtgcaaactgtgttagaaaaaaagacaatgcagatgagagatttccttgaaatgctcttaaaatcatgttattgatccgtgtaagtcagctatatcaattctactgatcaagaaataggtattttaaacacaatgctttcaggagtatacaatgttgacaaatatgcaaaaaaaaaaaaattgcaaaactccaagaaaatcaaataatgaatgctagccaaatttctatccgaactaagctaactcaatgatattatcgttgtctttaatggagaaacatgaataaggataatctttagtggacttagattaagtaatacaatgaatagctataaaatttgtggatcagaattagaagaggggaaaaacacattaatcaagtagacatgttaacaaaataatggattagtcaggattacatttgaataaattagcaaagcaaaagaaatacattaaatatctaatatttagtaacttagaagagaaaaaaatgctgtgtattttacatactaattcatacacatgcccaacaaataactaccgtttccagtcttcatgtgcaccataacatgtgtaacatatgaaacaaaaatttgctcctccctgatgtatattggtatgaaaatcttttaaggtaacatgagaatgaaagagattcttcttcatgctagacatagaggtttttaaacacatcatttggctgacgtaaagcacatttgcaataggcattagtaacctcaagttaagaacaatatatgccaggctgatgtactggacacttcctaaatactgtactcagcagttttggagcacttagcaatgatgaattggtgtgaagactcaggtactgaaaggtcatttccctttttttcttgaatcttttgcttgtcttgattgacgctctgaagaagccaaggatacagaaggggtggagaaagcacgcaacccaaattacccaaaggagctgcttataatgaacttgaatgaagatagattttggggagaggtgggggaaagtggccacaatcttcaatattcttttgaagtgttactgctttcaaagttgtgatttttctcaaggtaaagctgtttgacacagatagactcatctgtcaatcaaacatcttttactcatggccaggtcaaatacttgactattctagtagtggtatcaaactcttagtgccaatataaaacagccaactcacctagccagggaaaagaaataataagaaaatgaaaaagtgcactgagcctttatatcctgtattcaagaactgcatttcttttttatttagttgttttgtcattgctgtttatcagtttttgtttttgttgttttgttttatgatcaaatagttttagggggataatatataatagccatgtcacacatttctgaaagaacaacttatttcacctggccccataaatggaaatatttcataaattccagaagctttggcattcgtctacatcctctttccagactgcttgctatttcataatcattttcatgattctcattttccttatgaattgaatttgtgcttgaaacatttcaagcctagggaagcaatcttgtgagctgacagatcttattgggagcaaccttgttcagaattttgacttccacttccactcttacacaacaaatgtccacgtatagactcaacatttgcctcaaaaattcaagtctccttaagaattacaaaaggttgtatcaccctgtaagactgttgccattacagatggcataggactcaggattctaaaatctagtgctataatgggctataagttgggttaaagaagtgagaatgctgtgcttttaacttcaaaatttggcaagacataccattttttaataagaaacatattttttatttggattatccttttcttatactatctattttattatactttctttaatagtatttaatcagattttaatgaaatctggtacacaggttttttgttttgttttgttttgtttttgtttttgtttttgtttttgagacggagtcttgctctttcgcccaggccggactgcagtggcgctatctgggctcactgcaagctccgcctcccgggttcacgccattctcctgcctcagcatcccgagtagctgggactacaggcgcccgccaccacgcccagctaattttttgtatttttagtagagacggggcttcaccatattagccaagatggtctcgatctcctgacctcgtgatccacccgcctcggcctcccaaagtgctgggattacaggcgtgagccaccacgcccggccgctttcttttaattataaactaacaatagtatttacaattttcaaagaactttcaaatatactacaatcttccacagaaatccataggggaaaaaagggacaggagaggaactaaaatatatcaaacacactaagttgagcagataccatgatttatatatgtatatcattaatctttatgcacaacttaggacaaatttctttctgatcttagtatcataagtggtgtgcttccctgatccatcaaattgtttatccaatggacacggggatttgtgtttaagcttcctgatttaccctggatcctaggaagcttagtgagaactttacattccatcttgcatacccttggacttcatggtctgcttaactcttgaaagatggaaggccctctgcctcccttgagatctaaacaaaattgatttgaacttcctaatttcatgaccagtaagaatcccaaaactcacctctaaatttctgataatttcctaaaggctgggctcattgacctgctttgccaacacaacacagctcattttgattcacatgccaccaacaccatcaaaatcacttacttcaggtactcctgaggcttcaagtaagacatacatatattagtggtcttcccacccctagcaactccctgtaccctccccaatacccctcacccaccgaaccactgtcagtactggggagggatctgtttatggagtatacccgcagttctcagccttcccagggcgaattttcctcatcctgtcctctctcctaatttctctgcctcatctccatcattctcattggctctttagcactaaattcttcttctgttatgcagagaagttttcacccttagagcacttgagcacctacctatagtcagatcctcagggactttcttcctatcccaagggcacgttcaaaatagctcttctaggccagctgcagtgactcactcctgtaatcctagcactttgggaggctgagatgggtggatcacctggggtcaggagttcgagaccagccaggccaacatggtgaaaccccatctttactaaaaatacaaaaattagctgggtgtggcagcttgcatgcgtagtcccagcaactcgggaggctgagctaggagaaccgcttgaaactgggaggcagaggttgcagtgggatgacatcacaccactgcactccagcctggacaacaaagggagactctgtctcaaaaaaaaatatatatatatatatatatataaaaatatatatttatatatatttatatataaaaatatatatatttatatatatatttatatatataaatatatatttatatatatatataaatatatatttatatatatatatataaatatatatttatatatatatatatataaatatcttctagcaaagacatttttcttccttccccaagaggattctggtgccgtttgtaaaggtaatatatatatatatattttttaactattacatacatatgtgagtaggaacatcataccttatttctctttgcccttcatcaacattctccctataagttatgcacatataactttgttggttgtcttaaatgctgcctgggaaaagctgcggtttaaaaatgacaaattaaataatgtattatctcattgaatccttacagtaaatctgggtgattggaactgttctatttttctcttataaatgagttaagtgatgctcataaaaggtgatttgctcaaagttaaccagtcagcatcagagttgaatttgaacttggttcaatacagctttaaagcatgggatctttcccttgcattgtactactggttaagagagagaggtatgaaaccctcgaatgctttatcaaaatatacctgtcacttcctcttcctacccactcttcaacctccagattttcatactccttattactttccccccaacaaagtcttgcagttatttctgataaatgatacaactgccttccctaatgacattctccaatcctcaccatctccatcacactgagaactatggctttttaaaacattgaagttaatttttcaggatgttctctgacaaaactacatataatgatataaaatagttattgatactctttcataataaagtgagaataaaacctcattctatacatatatagtgtgattataaccactatactaaagaattgatatatttaaaaactcaaatataggatatgtatgctagaataatgagagaaattaattaacactgataatattaataaaaattatcatttctacaatgagactagaaaggaggaggccagatgaggcagagctttatgctgtattacatataatacaaagctagtacattttcttggcaagtgaagagatattagggagatgatttttagagcttagtttgacagtgaaagatgtataaaaagaacgaagagccacacgtagaggctggtctatgtctgaagaccacatcatgtactgtgatgaaaagtaattaaaatgaaacatcaatgttatagatgcagaaaggggcataatcaagcatcagagccagctgtggagataatttacagacttttatctcaccagcaagataaaacatacatatcttcaaggaaagaaagattcctatatgaaagtgaatgagctagttattagttttgaagaaatggtgtcttagataaggtgatttgtagcaatagcatttagattttacagatacacccagttcggcaggatggttgcttctacaaatccagttaaactctcccaagtgacagaaatcaagatatgtgggaattatttatgctcaagatgacaatttttatagaaacagtatctatccccccaaaaacatgggctatatcctaaaaacctgaaattaatattaaaagccgtaaattcccaggacacaattctggaaaagtaatgtttactctaaaatcattttattgagcacctactatgtgtcaggcactgtgctaagaacagagaatctaatgaagcagggcctgagtaagacagtcataaacagaaaatccatcctgtataaggtaggcactgactcaacatgggagggcacatcagtcgattcttgctgaggcttgagagatgaggaggtataaattatccctcataattcaaacttaacccaaggtattgtccctgtatttactgaacaagaatgtgatatagaagaggcagtttagacctccaagcaacctatagttaatgggtaagatctaggttggaagtggcctgccactgattaccctaggcaacctggttaaccattcacagctagttgcctaatctgtactataacaatatttattggatacttactgagtgacaggtgttctaagcactagactggttttctcatttaatcttcacagcaaccctatgcaatgagaactatttactgtccctatgttacagatcatggagaggttagataagtgacccaaggttgcacccttagtaagtagataacaagcccttgccacagacttgggggatgattaagtaaaatgatgtctataaaaaaattagtctatacttggaatggataacctgttaaatgtgatagttattatctgtattattttttatagcatacgaccctaccttatctcaaaacatagcacaataacattatttgaaaaatataaagttatttaattaaaatttcccctgacaatataatttttatttatcattcttttctgtacacataattatttattaagaaaaaatttaaaaagtacctattaagtacaacaccatgctgggtattgtggtataaagtagaaaaaagtagtcgaggtggctactgcaatgaatagaacagattataatgttaatacctggtctcaaaggctagcttggtctcagaaagttctttgaagcaaaaggttgtgtgcagtgaagatctcacagaatgtggtcaccctttcaaatgatgacatcctgaggcaacttagcattcaacctctctcaaaaatcaaatctggcacagattattttctaaaaaataggacttttcccacaaatattttcttcttttaaaattaacacacccaaaggtttaagactcaaatgccttactttaggacttgtaagaggtctctttcactgatctcaataccactacggttttctcaatttgcccactgtcacattgctagctttcctttcttctctagaacatcaagggactctccatcattacgccaattatttgttttaaacatagtgagcaacccaatgacaaggttcttaagattgaggacttcatatcatgttatttccttaaattaaatggaggatatatgaaaaaggaagggcctgagacctttatcaagagaagagttgggaagatatgagaaatgtataggttgcatatggaatatgttttctcaaatactgtggatatcagcattaacgggcataacgctgctgtcttccccatgaaaaaggctgccatttaaagttaggttttgtggagaaggaattaagcaaaatacccaaggtagacaggctaaggatattccataggagaggccaaatacttgagaaaagcatcagagctcagtcctggaggtgtttgttgatttatgtgtggtttctctgcattacctttaatggaagaacaattatgcctgaataagacagaaatgagtaaattaactaggtaagatataagatcatagatttttatagcaccttagtgatcagttaagtcaaccttctcattttcatatttagaaaagaaaaatatggagactcaagggagaggaagaatgaagttccctgacaagtgactaagacttttagaatcttatttagagttttagagccacagcaaaaattctacaaagcaagctctgtataaagtagtggtgagcactgaatgctgacaataatagcggaagctctgctgagatgattagaagagatgaaaggaattcataatattggctaaagtcacagtatcctccagggtttattctcatgacctagaaaattataaggctatttaataatatcccttaacttacatattttatttgtcattttctcctatttatcttggagacataaaagagaatttaaatgtataaatatttaaactgggttacatcagttctggttaaagtcatattatgtttccttatttccagtacatttctcagagactggtgacactttcaagtaagcttcatagcggttttgaagaaatttttgtaaaagcaggttacatatatatggatttgtgacattctaacataaaccacagaaaggttcctattaaaaagggagcaaagctgaatcattttggcttttcttcccactgtgatttttattcatttgaagataaaattcaaagcaaacatcttaaagcttctgtttgtcacccaagagttatttcaaggcagcacaggaaatctcacattttcaaaaaatcaggtcatgaaaatggaactgcaatctaattaatatgttcataaaacagtttccaccactaccaaataaaacaacaacaacaattaagatcaactctgtattctttggaatcccaagaaacacaatccataggagacattctcatcacaaaacagtttcaaatttaataattaagaattgtaacatttctgtcacatctctactcatttccctgacataatactttgtgtaaataatttctcaagtagagtaaaacgtcttttattgactggatatattcattcaacatcactgacctttttccaacttgtttgactgtcttgtactctctcttcaataacctttccaattccccctagtagctgttccatcatcttactaagctcctccacctgctcctccctggtcctctttctgagatgtgatcttgaattccatttaatacttcccagagaaaacacagggcataaaacaaaaactccctcaggctctccttccacctacctaatctccacattatctgcattctccctccttttcctccccctatcccagagggtgtcatgtccacaagtttcccagctctgtatcagaatatttccttagggacatgcttcctactcttaaaagtgcttggtgttcttcactagctactgtgtttttctcctctccttctcctctttcctcctcttcttctcctcctccttcgttcttaagcaaaattttgaaagaagtagtttgcacaacttttctctgcttttattacccctgaaatataacttacccccagacactcccttaaaccactctctgaagtattatcagtaactactaattcccaaatccatcaaatatattttcactttgaaacttaaggtatttggatcaagtcagttaagttgtttctccttctgactcctgtaacaacttgtatatatctatattaatatgctccatactatactgtaattatttgtttctgtggctgttctccagactagtttatgagtatctccaaggcaggactcttattacattcatctgggcatcccctatgaataaataactcagtgtgttccacctgttccaatataattcactaaccatgacatttttcagtaactcagaaattgggctattttatgattaaaatgcttctttggcaattggatctgatttcagataatactaatattctttacttgagcacaaaatgaagtttaaagacatacaattagttgaatattttgaagaaagtaataattatggcagcaaaacctaaaatgtggatgatcttttatttttggcaaagcattctcaaaaccatttcatctgtcacaaagtaaagctggagcccgtatcaaagcagggccagagataggcagtttgaacagggctcaacaatgccccgcagagatggtgaatagagctgaattcatctatgctccacacaccaagtgtgtacccagtgggaagagtgacttttgctttgaacagaggctctgtccattcaccaagtactgtagtttgcatttctacttcatctgttcaaagtgtgacacctttcctaatatatcgtccagagaggcactttttagtgaaaggatcctataggccacagtgaccttggaaacagagttcaccacaaattccttttaaatttctcattctgagaaaatacagaaagagctgctgacacagtctaagtataggtcattgttctaacattaaaaggaagagtttctcaaggaaaggctattcacattcagtaagcatcctacatacttagccaggctgctaaataacagggtaaatctgcttattttctctggtctactgctaatctaattttcaaaaagatccataaacaagagtgctaagtcatctgccacaagaacaatatggtggattaaaaatatattgggctctaaaatcaggccaggcctggttttgagtgggtcagcttccctagcaatagatatatgaactttcagcaagttatctaatctctgtgaacattaccttcctcatctgcaaacagggatttggataagaaattctcagaaagttatattgccattaaaggatgtaacttatgtgaaaacatatggcatgcagaggagtgctcaacagtgttgatctcttccatgaagtatatgatagttatacaagagattttggcatgtcattgtcaacattctaataaattcttcttttatttttttgagacagggtctttctgtcttgcccaggctggagtgcagtggcatgatcatggcttatcgtagcctcaaccttctgaattcaagagacactcccaccttagcctccctgagtaactgggaccacaggcatgaaccaccatgcccagctacctttaaaaaaatagagagagagacagggtctcactatgttgttcaggctggtctctaataaattgttattaccaatgtgctatgagattttctttaatagcctacttcttaacatgaagtgggtaaatatctgctgtaatagttttcaaaagtggtaaaaactcaaagagctttcagaaggtcacacaaaacattaacactccagaagctgaattagaaacctggagtgctttttttaaattatttttttttagtttatttatgtttccagccaatagcctgattatgtagactctagattatctatccttgaaatcatatatggagagatatatatgtataaattttacacaacataatccctagttgtaatatattgtcttgggtatgtttataggctggtacttctcaaacaactggaaacgtcacctaatagtccatcaagttataagcagttgcagcagttatggcttggagacatttttgagctattgcaaaaatgtggataatgctatagctagacagagtattaatgagcattaacgtttgtgggatatgattgaaagaggagagaaaaggatgagggatttttttaaaaaggaacattcgacctatggcaataaaaaactggttgtttagtttttttgggttcttctttgcatctcagaatttgaaactattttcaattttcctttacttgcctatttttctctgaacccaaatacctcaacattagtgtaagtaactcagtaatagtcaactaaaaggaagaagcaaaaaggagtggaaagtgaagaatttaaaagaagctaaaacatcatacattgttagtaaataattttcatatgatgaggaataatttcttatttttttccttttgtaagatttctaagacctccctggcttatgccactcagtcctttgaagatgtaacctcacagcgatttaaagtgcacaaactattttactacagcagaaaggctgctaggactaaagactatttttcatttccataagttgtaagcacattgatattactaataacaactttgctcctctatcatagcatacttaatcgaattatttttaaaaacactaaaacataaacatttgtaatttcatttttaaattccaaggtattactagaaaaaattaaggggcatacagctgatggcaacaaaagacagtaaaatagaaagccaagagaaaagttttatgtttaataggatcgatatctcatataatggaaaatctttgctacactatatctaaacctgaatttctgccttaaacaatggctgactttaacattgagccctagggatttgtgaacgagatgagtttgtataattatgagctccatctaaactttattggtcctaagtgtttacaagtaaattgtatttggccccaacaggaattcagaattaagctggcagtctggtatttatattttagaatttctgggttgttctgtaacccagaggaagagatgttaaagaagcaaggtcagctattacctgcaatttcactggaagacaagcagacactgcaataattttaagttaactaaaaggagcaaagctccattatcttacatgagacttgatacgtcatttccttcaacgtatacatagtcatcaaactcaatattgctcccaccccctaaaattctaataaaatataatgtattggtcagaacacatactctggaaaatgcacttctggattgagtttctgtaatttcaatgtatgaagaggagaaaaccttaaaagatgaaactctatgaggctagataggaaggattatcttttcattagaaggcaggccattctgactttctctgaatacgtattcattatattagtagatttaaacacatatacatgcaaattatgaacacatatatgaatatattatcaatatactgatttatatcttgcttcattccataaaggatttagatcaaaacagaataaaacagtatgagttagtttatgaattgaatgcttggtctatagaggaacaatcaaacaaataactttctagactaaaccttttagaaattgatacctggaaaaggacagtctaatgaaagaatttagggtcctagaagaaggaaaaagatgcctccatgttgagtgaaagtgccacagtcacctcattttgcctcttcactggagttacctctcagcatcacaaagacagtttaaaacatttagatgtcctacctttaaaaattaaaccctaagcaccaaataagcaaatcattaatcaccttccacaatcattaatcccaaatcttcctctggtgtcctcagaggggccctccatggcagcattccacagcctctcctagccagggcctttagcttctatcttccactgtccttttagccatgtgaatccatcattaaaaggatgcaaaggtatttaaataaaatgccctcctaaattgtttagctatgaaattcaattgcattcaacatagccttgatgtttctggcatgaaattatagtatttttacaaataagattataaaaagttgttatatatcttttaagtcaggcaaaaagctgaacatgttagtcacactgtgttaggtcattcatgttagaccctggcatgtgattccaggtcataatgcttctaaaggtcctcttaactgctgctacatgaaatttaaattcctagaaagctgacttgcatttcccttctttcaaccatgccatacttgttcctgaatgccaggctatctctccattctaacaactagccagaaggaaaaataagaagagctatatagtacttatctatccagtgaggcaaacccttatctttgtttggcttggcagtaaaaagactgaaaagtgtaatggaaagaagccttcgcaataaaatcctccagctaatatttctaatgtagcttcaaagaagaaacacacattcttcataccactcttttagcacggaaggggtagtgttctattaaaccaagtaataggaccacttattaactttaactcataactgataaagagtgaatttgtaatactattgctcaataatcaacacaccagccctagggcaggtggatgagagtacaagtaggaactctgtgcacaggcttctatttcaattactacttctggtaaaatttgaagactaccctagacctcctgtgtctcagctttttctcattcttgcttctcaaaaagcaggacagaaagaggaccagcacatgccaagtcccgcctctccaaagggtacagagcctttctagagatgagctagggctcgtgaaaccaaagcacatatgtcttttacaatgtttattattccttagcactggcctgttgccaacttctgatcggtcccttcacgaagaaaaggctctaaatgtgagaatgaggatagggggagtctttggagatgaaaagagcaatttggcgagacctttattctaagcacgataattcacgagcctgaaatctcaccctataggggctcttacagtaggacaaagggaaagagggttttctgtcaacaaacccctacaatctcttactgcagtactggaaggggaggctataaataagaggaaaacaacaaccattgagaaagtcaagaaccaagcacaaaattaattaggtcacctggaaaaaaaccaccaccttcttcctttgagtccaacatcatattaatgaatccctgcaaggggcccaggaagagtaggagttatacagagcattaacattctacattggcttagtttggccacaacaacaacaacagattggtacgacatgcagtgaagcagatgaagggttacctaactccaggcacaaaagaaaaccaacaggactctcaacttctccatacagctttcaaacatatgtattacagatctagaggagcatgaataagcaaatttgcattctttccaaaacttcagagttgaatagcttatttctttccagtcaaaagtataggtgaggctaatgcaataaaaataaaaagtgcttataattgcaggcattcaaagagtacatggatcctatgtattacaacataaacaaatgggcttaaacagcagaacttaggtagaacaaaaactgttgctttgtagcaaggtacacttgatagaaaggagactggtaatttcccctcccaagcaaatcttaagaggtataaaatgaactctgaagaaaagcctaaggcatagaagaaaaataattgacaaatgcctactacgtgccaggaactgtttccaggatcttttaatctcaagattaaagactattgatgtaaatttgtctgtaagaataatgaggaccttattgctgatgcctgaccctcaccaacagaacaagcaaggcaatggcaccaaggctccccctgactaggaaactctggtgatgcagttggaagtgggccaccgaggtttgcaggcatgtcacccaagcattctagagactggggatagtagctctggtcagcaaaaaaggtagatacgccacagcatcgactctggatggatctggtgttgttagaaaataagcacctgcctagagtgggagaggatgcctcccatccttctctgcaatggattttttagctgaaagccgaaaactctgtaacaaaccagcaggtgattttggtggtaccttaagctctcagggagctttcatttgagacattgtcataaaagcagctggaaagccctccgaaacctatatttaggtatctattattcatccagagtccagccagaacatttacctgaaagatatactttcaaaatcagacaaactgcatttccaaaacaacccatgttagcagacactaagccttaacatgtgcctttattatgcattcacaaagtttctgctatgaaagtcagaatccagctgaccctaaaggtatggcaaaaacaagcaattttaaaataatgaccttttgctcttataaataccctcagcaatgagttcctacacacatttagtcataaactccagcaagaaatggcacatgatatcacatgtccagggacctgaatgcattgcattgaaccttaatagatgaccaaatatcaaggcactaagcaagttctatgagagcctgagcacttcctgattcatatgttagaattctactagaattctactggttcattctggtagaaatatttcttgaatagctaaaatatccttaactgtgaggcaccaacacattttagcattattttaaaattgagtcaacattctaagtttcccttaaccttcttttagaaattcagacaaattgatatatcagaaattcatgtgtgcccttccccagggaattttcaaataaaaatagcaaaacaacaaaaaacaaaccctaagcctcatctttaaaaaaatttattaaattgttgccattctcaaagtttttttcttcctccatgaaatattagcaatttaaatgttctcaagtcctcatgcttgacttatttggggatgcttcatattaacaaagtatttttattgcataaccattactttctcagacaatattcggttttgcacagtttacttttcattctcacttgataccaatactctagttcaagacaaatcctcatctggtacctgtcacggaatttgataattctgagttttacaaactgaagggaatattgattactcaccatatccaggaatgccttctaaagggaaaattattcacgtgcatcatgttcgcagatcttctgtcattaatatttttcttgtctcctacgttacatgtagtgatttttacagatgaattccaactctcttgtttgagcagctatcgtgggcaattattgcaacaagtattgaatcccaaaaaaaaaaaaaaaatctccccccaccaataaaaacaaatagcaattacaaaaggccttccaggatttgaaaaaagaaacatcacagagcactgcaggtatgggtccatccatttaggttccactagttagtcaacatactaaaataaccagttcaactaataatcctaaatggtggcaaatattgtcctggtaaaatctaaccgccttgagtgtaaattaatgcatccttaaggaaggactctggaatgtgggaagaaaggagtcaaaagacagtttcttgatatccttgttaaagaagtgttagaagggaaatggaaaacttcaggttgctttgccatgctgtcctttagaaatgaatattgctttttcttctttcttaggcacatattcatgtatggtcactttaacgcagtgctaccgtctgagacgtgtcggacaaaggcctgggcagaggggctagaaaccatgtatcaccaaagccaacttctttcccagatttcagaattgctggttcaactgcaaaagtaggaaggcaatgagtaatttctgctctgcaggacaagattaccattaactaccatcatgacttcagaagatgctgtcacgatgaaattcatttctgctgcctaaccccataataaggctggctgttctctttaagtaaaatgactaagctattgatcttttcactgcagaatcccctttattttgttattatcaaaaccatgtgggagcttttcatattttgccttggaaagaaaatgaatttcacagctgcaagtcagacgttgtctaagaattcttcccccgatgtctttcttttcttttttttcctctctcaatctcttttgtttttcaccccaaattcagttttccaataggtgtcatttattctgatgctctgacatcttctgaaagattctcatgcccaagctatacagaccttgcatgcttttaaaacacaatggcaacaggctcctgctggagtcccccagcgccgaatttccagcagaacctttggaatcctcgcagccgccttgtctgccctgggctgtgccgccccagctctgatcagctcaggacacttgcaggctccgtggtactgtacattaactctgcagcagcctggctcagctgcagagactgctgcctgacaggggatgtgctggcgtcaagggggccctctaggtgggttcccagacattgcagagccgcgcactccttgctaacctccaagtaagagcaagcaaaaggggttaaaggaatagctcgccctggaagagcagacttctttcagtaattaccaggcaagaaaagctaaacaaggagaagcctgtaaaacacctcacagggaaattacgccttaaacaaatacggagggaggattttttgtttgctcgttttccttcttacccagtgaaaaaaaaagaaataaaagaagtccagagataatttgcaaatgatagagtttggtggatttcactccttaaaaaaaaagcaccggggtggggaagccttgtttacttgatgatttgtaaccatttagctgcagatgaccacatggtgatttttggacaggaaatcctatggaagccggttctgcagaagtcagttgtacttcaattgcaattgcgcatgccataaaactgcttgtttgattagggggtgtgtagatatgaggaatgctgagataaaacgttgcaatccctatcactgatgttttgcatttcttcatgcttgctcctttgttgcaaaaattctgttcaataatcccccaaaagcaccccatcactgttgatgccattttggagcaagaataaaatagtaaactcttgtaatagtaggttggcacttaaatggtatttgtttgaaatcagtgggagaatggactttgcagtagaagtacactcaacattaatataccacttttaacttaggtatttaaaaaggcttttacgcaattgcttgatattaaatggaataccggcaacatttaatataacatgctattatcttcatttaggatttccccagtgaggtcctgtcattgcagaaaatattacccaagattgggtggagggcatgtcccataaattcaaaacctagtataaagaaaactaatcttaaaaaccaccataatttggagaattttcattttgatcaaaagatgatcctaaaaggaggattcctaggaggaagaagaactgggtgattccttaaaagcaatgtgaacttgtaggttcagaaagatgccactacagcataaaagaatcttgagaatatttgttgagatttcctgtagcctaggcagtgtcctcatgacccctttttgctaaagggactaaatctcttccataaggtcatttgtaatctggcccagaaaacttcagcctacattgtttttaacaagctttgaatgttttgaatcaagtaattaaaattttgatattatattagacatttaaatattattatttaagagctaggaacatctacaatgccccaggtcccattctaagatagttacagtattaccccatttaatccacacaacagcactatgagttaaggactgttactagccctgttctccagatgaggctattgaggcactcagatgttaagtagcatgtctgaggttaaatatctagtgagtcactatctgaatcaaggaagtctggctccagagcctgtacacattaccacaatattctagcacctctgtaatcataataataccaccttgttatacttttatactttctaaaatattattgttatatgtattattttggcatcacagaattatgctgaggagattaagacatttattatgcccattttggagatgccaaaaagattgtatttgttcattatcaggcatcttgtgagcagtagatctggaagagaattcaaattatttgactctggttagtgatctttgatcatgatgatgataatgatgggttttaattattttaaaactaacattcagtccttatacaagagagtaggtctccatagaaagtagcaaatgcaaagattttttaaaaagatgtaaaaatatattttcctttgtaatgaacatcatttatctgacattattttcttagtccattttattctactctgttcatatgtcaaaccatcacctatgggtgataggatagtaagaatacctctgaatctttctccactaccacacagttcaacattcaatacttgttagctacatttccatttgcgggcaatgatataagcaaagcactttataaataaaatacaaatgatttggccattaaactactaaatatacttaaactaagaggacattttagctgaatatttttaaagtgaattttcgttggatttttatttttatacatgcaactgtctagaataaagtctaacaaattagaacaaaaggaaacacaactgagaaactatgataaataacagaaaagccaaatttctgcttgaaagatagcaaagaaaaaactgtaatttatttcacagttcagagaatcaagactacacattattaaacaatccaaaattgaatatttttgcagacataaggcaacaaatataaaagaataggcttgcttagaaaatagaaataactcatttccagcattttattccatttatattagaaagagggtcttaagagttatgtctactaatttataggctgatactttacaaatttaatacttcctacatgtatggccttcaagaaacaacagttaggcagaactaataggtttgtaatctaaaaacaagttgtcaaaaatgaaaaaatgttgttgggttagggtaatgctaatctattttgttacactaaaagataatcatcctttcatgaaacttttaagaaatatcaggaagccagttctggttgctcatgcctgtagtcctagctacttggaaggctgatgcaggaggataacttgagcccatttcaagaccaggctgggaaacatagactctgtctctaaaaaaattaaaaagaaatatcaggagtaaccataaaagattatctttatggctaatctcagccccattatttttatcaatacaggagtgcgaattattagcagggcaccacaaattggcataacctcagtgaagtccctgcagctatggcataacctcagctctactagagcaaagactggtttgttgttttgttttgtgtttttttttaaattttaatcccacagcaagcacaagagtaagtgaacttatattaactacccttaaatgaggctgattcaataaaaagctcaattaattgataaactacaaactcagagcaaaccaaaatactttcaacattttcattgaaagatcgcttaatgcatccagaatcagagccagaagtattaactagccggtgtcccacgtccttttccaataaaacccttttctctcatggttatagggttatgctcataagagtgaaggttttcaaactaagtttctgggaaccctatggtttttcaaagttgcatcaggtcagctgaggggcaaggtactttgtgctgggtctaggaagccaggtactttgtgctgtttcaacaagagctcttctgctttaactagttttatctcaaagtttgataatacatacaaaaaaagtctggctctttaaaaaaaattacaaaaatgtaacagtagaaatacagaattaatactttctacacaaattcttatctctgtaatatcagtttcagtatttcatcctcttaaaatgccttcaacttacacacttccttcacaatgagcataaaagaatgattaagttcaacctttatgctagtataagcatagtataataaagtcacaccctagttcctgaggttgggtatttcctagactctttagtcacttgtacttatcagagggtgtgatgagttacttcattgattttccctgagtttcactttcagaaagtaactttaatgtcaaatgttaaggtatatttttttgtcatcattgcattttggtataatcaatagctaatgtcaatgtttgcctcttaaataacttgatgaaataaaactcctgtatatttagacatcaaagaataaagacctaaaagatgacttatttatcttatatgaataccaataatcagttcagatatttttggaaagtctccattctttcaagaggctggattacttttgtcccttagatgtcaaaaacaaaacacttggtccctgtattctacatattgggttcatataaatatatttacacatacaaaaacttctatgtacttttcttagcacattctatatactattaataacagtataaatacattatacacaaggatatagaagctactgtcacctggatatcttgcaggatgtgactttttgcctcaagctccccccataaatatatattttttaccaataaaaaataaaatttacatgagttttcacatgtgtgtatgtatgtgtaattatacatttttttctttttattgcatatatcatcaactaataaagaggtgagtgtgccatcagaatgagacctgaggtggctgtgcttccaaccccacctcccagcaagaaaagaacattcaagaccaaattctctatctcacctttacagaaagccaatcccccaggaacagaacagtgtcttcttctctatatttataacaccaaaaacattgttggtactcagtcaatgttaactaataacgatgttgatagtcatgactttccactcctggcaagttctagcaaagtctgaaggcatgctgttctgaacatttataactgaaatacgagaagcctttcatgaagccgcagtttcagttgctgagagtcagggaaatgcatcatgtttcagcaagttgctagtagctactacattcaatttctacatattctcataacccagggtacaatcaccaattagaaaagaaaaaataaattcattaaacacctagtttcatcacctaaaaccagcaaatgctttgttgggacttttcatgattcaactaatataaaaagccattttggatcatactcctcaaggttaaatcttctaatcttaaatgataaattcttttacagaagaaaaatctcataatatgaaatatatttcataattggaatatttagaatgcttgttaaattttacttttaattttttttttggaagtagaagacttaaaagcctaatactgaaatacaaagaaggcacttaatatttatacttaagaatcaaaagtggaaaaatgttcacagcaagtttaaagacaaaaaagtcaaatgtgtataccatcttggagtcctaagatgtgaacccttattttcaggttctgccttttactttttgtgtaattttgaccaacgcatgaaacctctgtgagacacaatttccttatccgtagcatggaagtaatacaaacacttagattattataattttaacttattataatttaaaattttttaataagaagagctctttaaatgttgtttgcatatacctttaaaatttgcttagtaaaatataataaaatacagatcatttgttttgcaatttactggaatcaaaatggaaaaaaaagaaaaaatacaaataatgtaatgtcaaaactaccttctgaaatggaattacatttcatttatatcttaagcttttctaaaggctttgtataatatttgtttagaaaattcaaaggagcaaaaatatttctcatgtaataaaataaagcccaacttcaaaacttactcatattatcagctgggcatggtggttcgcacctgtaatggctctcaaaaaaaaaaaaaaaagagaaatgttgtaagaatgcacacttattctttcatttatcctgattagatgtatccaaaatagatttgctttcactggaaatttaattgattgttactgattgataatttaattaaacttctgatgacagttcttctatcactcaacctcccagtaaaaaagtaacataatccagctttcagttcctcacataaggagcttggaagttgccaatctgtcctaacaacaaaaaagctgaacaaactgaaaaatcaactcttcttagatccataagagaagtgaggtcacagggcaaactgctgcccaaaccactggtgagatagacagtaggctatggagaatcacaacataccggagcagaaacctccaagagaaccagtgctggggtagaaaaacctcaactataattgacaaatcgttagaggctgagtgcaggcaagtctgaaagttgaaaaactccagaggaacccagtaatagggaggtccccacaattctgtgtgttttacctccaggagtgctaccaagttctcacagtaaatattggagaaaaattctctcatgcttccagcaagagaagggaaaaagtacacatctttaaatctgctgaagcttggttcttcctgaggagaaactagttaatcagagcctaacctgctggggttttttgttccattttgttttgttatattagagcctcactgacctggggaaagaaaaatgcccaactccagcccactctagcctaccatcaaggagaaaggaaatactcaattccagcccacgttagccattctctctcacctatggtataagaaaaaaaaaacctgaaaaacacttaggagattcacaatccagaggcccaggctcaccaaaagtctgaaacctaattatggaatgatagaaagcttcccctccactgccccttaccacaccaccacccacataacttttttattttatttatttatttatttatttatttatttatttatttatttatttggcagagtttcgttcttgtagctcaggctggaatgcagtggcacaatcttggctcactgcaacttccgcctcccgggttcaagcaattctcctgcctcagcctccccagtagctaggattagaggtatgtgtcaccatgactggctaattttcgtgttttcagtagagatgaggttttaccacattggccatgctggtctcaacctcctgacctcaggtgatccacctgcttccacctcccaaagtgctgggattaccaggcatgagccaccatgcctggcccacccatataacttaaggcctatttacaggagttccttttatccagtacatgcccagctatgaagaaaaaattacaatgcatagttaaaggcaaagaacacagtttaaagagacagaagaggcatcagaactagacatgccagagatgttggaattatccgtatgatacaaaaatggaagatatacatcaatataaatttgtgcaaacccatagaatatacaatactaagagtaaattctaatgtaagctatatgttttagagataatgatgtatcaatgtaggttcaattgtaaaaaaaaatgtaccacttttgtgggggggatattgataatggggtggctatgcatgtgtgggggttggagtaaatggaatatctctggacctttctgtgaattttgctgtgaacctaaaaatgctttaaaaaataaagtttttacaaagttacatgacaagcattaacattttatacccagaatatgtacaatttttatacaatttcaaatttatggatgctaaaattgctatttgtaatgtcaatagattccattttctttacaattgcttgaagcaaagatgtaattttatcaagaatgtttaacacatattttgacaatctatttataaaatctgaaacttatcacatagtttcattttaactagattcaatatcatttaaagtttctttttaaagaggaaacattatttcatttaggaaaccatgcaagttcaacatgggaaatacaaaaataaaataaaataaacacacaagaaagaagcaagtcatccataattccattcccaaaagacaagtcagtatacttctttccagtcttcctcccctccaggaatagtgggtttaccaccgatttttatgttgttgtaagaatatttcaccgacctctgaatttggtaaaaagtactgcctggaaaagaactcttttatttgccagatggcacatggtaaagaaattaccatgaaaatactcaaacctctccactctcacaggtttactggggaaggcagttcaatcagatggggcttacaaaagttattattctctttaaaactcttgtgatgaatttttaccagtagatgatctcaagagggtattcctctggatgtttctattcttaactctttagttttgatccacctttaggtctgcttgtatatttctttttaaaaatcttaagtagtatatcgctgcatatactactacagtagtaggacatagtagatgtattgtatggtccaggtaaaactaagaaattattcttcctacttttagaatggaatacaatgtgtggtccaccatatatattgtcaatctaatttaacgcttctttaatattctgccagtactggtttttagtgctttttaaaaattatatatatatatatttttgcagtgttttcagtcactttaataggaagctggaagaggctgcatcagaggctgcaggtaaaatgccatttaaaatccaaaggccccatccaccacttctaacccatgcacatatataattacacatcattggcagttaacagagttaggtataaaagcaaatatgactatgttatttacaaatacatatatttgtatatatttataacatatgtatattacatatatatatacagacacatatatgaaacattaaaaatgaaaatatttcatttagaaaaccatgcaagttcaacacgagaaatacaaaaaaaaaaagaaacacacaaggaagacacatatacatgtatttttatttcggcatcttgaattgactacgcagagacattgccactccatttttaagttatttttgaaatagatgactaaagattatcatcagcatgtagtggggtacatgctctaggggtagtggggttttctggtctgttttgtccttggtatatcctctaatgcctagaatagtatctggtgcataataaggactcagagtccttattatcttgacattgactttgttaagtattttattatcataaatatttaataaatgagtctctataccaaacatgattacttatgtctgcctatgtttccttctaaagaccttgcctttcctacacttcaccattataaaatctgatgggaataagcatgataacttgactcactgacatctgattcatttactaggcagcaaatattaatatttgctctttggaatgtgaaatgtcctaagtgaaattgagactctaatcagttcaaggtggggttgaaccaaaatgtcctgtagactcaggggctgaagttaccattttgggttcagtgcaaactgataactaaagagacagtggcaattacagggagaaggcaggaaagaacagaaacacagagacaaaaagaaatcggtgattgtatggccccaaagagagtagctgccttaatttcagttttcctaatccaataggccctgctatacttgtttctgttaatttctgtatcttcatagtaactatgttcccccttttctacaggagctagtctgagtcagcttctttttttgcaatcaacattgtgatgagtcatcatataagaaaccttatgttgctattcataaattatttccttccctcctgaaataaagtcatttaaaattaatgctatattgtaatattgaatagctacaatgaatgaacttgacattgaattaatggttacatgatcaagtggcttaaattaaaatgcacagagtggcgttaacaatgtatctacatctacatccacatctagatgttctggagactgttctttttctctgactgacatctattacacttccaatcaaaatactagcttctcattttctcgaaccccttttcacagttttcttcattaaatgtcagtttgtttcagataaggagaggtgagagagagagaaagagagagagagagagattttggaaaaaaaagaaatactgtgatatttttagatttatagagagaataatttagtactcaaaaggcagaattcctttttaggaaaaaaaggatattcagataaattttttcaaataatcatttgaaagcttaaaaatataaaaatgtatttaaactagaacccaataatttagaataattaatagtttcaaagtcactgtagtataattaagtagaataatctttgcattcaagtgtagaataaattcaaggctagttattaaatactagttgcccattgtggacagatgccctctcattcacctagcattttacacactcttccttgctgtttttaacattctgactcgagggtgaatctataatgctgagcacttgaaacttttaactcgcctacctctctctataattggcatattccattcctaaaaaaatcgcaatagactatataaatcacttaataggcacaacaaagcaaaacatgaacaatacacgtcccaaactgatgagacacaaaactattaatgtgaaactgaattgcctagctctgtatcttatacttttctctctgggaagcacatttgaaatgtgggaaataattcaatggggaatataatgtgattttatctgttgtttttagttccaagatttgtaaaatacataaagacacaaaagagctttaaaattttccacaaaataaagtagcaaacctgatcaaatagtaaattcatttttaagatttctcctcttttctcactgaccctccctttccctttagattagcaatcaaacagggactggagcaaaaataaaaagcaggaagtgggcaacatagcacatgacaaaaaaggattttgttgtcagaatcctcagcacgttttattgatgtttgaaattcccaactcattttcaaaatgaaaatgctacaggaagcaggaacaaagttaatgaaaatataaatgcacttttctcctcgtcttccataaccactcactgattagaggcacagtccatttgagatgaggctgctgcctgtgtgtgtgggagggttgaatattttttgctctgggaggagcaactgtgatagccccaaatccctgacagcctctcttcatagactgcaggtctagtgtgcaggtgatagtgctaaactcccagtccaagggagtctaaaggaggaagccgtgaagaaaaaggaaagtgaaacagtggactaggacagaaggacattactattaatactaattttcagccagtgcagtggctcacacatgtaatcccggtgctttgcaaggctgaggcaagaggatcctttgagcccaggagttcaaggctgcagtgggtgacaaaatgaaaccctgtctctagcaatataaaaaataaaaatcctaactttcccattccccccagtgacctgctgttttccacaccttgaatgcacatctcttttgggatccatttgctggagcagaggtgttttaaagatcagaagcatatttgctaggaggcataaataattttcccctcaaatattagagtaagaaaggggaagcacgcaagaaagatacaaatatgatatggtattgtcaaggtagttaaaaatatttgtaaatggatatcaatattgtaacatatttgctgaaaatgaggacatgtagtagatagcaaaatgctgttttttgctttttctttttttttttttgagctcttgttgcccaggctggagtgcaatggcgcaatcttggctcactgcaacctctgcctcccaggtttgagtgattctgctaccttagcctcccaaagagctgggattacaggcaccaccaccacacccagctatttttatttatttatttattttttttttatttttagtagagatggagtttcaccatgttggctaggctggtcttgaactcctgacctcaggtgatccgcccaccttggtctcccaaagtgtaaaacacattttatttgctttcaaactgtccctttaaactttatttataaagaacatcttatgacttttctgggtactgttaggcaatagagacctttgcattcatgctaaaccatcatctcagactctatccagaaattagaatgtccatttcaaattgtaacccaaaactctaaacttgattgaacttacattttctcccctctcccagctgggcccaccacagagtctctgtgtgcagtggagtaagtgggtggcattgagactgggttgctcttccccttccttggctatccaggctggctagccgttggtattgactcctctgggattggaaggcacagaaagtggtgaggaaaggaagaaaagagttttgttttgttttcctgaattagtgccatcgtaagatggcatcacatgttggagacctggcagatgttgaaagctgcctctttgtctcatggtacttttgtgggttcataattggtatccctgctgggtcctctggctgcaactcctttgactcaagcaagagccttgttttccaattgctgctgattaaccagcacccccatcaaggccttggttttctagtggttccatccctaccaactcttgctcttggagccaaactggctttcccagatggtcctcttgggaaggacatcaaatggctgaaggccaggtctctctttgagcttaatgtgagttagataactgcagcccgctttaagagagggtagggttggactcacggcactactcagttctctctctcttaaaaatatatcttcacaagttcttgctcaggcatgaaagggtgcattttctgcctttggtcctggtgtctggctatgactgtccatcctgtgtaaatgaggagagtaagtctgagcaaaaggacaaagtgctaagatggcaaagcagaacctgggtgatgtgtttgaacctcttaataacctaccctggaatagcctaccttgaaaattcatgttataagacagtacattttcctcatttgtttttgttaagccattaagttgggggctccagacttgcaaccaaaggcatcttaacttaagaagtttaccataaatatttattataacccacacaaggggatgtctcagtaggtaatccagttagacagcagaggaagtttatgtttcctcacttttcttcttctttccaagtagctggtgggtgagctcatctgctacaaaacacacttcaaaataagatctttaagttaattttcaaattgaaattgctattattgaaacaacagttgtgatagcacctgcgataacaaatgtaaataaaaacaaataaaagctatgctcaatttgtggacccatcatttctcagtaggcttggatctctagagttcatggggagacccaagaggtttctaatattacaatgtattaccaatatccagggcaacaatcacatttcatcttagaaaatcagaagatgatgtatgtgccaaaaacctttggaaattgaattgtgctttatgctgaattctgtttggaggatctagcaaggacccattttactgttccatcctatgatgtgggtgtgcttatattaaatcactttcagagaaacactaggtgactaatttgtgacaatgatatgtttgcagactaacacattcgtaagaacagcagaataatgagctaatttgtaacgtaccagatggaatgtactgaaagctagtggcctaagctatcataattgtcctttataatccaagaagtcatttctagtaatcttgctacccacaacattgtttttatataaacaggtcacagtagaactaatcctcttcccgtgaaggcaggcctctgttatttcagtgtgcttgcaactggggagctgctgcagtgtgtggttctggtttgctttttttttttttaactcctatgtctgaatggcaccctataatgagggatcattaatcttaactgttctgtagcccatgtcattgttgttattttcttttgaagttgtttcttccgtaatttacacacatttaggtatattcaaatttatacttgaactgtctttctttttcctctatgtttgtgtgttccagctcactgaaataggaactgaatcctcagcacttttgagactgcccatcccaaatcaatccagtgattactttaaccttcttatcattagtctcactccctctcctttcgtgctcaaccaaaacttgagatttataaatctgaaccccaatttcagctctttctccattacatctcctcagagccccaagtgtaaactagctaacttgtactgctaggttaatagaaatttttctaaaagaataactaatatcaattttcctcaaactctttcaaaaacttgatggggtggaatacttccaaactcattttacgaatctagcattgccctgataccaaagccagagaaggacactacaaaaaaagaaaactacaggccaaagtttctgatgaatatagatgcaaaaatcctcaacaaactagccaactgaatttaaaaacacaataaaaagactgttcaccatgatcaagtgggattcatcctagggatgcaaggatggctcaacacacacaaatcaatacatgtaatatatcacattaacagaacaaaggacgaaaactatatcatcatttcaatagacgcagaaaaagcacttgacaaaattgaacatcctttcataataaaaacccctcaacaaattaagtatagaaggaatgtacttcaacaagcaaaggccatatatgacaaacacatagttaacaccatacttaacaaggaaaagttgaaagcttttcctttaagatccagagcaagaaaagatggccactcttgccacttctattcattataatagaaattgcagtatacaaaatcaacatacaaaaatcagtagtgttgatatacactagcagcgaactatctgaaaaagaaatttttaaaatcccatttataatagttacaaagctgtataacattaaagatgacacaaatgaatgcaaagatagttcgtgttcatagattggaggaattaatattaaaatgtccatatctgaaacaatctacaaaacaatctacagattcattataagccctatcaaaattccaataccattcttcacagaaacagaaaaaaacaatactaaatttcatatggaaccacaaaagacattaaatatccaactcaaccttgagcaaaaagaacaatgccaaaggcatcacattacctgacttcaaaatacacaacaaagttgtagtaaccaaaacagcatcgtacttacataaaaacagacatatagaccaatgaaacataatagagagccagaaataaacccctacatctacagtgaacttattttcaacaaaggtgccaagaacatacattggggaaacacaatctcttcaataaatggtgctgggaaaactgtatatccacatgcagaagaataaatataaacctttatctcataccatatataaaaatcaacctatagtggatgaaagacataaatgtaagaataggggaaaagctatatgacactgatttaggcaatgattttttgaacatgactccaaaaccaaaggcaacaaaagccaaaatagacaagattgcatcaagctaaaaagcttctgcacaacaaaggaaataatcaactgagtgaagagacagcctacagattaggagaaaatatttacaagctatacctctaataaggaatttgtatccaaaaatataagaaactcaaacaactcaatggcaagaaaataaccttattgaaaaatgggcaaaggaactaaaaagacatttttcaaaagacttacaaatggccaacagacatatgaaaaactattccacatcactaatcatcagaaaaatgcatactaatactacaatgagctatcacttcatacttgttagaatggctattatcagaaagtcaaaagatattaagtgttggcaagaatgtggagaaaagagaacccttgtacactgttgatgggaatgtaaattagtacagccattataaaaaatagtatggaggttctttgaataattaaaaatagaactaccatatgatccagcaatcccactactaggtatatatccagataaatcctgcatgatctcattcatatgggaaatttaaaacagttgagctcatagaactagagattagaatggtaattaccaggggctggggcaactggaaatggaggtgcaagtgtgatattgatcaaaggaaacaaaatttcagttagataagaaaaataagttcaagaaatctattgtacaatatggtgattctagtcaataacaatatgttgtattcttgaaaaatgttaacagagtggatattaagtgttttcatcacaaaaataaccatgtgagttaatgcatgttaattttctagatttagtcagtctacaatgtatatatacttcaaaacatcatgttgtaaatgataaatacacaattttattggacagttaagaatatagatataattttaaaatttacttagatgtatatcaagacatgccatatgtttgaatacagtcttgtaaaaacagtttttctgaagaaagcgtggttttctggaaggagcacaggcttttagtatcatcggacagacctgagtctcttattaccactttatttacttagtctcatttcccaaccttaaccaaatcttaattttttcgtctggaaaacaatgatacatatctcctagatttcttcaggattacattagaaggtatagattaaatcatgtagcacatgcaagtactcaatgcatagttgtttcccttgattcctcagatgtttgccatttaacctgctgactgcaatggtgagaatgttaaattagggaagcaagaaaacagcagtgtagaaataggagaaggatgaataacataagcttctaagaagcaattattaatgcaacgtaagctgggagggtcgactgtaaacagccatggtatggttttggtatcatttgccttaaggagagtctataaattagagtaagaccaataacccagaagaaaaatgggacatggatgcaaataaccatcacagaaggggaactataaatagtcaaaagccatttgaaaagatcttcaatctcactgataaccaaaaataaatcaaactacaatgaggtattttgcctatcacattcgtttaagattttttttaaaagactaaaaatatgcagattgtgagggggtgggaaacagtacacccatacacagttgttagaaacatggattaggagagacattttggagtacaatttagcaaatttttaaaaatgtaaaccatacataccatttcagaacaattacatttgtaagagtttatcctacaaaaatgattgctcaagtgcacacaaacatacacacacatacacacattcattttggcactgtttataagaccaacaaaacaacaacaaaagtctgtttctttctctctgaccagatattaaattcctggggagaaggtcagacctttctacctcctccccagtaacttccaaacccgtaaacatgtaacagggttgaaggtgcttaaaactgcatattggctgacaaaacatcagaatatttttattatgtataaagacaattatatagatttataaaatttgtaactgacttgctatttccaaaggtgaaaataagtattcaataattggcaatgcaaaagtttatttttttctatccattggaaatttgtgaacattttacacaataattgagttttatcaactttccaaatataagtatttcttatttgtatttcagataataaatttgttatttctagagacttaaagtatttaaagaaaatcaaaacatcccatcaaacacaattttgttcttaagtctctctttcttcttttattctccaaccctgcctcccatggtatatacaaagctttgctttgctgccagactttctctaacatctaaaaagtgtagaaagcaccgttattataggctaaaattgatctcatttatcccaggagtaccaacattctcaaacaggggttcaaactcctgttactataattcttgggcctgttatttcaatgagaatctaattttcttgcaataacaaatggggagatgggagacagtgtcttccaattacaaagaccatgctcctgatattatcagcaaagcgtacctctgggtcactttcaccagaagcaggtttgggccttagttacaccctctggaccaaagtgatgtgaatttaagtgtatttgttagtgaactgtctgatctgggctatggaacagactaaatggaactaatccatctaaacgggaaactcattagacaggtagtcagcctaacttggctactttattacagatagatccaatattaaaaataagatccaatatttaaaaataaaatagtaccttctttttcagggagaactatactaaataagaacagttgatatacatatattcatatgtagatgcagacatatatagatatatacatatgtatatacatgaatatacatgaagtaagagtgttacagtattctcagagcaatgtgctaggaaaacaccctttcatctatgtgaaccccagatcaactcgtataaattctgtatttgtatgtttctagcactataaattgagctgagcttctcaaaagaatacattgtattaactaaaggaattcaattaataattagcaaagaaactaatcagctttcttccacataccatttagaaacatgcaacagcacattggaaatggcagcaggaggagagtgaaataaagttaatattttttcaagtctgtcttctggggaagactttgtgcattgagacttagacaagttatttcctttaatacaataaccttataaagcatgtactaatattccccagtttatagatgatgaatctgaggaacctggagaggttaagttacttgcccatggacctggagagtaaatggctgagctgtgcttggacaccaaaacctacctttgcccaccatactgggagaccagaattgtcctgtggattcggagaaggctggacaggactggttggaggggatgcaattatggaaagagtagatggagtaataaagaacataaccttcgtaagtagtaaatgccaggcactgtgctcaatacttgacttgcctttcctcatttaatcttccacaaaagtactactagtttgtccactttacagtgaggaaaacaaagcacagaatagttaagcaaatcacccaaagttacacagccagttagcaagtcttacaattaattcataatattatttcattgtttattttccccatattcatctctctttttgttttctatttctttcttacagaagggggggaaggggacatgttttataatttactgatttcatatacctttggaagttttagtgccttttggttaaaaagtaaccaatatttttccctacgtttcagatgccaagaggctatttagagatattgggaggcactttactgacgttctgcttatgtcaacagatacgcgtagaattaggctgtaatttgattcctaaccctattgatgacttcctaaaccctcatcaaaaacattttgttttagttccccatatgcaaaatcaaaataaagaggtgtctttgtttaaaaatgctaatatatgatttggcaaaggctgacattttatcttgtctccttggctgctgttttaggattattcatctagcactgactgagtgcccagcatccatgcccctcccctttcctatttattatcaggctgctgcagtgcagcgttgaaacatctgatcatttagatcattaaaaatcaatccaatgaccaaatagttctgtacgttttagagaaatgacagaaagtgcagtattagattgctattaacttgctctggggttttctttttacagctgccaggaaagtcatttggtaaaattgattaaaccagcatgccaaggaggagagcggaaaagagcagagaaatgcaaacacagtgagcttggaggggagggcaatgtttttcttgggaatgaagtgagatgtcagtagaggaggcagcagggggtaggtgggaggagaaaccttgcatatagtgagcatactataattagaggtacaagagattcaagatggtaggatacaaggaaccacaatgcggaaacaataaaggaaggaagaaggaatgaaaaggaagcaagctatccatgcgcttctaacatactgtctgcattggttacactgcacagtttgtctgaattaatccaagagacatcactggtacaataagaagaagctgatttgaggatttccatagataaggctctttcaatagcaggagtaggtagggaagagtgcctagtttcctacacagtgtggtttatttctgtaagaacaattaatgaagaaaagaaaataaacctctctacttgtgctcaataggacgatgagtgcataaaaattcacacatgccttcccctaatttgttattatagtggccatacatattccttccctccaaataggaactgtgttccccttacagaattgcatttctcctttaacacgtttcaacaattttttgattaatccgaaaagaaccctggtatgtgaaatcagagagtgctgacaaggatggattttaatgtggggtttctgccactttgcctctatttctaattcctccctatgtcctatttaaagtcacacttagctcacacagcgcatgcttctagagaagaggataagcaaaaccatcaagaatttatttgctgtgtattatgtctgctaacatttcaagtataacaaccacctaaacacaagggacttaaaaacagcattaaaactttaaaaataaagaaaatattctgtggatgagtgcatgtatttccttggatattggacattgaaaatgataagacacaagaaccatttaattgcataggagaacaccaacactagtctaaatgaagtaacccccttgagagaagttttaaattgcatttaccctgtcctgggtatgctacttggaagaagctatgatttagacagcaatttttggcagccaagatttacataagagtaagtagccttcttgaatgagagtggcagccagcttccatgaagtctcccacctcctggcatttaacatacatctttgtagagtccccctcccactctatcccaggattggttatcagacagcagtgatgacatgtcactttcaagaagagattatgaaagactgtgtttgacttctgtcttgggatgtctctgtcttttgtctccgtctctgtctgcctatctgtctctctcatctctcactctgggggatacaagctataatactgtggttagccctatagagaggcccacatggcaaggagttgaggctttccaacaactatatgagtcactgaggaagcagctgagccttgagatgactgtagcccaagccaacaactcgtgagagacccttagccagaaccactaattaatatagagaaatactgagcaatttacatgattgaagatcatatgtagagagatatgtcataaaaggcaggattggatgggaagtagaaggatatagatgcaaaacttcaaggaagaaggtgtactcatcattggtgctattcgtcaccattctcagttctccctctttaaggcacatggcaagattgcactttcttgcccctttgaagttaggcatggtaaccttactttggcaaataaaatgtgagcagcatgagaaacacgtatatctctctaatttgtatatgtacacacacacacacacacacacatatatatatgtagttaatctgaatatcactatgatttgatgaaacaagacaaaaaagaaaaaagatatgtgagcagaagcaatacgtgtcacttctgggggaaaccactgaggtctgtgtatgaagtgccctgtcttctgccacaatgactgggaactttcccgactgtggtgtctcccattaactgtgttcctaagtgaagagcagaaccctctccctccaccacaaacctgtcatgaacatgtagcttgagtgagaaataagcctctactcttctaagcaactgagcttttggtgttgttcctgtagcccattctcactaaaacagaaaatgggtctctgactaagaattcactctacagaaaaaaggaatctggtatgaataacccgaacctcagccacaaactctgagcttcctgaaaggtgtagtggttcttggcagattgtggtgactggcatatgaactctcctaatcatatcccggaaatacaaagagttgtgtggagaactgaaagaacttttttcactagattcctagaatttgagagctccagaagcagcacagctgttggcttcccctgagagagcaagaagggagatgtactctcctttctactctgcaggtgaatagtgttctggtactgccctagatacaacagagaacattcatagctggaacaaactggttggtgtctgccgttaggcaatcaagagactaatgaacatgggtcaaggtcactggtagagcagagaccagtacaaagtgacatcctgggcagatccatgcaggggcaattgcaaggcaccccccagagtctcagagatgctaagtgaaagaggttgtgtgagttactgaggtttatgctggagaatatgagcatagagctattgagactggagaactgattttaatgtgacctaatttatatctaccagcttgaagattaaacatctaaaaccctattacttcattactaattaattatgtgtttgttacaataatctatctgacatcacactgtatcatgtggcattatatggttccaccttgatcagctttcaactcaagaatttaaaatcctcttcaccaggatcttattttggtctagaacagattaatctattctcaactgccacatgtttttagacactatacaaataacattttaaaatgttcattgattcaaagcttagtggcttacaattcagtgcaaaaagacatgggcaatgaagcaaagatgtgagcagttcagctgaattaacattttgagtatatgcacattagtcctttggatgggatcatgcctcaaacccattgaaatacacctcaatgaaacaataagtaaacgagggggaaaaggagactacatgaggttttgagtggtgaagacatgaagtctgtaaggctatggagaataattaaatgtgatatttatatttcaaaataggtaaaacttgataatggcagaaggtaaggagtcagtggagaaaaacagaaaatgctggcagaaagaaacaggggctaggggtacaaggtctcttagaaagtgggaagaaatgggatctagaccacaaatctggatgtccttacagaggattcacatacaaatcttattcaaatacatcatggattcgtactgaaccttcagggtagattttaatgacaacctggttgtcttagtccattcaggctgctataacaaaatacctgagtagattagaaatagcagaaatttattgctgacagtcctagaagctaagaagtccaagatgaaggcatcagcagattggatatctggtgatggtttacttccttgttgatggacaactatctattcactgcaagctcacaaggctcaaggggaaaaggatctaggcttctttcataagggcactaatcccatttgtaagaaccctgccctcatgacttaatgacctcccaaagccccacttcctaataccatgatattgggggtgaggatttcaaaacaagaattttgggaggacacaagcagtcagatgatagccctggtttaacccatatggctcatgttctctcccctagcacccttgtatttccccttgtaacactcatcacaacctgcacttgtatattcatttatctgtctgaatgcccgtctccacactaggatacaaacttcttaagggcagggtttacatctgctgtggtcactgttacacaatctccctagcacagtgcctggtacacagtaaatgttccataaatattaatatttgtggattgatcaaatcaggatagacacaagaacaaatttaagattacttagcttattgtcccaatctcactttggcccaccttactttgtcacttaaatgaagtcctagaatgaactgtggcccagtagtccttatacctttgtaaaacttcattgatattgagggatttcaatccagttttgataatatagcagccaaatctatccacatcactaaagccaatcagccagactgtcattcttactctgatgctatttagaatgtgcaatgagccaccggattccacttcctaaaaactaatttccctagagcttctgctctcttattttatcaatgcccctgaggtcagaaactatgattttgtctctcctgaacagcacaatgtctcattaaaacttcttcctataagcttgagtttttctttagaactgcaaggaagtttcaaggatcatgaaggacctttggtttgatatcagctatttttagtgctttgagagcaacagcacagtcaagttcactaatgacctaaaaacaattaattcaatatatattctgattccttgattgacactgttttttttgtttgtttgtttgttttagatttggaaaaaaattactgcttgttcaatcttttaaaaatggatgttctaatttttttttttacagattccaacaaccaagttggattatcgtatttgaatataaatatgggcaagtctgacaatccaataatttatattttatatagcctgcttctacctaaggagaggaagatagacagtaattatttatctattcaacaaatttttattgactgccaccatatgctaagaacaactctaaaggccagggatatagcagtgaactatgaaataactagggctcttgagtcgtggtaggagagatgaaaaataaacaaaaagaaaaagtgaaatctatataaggattatatgataacagtttgcagggagaacaatttaaaaagaagaggggatggggaatgccaggaacaggcatggtgaagatataattattaaaaacaaaataaaaggatagcctcactctgaagatatccaaataaaggatggaaagaggtgaggaaagaaaacaatggcatatcaggctgatgcaagttctggctgaaggacttgagaacatgaagtacctgaagcaggactttgcttggatagttgtgggaatggaaggagaccagagtgactggaccagaggaggaggagtaggagctgaatctgagaggccacaggaaaaaatagtagattattataaagaccttcaatttcattttgaggaaaatcagaagttactgaagtattctgagcaaagaagtgacctaatgccacctagactggagcagcctcactctgctgaggggtgcaaaacaggctgaagcagggacactggtcaggaggtggtgcagcaacacaggtgggaaagttggtggccggaaccaagctggttgccatggtgatggtgagaaatgggcaaattctgggttatattttgaaagaatgctggctggatttgctgattggattggaattgggagtgtgaggaaaaaaagagtcaaagacaacaacaaagtttggtctgagatcaggaaggctccaggaggagcaagtttgctgggaaagagcaatactttggttttggacatgctcagtttcaggtatagaggagacatcatggtggaaatgacaggaaggcagttgaatatgaaagtctgtatcaggtgagagatccagatcggtagagacttgacaaacaatggcatatagactttgaagtcttgtgattagatgaggtgtaagagatacgcagaaggaggacagaagactgcaaggactaagcttgggacatgtccatgctaagactttggaaagctgaggaggatgcagcaaaggaggatgcagagtcctcaagggaaaagggggaaagccaggggaatgagatgccttgagaccctggggaagagagttgtcttctctaaatggtaggtattcagcatcagtgtagagacacctgctttgtaatatttatttggtcatgggattcacatgccttgacttacacataggttaacattaaatttaatttgcatattttggagaattgaccaatttataagagagaaacaagaggaaagaacaaatgccagaacttatgaaatcttcaagattaactgattacatatcagtaaaccaaaattacattacattaagactgccgttaaattaatttagtaatgcttcaccatgaagattatcttaatatttggctcaatttttaaaaaaaacttttttcttaatttttttacaaaaaaatttttctataactcaaaaaaatattttgagttacagtttacacattaagggggaagccattctccattcacatattcccatatattatataagttgaacttttttccaggcaactgcataatttaagtaagttctgacccatttcttagtcactgccctgactggacttgacctgactggggagcacacattgagttcaaagaacactctgctctgacattagccccataggaataggccactttaaaatgcaaatatgtaaaattaagaaggaagataattatattggagtaagcatcttattttggagaaaaattagaactgaattttatgccaatgataatattcaagctttgtattatcatagaaattatgattttgttttatcttttaactaaaaccaaagtcaaagatttcttacaagtatgagaaaagtgaatttaaaaataaaatagagctatatgagatatgtgcagcattgcttctattattgcatacaatcatagctcagaactgtaagagtctatgttactacacataaagcaacaatatacaaacttctatgtaattgtattttccccttttagaaatggagagaataccaatcctgtttacctaatcagacaagattatgtattttaaagcattttaaaaactatagaatatcgcacaacaccaacggagtaattcagtgtgactttcctttaatggatgaaaagttttaaagcactagttattcttcagttggtaggaaggcatttatctgtaaattgatacatcctcaggcaactgtgctgatattcaaatttagttattcaaaatgtggctttcatttttttttttttttggtggtagggtctctctctatcatctagacctgagtgcagtggcacagtctcggttctgcaacctccacctctcaggctcaagcaattctcaggcctcagcctcctgagtagctgagactacaggcacgcactaccacacccagctaatttttgtattttttgtagagacagggttttgccatgttgctcaggctggtctcaaactcttgagctcaagcgatctgcaggcctcgacctcccaaactgctgggattacaggcatgagccaccacgcctggctgggatatttttatgttgaacattcccattctagccatgcgcttcttacctggacttcattaatatatatatacatatgttagaccagcattttgaggttagaaatcatgaatcaaacagtaaggtttcctgggatatattagacaaaacaaaattgaaccctggtatgtttgaattgggagtagtcctggtacactatgactttctggttcagagataaaagccttaaatggcctcttaaactttaaggattcttagccattcaatatctccctatgccattttgatgagactagtgtaaatgaatcataggcacatagattaaattcccccacgaaatactcatgactatgaaacatttaagaaaaagtgggtaaagagtcaaatatgttttgctgactcctcaatattttcaagatggacacagacacagtcagcacattcaaaacaagctaacagtgaccaaaagtgtctgcatttgctcttatatcaccagtctttatgtcttcttcaattgtgaggaagaaaagctcttcaacaatacagttcacatttcagtctcagtagctggggtaatctgatctcctgattttactctaggcttactttgaatgtgaccctagtaagtttaaaattctttatactgcctaccttacactcctgactagctagttagctaaatagaaatgagggttagaccaaaagaggactatcttacagcgaagtataggtctaggcagttttctatctatttagtgaattattacagaagtcctcaaaatggccttctaggagtctagaaaaagtaaacgtattttccataagcatccacaatctgtctttttttttttcaattatactttaagttttagggtacatgtgcacaatgtgcaggttagttacatatgtatacatgtgccatgttggtgtgctgcacccattaactcgtcatttaacactaggtatatctcctaatgctatccctccccccttcccccaccccacaacaggccctggtgtgtgatgttccccttcctgtgtccatgtgtcttagtagtaaaaccaagaaataatctcatctgattttaatgcaaattacacccatttccaaacatgctggctttttaaaacaatattttttattaagatttacaatggaatttcaaaaatgcagccatttacactaggttgattcttatttcactttatgtacatgagtggtttttcagctttaaagttttaaagaattcagctcagtattttggtgtttcagcactttctattttgaaaatgagccaaatattgatgtggtcagatctatgatccctcaaaccattaaaagttataactctgtgataaatataatgtagcagtgttccaaattggcaactcatattaagtttaagaataggaattacctacaaaaaatttccaagtcaccatatatctgtctctgtgataatgtcatgctccctagcgatgctctcaaatggtagaatgagtcactggcccttgtcttttcaaattttatccatgaaaataaaagtaaactgctaaagataatctagaattttgtactctagcaggtttcaaatataattgcttctgtgttttttggtataaagttgctcccatggagattataattctgatttttttcctattctatgcatttcaagagctaaaataagtgtgggaaaggatatctatatatatctatacctctatacgtattccaactaagatagtgaagggtttaactttgtgtattacttagacctaataattacatatatatatatatatatatatatatatctccaagattttaaagtattaggtaataagtgcacataagatttcgtactttttgtcgttttcttcttttaaattatgcatcagattttcttgtctccaattgctgagggtgtatcttctcttcttatttgctatcaacattatgactaaaaatatatcctccaacatgtctaaaagtcttattttagataggtggatttcaaaccttgctttgcttatgggtaaattaggcaaagagagggtgctgtggtggaggagctccatcgtcctccatcttcaaccttgaagagctcaatttggaaaccagtgtggtagccctgtatagtgaaagtcatttactaacttctcttccatggcaaccacagtaaatattatgctacaatgtggactctaaaataagagattaaaagctaatattgatctatgaatgtatgacaataatagcaccacgaataaacccaagtccaacactttattgcgtctcccccagaaatcatgtgttgaagtcctaactcctcgtacgtgagaatgtgaccttactggaaataggattgttgcaggtatgattcattaagtgaagatgaggacatattgcaagagagtaggtccctaatccagtgtgcctcacgcctttataaaaagaacaccatgtgaagagacaaacacgtacacagaaggaacactatgtgaagactggatggatgctgctacaagcaaaggaactaccagaagctacaagagagaactggaacagttccttccctagctcctttacagggagcatggccctgccaacacctcgatcgtagaattctcacctccataactgtgagacaacacatttctgtttaaaccactctgtttctagtactttgtttcagcagaaaactcatacaccactcattcctcaattttctgcattctgacttcaactcctaccataccaatgaagtgcttttcactaagtagtggcctcttttcaagtcagtcagctcattctacttctagcttttcaactactgactttccctttataaagcctctcttgatcattattttctgatttttttttttactaacagttctgaatactcctcatttcattccttcaacaatcattgagagtttatgtgtcatgtaaaaaaaagaattcttcgatgcctaaaagtttctatgttaaaggaacataaagttgggtgggagagagaagtaaatcaatgagtagattttcattgtacacagtatgagaataaacaggaagccctcttaagcccattctacaggtttaggcagacatccttttaaaagatgatatatcagatatgagctggaacatgaggaggagttaccttgacaggaatggaagatgtaagacctgagccaagaggaagagggtgttctaggcaaaaacagcaaagaaacaaaggctcagagacaagagagaatcatgaacgccagagaattgtgatgaaaactgtgtgcagaatgaaagagaggacctgacaaaagaacagaacaggcgtcgggttctgatgggccatatatgccatgttacagcttggcctctattctgaaagcaacagatagtcactgaaaagtcttaagcaggaaatatatattatcatatttatcctctagaaaaaaatgttctgagcattgtgtgaaaaacagattagtgggagtaagcaaagccaaacacagaggatacagtcaggaggtggtggtaatatttcagaagacagatgatggtggctgctatggtttgaatgtttctccccttccaaaactcatattgaaatttaatagtcattgtaacagtattaagaggtgggacctttaagaggtaattaggtcatgagggctccaccctcatgggaggcattggtgcccttataagggcaagttcagtcccttcttgctctctcctgccctctcactttccgccatatgatgtcacaacaagaaagccctcgcaagatgctggcacgttgatattggactttccagcttccagactgtaagaaatgagtttctgttcattataaattacccagttttaggtattttgttatagcaacacagactgacttagcttaacctaaagtaatacccatgtatataaaaaactttggagaatactagaggtgaaactgatatgacttgacaattgattggacatgagggataaataaaacaattcaaaatgattatcaagtttctggcttgtacaatttaataaaatctgatgtcactcattcagactgaaatatgggggaggagaaaagggggaggtggtagagcagattggatgagatgggaagggaatggaggcaaggaggctctcttggacacatcagtgagtttggacatcttgtgcagacatatctaaaatataagcctagggtctaggatatccagatgaaagactgataaagggaatgcctgagaaggcatggatgtgaagaagaccaccagcatatcacaatcatctgtggaatttctgaataacttaggtgcctgggccccaatccctagtaattctgattcagatgatcgagcatagcaagcggatggctgcattttaaaaggctttgcaggtgattctgatgcatagccatggctaaatacctctggaatatggggtaacagcagaaagtgctgacgaaagaacactgccatttcagtggtaggcagaggatcaagaaaccccaaagaaaactgacaaactgcaggctgttagctaggagcccatggaggaatagactgttttatgcacagagagtggcctacactcttcaaatactgaagagaatctgagtaaaacaaagactaagaaaaaatttcctggatttagcactaaaaatgtcagtatatttggtgtaggaaagtgcaaaattgagagtagatgcaaaattatttggctgttagagggaggaaggcagtaggcagaggaggacccatgaaaatttgctttagcactgttatgctttgctttttgaaggaagtgttttaagtatgtttaaatacccatgttaaagacttagtccatggctaaagctggtgatccaagacaagtggcaggtgaaggagcaagtcaactgaaaaggcagaagcaggtgggactcaaggtacaggagcagatttctacctcaaacagaaataggatggaaatgtccatgtgaccaagagacagagtttttattgggaaaaaaggacacaaggctgactagagaaatgaatgggattttggcagtattgaggctccatccaattgggtctggagagtatgaacttgctgtggcaccagtgtaagtggttgtgtttttctctggaaacacaagggttaaaaatggggagatcacacaggtggattaatcctggcttgttatctcctgtttgggtttatgaggagaacaatgaagggttagcaagaaagcagttgagaaataagactattaggtctttaacgtaataagaggagctagaaagaaagaaaactatgcttagagtgtgggatatttgagtttaagattttgaggttggttggagcagttctggctgatgacaaagttcagagtgtggccatggaggtgaattgccaaggtaaaactgaagtcaagatcagtggatataaggaagggggatatgagaaaataaggttctcacccttgattgcacattagggtgatttggtggctataaaatctttcaacacttcagccccagtgaaatcaggatctttgtgggtagaaccaaagcatgaatacttttaaaagtacaaagattgagaaccacagaactcagctgtctgttttgtctaactgaattttgaagtcactcaaggtcatgaattgtagggatatttttggtttcaagacttttactcagcaaagtattgagatgaagagaatggcaaaatagccagcatggggaagaaacaaagaattccaacagctcttaaatattttgtggtttattataaaaagataaatggaacaaggattgtattgtcagacttctttcttatgataacctagagaaatctcctatactctcatttcctcttttttttttgtggccccctagagtaggagtataaataaatccccactttctttgtaaaagttcaattgtaaaagttcaattaggcaagttagagctataagcctataaaacactccagactcaactctgcaatttccatcttcacacttcaggtggctgtcttagatttagtttcttagactagggcctgcccttattagtttttcaattaccaccctcttccagagactgggtaactgatcaggtctattccagaggttgtatattagcaataccctttgcttcacacaaaaaaagctaaaaattaatggatatcctttatgtttcctggagtgagcaccttcatctgagatgcattgaataggaagccagctgagttcttcttgtcaccatggtgactttagcatccctgaattataggttctcacaggagttcacccaggtgaaggctttgaatatgatcagaaagcaaacctgctaggcccctaaatgatgcttcagcttacaaaagtatcaaaataatgattgggtattccctagcatagtggctaattcctagtagtttctcactgattaaatctgaaagatattttcctccctgttctccttcctgcagcaacaaagcccaggcttttcctgggaagtctaaggttgcaaaagatcttggttataaacaacagtagtcagaatgtccctaggaagccaggcttttaatttatcaagcattccctggcagtgaggcatccaaatcattttacttgactttttccttacctgataaatcagcaaagaacaagaatatgatgctaaattagtctgtgcaagaatgaaagccaaagtttccaaattttctgtgcccaacaactatgtgaaatctgagaaatgaactccaatcagtaacattaatgacttaaatttgtatgactttacagttcagtatatttatacgttatagtttatattttcatatcttttatgtcatctgatctttaaaagagttacaagtattgcctctttttaaaagaaaatgacttctggcttcagaagataaaacttgccagaagttaaacctgaaattaagtggctcactggaccccaagttcaaaatcagatattttgacttagaaaacagagttctttccgctacactattttctttatatatatatatgcacacacatatgcacacaaacacatacccacacactatatatacgaatgtatgcatacacacatatattttaagaggaaaatataattccagggggaaaagtattattgcaggtatcaataaccatttgggacaaatttaaaaggtcttaattctaatttgctgtgaaaagtcatgccagagttattacagcatcaaaaagtaaaacaaaacaaacaacttcagttccatctgatgtagctgactttttgatgagactaaaactgtgtagttcatcatctccatccaagttcagatctcaagtctatgatcttgactaccttaatgtatggctattattatcttgatgatcacattggctttgctttcggcacaccccgatctctctccctttcttctgattttctccactcaaaacaagaggggtatttttctccgacatttgtctcttccatgcccaatcttaaggaagacctactgtagttgccaaagcgcatcagcacctgggagactattttagaatgactgacatcattctcctgacactcaccatcagcccaattctcaaacaacataaggtctgagaacacagagtcgggtgctgtaaactcaaagaagtactttaaaccatggcaaattcatcacccctccaaagtgctgactaatatcttggggctagttcttttccaactcagctcatatcccattatcaccacatctcttcagtctttttgtcctgattctttatcgttgtgatcaccacccagtaagaaaacccttcctttggccttgctcttaccatatttcattgatattatgatgacactgattgtgagatgcattattaattgcttaatggtttttcaggacaaaaataaacactaaccttattaaatgagcacatcaattgcatgactcatccaaatttcagaaacgttaaaataataaataatgcttcaaaattgtcaaaaatacagaatatccttgctcacatcctcatttggcatagtttcttctgctccaacattttctgtaagaccctaccctctcactttcctgtacctctagtacagtgctgttcaatcgaattttctgtggtgatgctaatgttctaaaatctgtgctgttcaatattagacaactacatcttacacctaggccaaactttttcttcctaagctagcttgccctgttgccctcaataacaaccttaatcacagtgataatttcttcagactcacctccacttcactttagaaagacaaagtcgtggacttggtcacctccagccctgcatcccagtgcttggagctctgttgttctgttccatctccgaggcttgaaactgtctcaatttcccctctctaaataaatctattatcttcctatcacttaaacttcctagctcaccctgatcttggtatgtgccctcatgagaacaaccaggtccccagagttccaattcctgaccttttataaaccttgatacccaccgccttctgtaccttctagactgttgagcgttactagaaaaaaagattagtcatcttgactagatgttcaatgaatcgtgctatttacatttaaggagggttcaatgtttctctgcaatgctatttttaacaagtgattgaaaagctttatgttacttttaaattcacaacattacctcactttcctttactgtcaatagaaaataataatggcaatgatagtaaaaaatagctaacatttctgtgcatttataatgtggtatatgctactctaagcagtttatatgcatcatatcagttaactatcataaatattatttggccttactattttttatcactttacagaagagaaaatatatataaagcagccccgttgtgttgagaggatagaagccttcttacatgtaattgctttttctccctcatttgaaaccactactcattttctgttcttttcctgtatttcagaaaaataagattttcactttccagactaaatggatccatgcacgctcttaattctatccccattctatccttcaggacgtttctcctaattccatcccctgttccatcctttggggccttctctgtctctgacatcttcagtctatccctcctttccttcacatactcctgccccgatcacaatggttctttccactctatctacaaattctcacttaatgaacagaaagttaaaagatcttctcccgaatttgtcatttttttttcagtctcctccctttgctttacccctttaagcttcctgagagactgggaagggcagtgtgatgcagtgaggaacatgttcccaggcagccatcagggaggaggccacagagacgctgtggcacaaacgtggtagtactcggctttaatctgcaatggatgagaatgtctgagcagactgatgcacagaggaattatgtggcctctgccttgttatccaactattgagacatttggtctacatctaattaagaattatttctggcagtttttcaattacatggttatttcttcattttgcctggtagttctttatttctcaaatggtagaactcttagcattcctttaagcctttgcagtatgatttctgcctctatcaattctgattgctataattgagttcctaaaaagtcaacatgtgaccaagctttttggctgtgattattgtctttcttagcatttaaatacaagatgatcagccaccctaatcttctctccttttcaaatataatggaaacactgcttaaatttattgataggaattccacatcttggctaatacacaattctaagatgactcctattaccctcagccctggtgttactccacggttatattactttacatggaaaaaggaatttttgtagatgcaattaaggttactaatcagctgaccttaagataagattatcagggtgggtctaatctaatcacatgagtcctataaaacctataaaagcagagtgctttctttagctagaagcaaaaaaggaagtcagagagatgaagtgtgagaggggaggtcttccacggctgagatgaagatgaccaatgggataagaatccaagagtggcctctagaaggtcacagggggctacagccaacagctagcaaaagaagagggatttctatcctataattgcaagaaactgaattcttccaacagtggcagtaatgatcttgagagatgaccttgattccagataagatcacagctggttagcaccttaatttcagccttgagtttgagactctgagcacataaaccagccctgttatcctgaatttctgacctaaagagctgcgacattaaaaaaaaaaaaggatattgttttaagttgctaagtgtatggaaatttgttactcaacaataaaaaaagactatagccaaaacatctggataatttattgctgcatccttcatatcttagataagaagacggtgtctcataactctgaaacataaatttctcaatttttctttaaaataaaggtttgctcaagtgtaaattagaaaacatatgctttattaaaagaacattctctttcaaaaataaatacacgactatattattcatggattctttatggcattacaaaccaatgactgggcgcggtggctcatgcctgtaatcccagcactttgggaggctgaggcgggcggatcacaagatcaggagattgagaccatcctagctaacacggtgaaaccccgtctctactaaaaaaacaaaaatacaaaaaattggccaggcgtggtggcgggcgcctgtagtcccagctacttgggtggctgaggcaggagaatggcatgaacccaggaggcggagcttgcagtgagcccagattgtgccactgtactccagcctgggtgaaagagtgagactccgtctcaaaaaaacaaaacaaaacaaaataaaaaaaaccaatgcctggtttccattttagggtccgttaacattaaagtaatgtttgttggattctataaaataacagttggcctctgaagtatttaatgaaatgaggtttctatacatcaaacatttaaatgaaagtcaacaagagaattagatggtttaaacacaatggttatatggaaccatggtaatggtcatttcataaagtttatgtgtatatcaaaacatcaagttgttcactgaaaatatatacaatttcaatttgtcagttatatcccaataaagctgaaagtactattgaattcttaaaaaatatgttgaaccatgcatttctttattcaagggtgactgctttacagaacaaatgagtgacttaatttcttaatttggaaattctattatgtaattttagttaagctaactgcaagtttgcagtttacaaaaatggaaagcttttttataacagtgagatcccatctctacaaatttgttttttaaatgctaaactaaaatagaagacattaatattttaatagtgaaaggatgagcattagtttaactttcagtggtaaaaaaatcatattaacatccaaatcatgtaacaagttatttgcagtatgagaatagagtcaatattttgattaaataaattaaggtaataactttaatgaacgctgagctaaaatactaaaatgcattgatgaatagaggcatgtctagaccttgcaaatatatatgcttctattgcttcctatgcctcaaacataaataagatctttaatttctgtctttattatgtctgataaatatgctcctactttgcctttgttggctctataatcctccaattataatgcttctgttgtttgtcttattcttcaaaatagcccaaaagacctatcaggaagctttggattttgtacacatttaatttttcatacttcccctattcacttcctaatgaagggtctactctacaaccacattcaggcaataagaattagttaggtaccaacttagagtctagtccttccagtagcatttttagttcttcaggtaattgtgacttgactcacttaaggtcatcaattaccattcctcaaatttaactggatggtgataagtttgaaggtgtgaatggtattccaatagagaataccctgtgaccatgtattcttttcagaaaagtcacaaagcaggtgggatattttgtcactgttcaaagattaaaatgatagtaatagaggttatttaaaaatgttccaaattctagggttttatcttactattctttttccaaaactggagcatattctaagttcattgccacatgtatttcatattttattcttacctagcactgaattttatataagcaatatgctttctatcactttctaactgcattatgtattatcccttcaccccaccccaaagccttttgttaagccagtgatatcaatgaatgcctcctttaggggtgtggttcaggattcagtaacacattggagtatgtgctatacttcaaggcacattggagtatgttccttgaagcatcagatttttatgtgaagccaaaatagttttataaaatatagattgttattcatagcaatggtttttactgccaacaatgagagatgtttgctagcctttggttacttcctgagcataaaatcaccccagcactgcttatccctaaggcagaggctgaacaaggatggtgagaatctatatactttccagggttgagggaagaaatgagcccacacgtgacacctgctgactccttgtacctgcacccatattttatcctcaagtaagggatatctcagttcattgtccttaaagacatgtttctcaaagagtcattcttaaagttgtgtaaaacagaatctgtacattaattatctatgcctactgcttacttatctgaatagcaaagacaacaacaattaaaataaaaaattgctgccacagaattcactataaatgttaatgggactctcaagacaacccctttacagcttttcaaaacttcaaggggtatttttaacttaataatggaagaagaaaatgcttgcaatacacccaatacacctggtaccataaagaagaacaaatcaactgggagctgtgtggtgtcatgagagggcagcaatgcagggcagtgttgtggaatttggcaggcagcaccgggtctgaactgaattatcactattatatcctcatctatgcttctatgtctagaaatgtcccatagaacttcctgcagtagcagaaatgttctatatctgtgctgtccaatataatagccactaatggatatttaaatttagatttattaaaataaaattgaaaatttagtttctttcacatatggctagtgaataccaatttggatagagaatgagattcttttttagatacttataccacctattacttattgagccctaacctcaagccagaggttaaggatctattttgtaccaggcactgttctccaagcccagaatagaacaacctccaagacaagtagggccctggcaccatggacttcagactagtgtgggggatagaaaaagaataagaaaataaatgattctatgatttactttggcatattatatagggcaagggactgtgtgtgctaggaaagggtaagactgttcttagaaaaggtagttgtattagtccgttctcatcccactaataaagacatacctgacactgggtgatttataatggaaagaggtttaattgactcacagttcagcatggctggggaagcctcaggaaacttacaaccatggtggaaggggaagctaacatgtccttcttcacatagcagcagcaaggagaagtgccaaacaaaaaagggaaagccccttaaaaaaccatcagatctcatgagaactcactcactatcatgagaacagcatgagtgtaactgccaccatgattcaattacctcccacttggtccctcccactacacgtgcggattatgggaactacaattcaggatattttggtggggacacagccaaactacatcagtggtcaagcatggtctgtctgagaaagtgacttctgagtgttgttatgggttgtactgtgtccccctatcaaaattaatgttgaagcctaacctctcagtaccctagaatgggaccctattggaaatagggtttttgcagatgttattagttaagatgaggtcatataggagtaagatgcaccctacttcaatgtgactggtgtccttgtaataaaagggaaatttggacacagagacatgtacagagagaagacaaagagaaatttggacacagagacatgaagggaaatgtggacacagagacatgtacagagagaagacgaagagaaaatacagagagaaggccatctacaagctaagaaaaggacctgaaacagatccttcctcacagccctcggaaagaaccaaccctgccaacaccttgatctcagactcctagcctccagaacggtgagataataaatttctgttgcttaaggcaccaagcttgtggtattttctatagcagccctagccgactaatacaagtggcaacttgatgaggaagccatgcaaattgcgcatgtcatttaatcctcacagctaccctatgtgttaggcattggtgtgtccatttatcagatgagaatttcaagttcaaaactatgaaaataatttgcctgaggaaatattgctcttatgtggcagactcaagacagaagtctgagttagcatgatccctgggtctcagtgtttcttattatactcttttactaccttgacttatctaaatacactcacatctgattcaatgacaatgaaacaattaattttacaagtaaatagattagtttatatggttatgtctataccgtagtttcagttaaaataaaattttaaagtctagcaaaggtgtcttatttggcttttccttcaaaactaactccgtatttgattgttgaatctatctgtgaatattagcctttgaagtatggagatacatacacttttatgcatatgcacacatacgcacatacgtctatatataattttagtctattttatagcttacattttagattaatttaagcattgtgatgtaaagtctacagtactcttttctcagccttttccccactaccttcccttgtattttacgtgtccagcctgacactcatattatcttgcttcaggatacatctatttcttaaagtcatttttctatgaggacaatcacaatccccttataatgaatacaagcatgtttatagaccctcaccttcatcaaagaggcttcaatgttctcttaagagtgtatgaagctggaaatatattctgaaaatataagctcaacacctgccttcctgaaaatatgggtggtggaaagcccttgtgagtggatagcccatgatttgtttgctcaattagtgaaaagaaacacttcaattggcaaaaatgtttgcccaaatgagaatggctttatagaaatgttctaaatatggcctgactctaatcaagcaatgccatctgcttgatgagtgacaaggtcacaacttctataatagaagcagtctccagtgccagaaatgaatatacagaagtccaactgctgcctacactaaacatggctacctatgttgtaggaggcctgcacgtgtctgttagcttcaggtatgatcttaccaagaggcactttcattggtcttgatcctgctaattatgaggtgtagacccttggctgagtcacttaatattcctgacgctcggttttttttccctagaaaatgtagctaacaatttctatgtctcatatttgtggaagggataaaatgaggtcatactcttgaagacatcttgtgaaatgcaaagtaaaatgtaagcaaaaggcacaatttttccacctgtaaggaatggctcctagaataaaaaattactttgaagtactttttgagtacttattttgtaccaagcacatggccaataactttatttgcattatgtcattttatctcataatgacactatcaattatgtattattacaactgccatcttccagaagaggcaactagtagtgcttaaatggtttaggtgagttgcccaaagttccccagctagtaagtgccagagagtagatttgaacccacctgtgttcttaactatttcttctcttatcccttatgcccctgccaacagttaaaaaagagcaactattcttaaaactatattactgagataatttacttgcttttgtttgtggagacaaaaattttaagatcattatttttcaattgtaagagaataaagatggccaaatagaaacagctccggcctgcagctcccagtgagatcaacacagaaggcaggtgatttcagcatttccaactgaggtacccagctcatctcactggacctggttagacagtgggtgcagcccacagagggcaagcagaagcagggtggggcgtctccccacctgggaagcacaaggggctcgggaactccctcctctacccaagggaagtcatgagggactgtgccgtgaggaacgaagctacccagcccagatactatgcttttcccacggtcttcactagccacagatcaggagattctcttgggtgcctataccacaagggctctgggtttcaagcacaaaactgggtggctgtttgggcaggcattgagctagctgcagtttttttttcataacccaatggcacctggaacaccagtgagacagccattcaatcccctggaagggggctgaagccagggagccaaggggtcttgctcagtgaatcccacactgacagagcccagcaagctaagatacactggcttgaaattcttgctgccagtatagcagcctgaagtcgacctgggatgctctagcttggtgtggggaggggtgtccgccattactgaggcttaagtaggtggtttttccctcacagtgtaaacaaagctgccaggaagttcaaactgggcagagcccaccgcagctccacaaagttgctgtagccagactgcctctctagattcttcctgtctgagcagggtatctctgaaagaaaggtagcagccccagtcaggggcttacagataaaactcccatctccctgggacagagcacctggggggaggggtggctttgggcacagcttcagcagacttaaatgttcctgcctgccagctctgaagagaacagcagatttcccagcacagcccttaagctctgctaaggaacagactccctcctcaagttggcccctgacccctgtgcctcccgatagggagatactcccagcaggggttgacagacacttcatacaggagagttctggctggcatctgttgggtgcccctcttggacgaagcttccagaggaaggagcagggagcaatttttgctgttctgcaggctctgctagtgatacccaggcaaacagggtgtggagtggacctccagcaaacctgcagaagaggggtctgactgctagaaggaaaactaacaaacaaaaagcaatagcatcaacatcaacaaaaaagatgaccacacaaaaactccatctaaaggtcaccaacagcaaagaacaaaggtagataaatccatgaagatgaggaaaaaccagtgcaaaaaggatggaaattccaaaaaacagaatgcctcttcttctccgaaggatcacaactcctcgccagcaagggaacaaaactggacagaaaatgagttagatcaattcacagaaataggcttcagaaggtgggtaataacaaactcctccaagctaaaaaagtatgttctaacctaatgcaaggaagctaagaacattgataaaaggttagtggaatagctaactagaataaccagtttagagaagaacataaataacctgatggagttgaaaaaacacagcacgagaacatcgtgaagcttaccacagtatcaatagccaaactgatcaagtggaagaaaggatatcagagattgaagatcaacttaatgaaataaagcatgaagacaagattagataaaaaaagaatgaaaaggaatgaaaaaagcttccaagaaatatgggactatgtaaaaagccaaacctacatgtgattagtgtacctgaaagagatgggaagaatgaaaccaagttggaaaacacttttcaggatattttccaggagaacttccccaacctagcaagacaggccaacattcaaattcagaaaatacagagaacctcacaaagatactccttgagaagagcaaccccaagacacataatcgtgagattcatcaaggttgaaatgaaggaaaacatgtgaagggcagccagagagaaaggttgggttacccacaaagggaagcccatcagactaacagctgatctctctgcagaaaccctacaagccagaagagagtgggggccaatattcaacattcttaaagagaagaatttgcaacccagaatttcatatccagccaaactaagcttcataattgaagaagaaacaaaatcctttacaaacaagcaaatcctgagggatttcgtccccaccaggcctgccttacaagagctcctggaggaagcactaaatatggaaaggaaaaactgataccagccactgcaaaaacatattaaattgtaaagaccgctgacactatgaagaaactacatcaactaatgggcaaaataaacagctagcatcataatgacaggatcaaattcatacataacaatattaaccttaaatgtaaatgagctaaatgccccaattaaatggcacaggctggcaaactagacagagtcaagacccatcaatgtgctgtatttagtagactcatctcatgtgcaaacacacacacaggctcaaaaataaagggatggaggaagatttaccaaacaaacagaaagaaaaaaaaaaggtgttgtaatcctagtctctgataaaacagactttaaaccaaaaaagacagaaaaagacaaagaagggcattacatattggtaaagggttcaatgcaacaagaagagctaactacctgaaatatatatgcacccaatacaagagcacccagattcataatgcaagttcctagagacctacaaagagacttagacttccacacaatactagtgggagactttaacaccccactgtcaatatcagacagatgaacgagacagaaaattaacaagaatattcaagacttgaactaagctctggaccaagtggacctaatagacatctacagaactctccaccacaaatcaacagaatatacattcttctcagcaccacattgcacttattctaaaattgaccacataattggaaataaaacactcctcagcaaatgcaaaaaaccagaaatcataacaaacagtctctcagaccacagtgcaatcaagttagaactcaggattaagaactaactcaaaacagcacaactacatggaaaatcaaaaaacctgctcctgaatgactactgggtgaataacgaaacaaaggcagaaataaataagttctttgaaactaataagaacaaacatacaatgtaccagaatctctgggacacagctaaagcagtgtttagagggaaatttatagcactaaatgcacacaagagaaagcaggaaagatctaaaattgacaccctaacatcacaattaaaagaactagagaagcaagggcaaacacattcaaaagccagcagaaggcaagaaataactaagatcagagcagaattgaaggagacagagacagaaaaaaccctttgaaaaaatcaatgaatccaggagctggttttttgaaacgattaacaaaacagaccactagccagatcaatgaagaagaaaagagagaagaatcaaatagacacaataaataaaaaatgataaaggggatatcatcattgatcccacagaaatacaaactaccaccagagaatactataaacacctctacacaaataaactagaaaatctagaagaaatggataaattcctggacacatacaccttcctaagactaaaccagaaagaagtggaatccctgaatagaccaataacaaattctgaaattgaggcagtaattaataacttaccaaccaaaaaaagcccaggaccagatgaattcacagccaaattctaccagaggtacaaagaggagctggtaccgttccttctgaaactattccaatcaatagaaaaagagggactcctccctaactcgttttatgaggccagcatcatcctgataccaaaagctggcagagacacaacaaaaaaagaaaatctcaggccaaatatccttgatgaacatcgatgtgaaaatcctcaataaaatactggtaaaccaaatccagcaacgcattaaaaagcttatccaccacgatcaagtcggcttcatccctgggatgcaaggctagttcaacatatgcaaatcaataaacataacccatcacataaatgaaaccaatgacaaaaaccacatgatcaactcaatagatgcagaaaaggccttcgataaaattcaacactccttcatgctaaaaacactcaataggtattgatgtaacatgtcttgaaataataagagctatttatgacaaacccacagccaacaacatactgaatgggcaaaagctggaagtattccctttgaaaactggcacaagacaaggatgccctctttcaccactcctgttcaacacagtattggaagttctggccagggcaatcaggcaagagaaagaaataaaatatattcaaataggaagagaggatgttaaattatctctctttgcggatgacatgactgtatatttagaaaaccccatcgtctcagcccaaaaactccttaagctgataagcaacttcagcaaagtctcaggataaaaactcaatgtacaaaaatcacaatcattcctatacacaaataatagacaaacagccaaatcatgagcaaactcccattcacaattgcaacaaaaagaagaaaatacctacgaatacaacttacaagggatgtgaaggacctcttcaagttgaactacaaaccactgcccaaggaaataagagaagacacaaacaaatggaaaaacattccatgctcatggataggaagaatcaatatagtgaaaatggccacactgtccaaagtaatttatagattcaatgctattcccatcaagctaccattgactttcttcacagaattagaaaaaactactttaaatttcatatggaaccaaaagagagcccgtattgccaagacaatcctaagcaaaagaaaaaacaaacaaacaaacaaaaaacaaagctggaagcatcaagctacctgacttcaaactatactataaggctacagtaaccacaacagcatgctactggtaccaaaacaggtatatagaccaatggaacagaacagaggcctcagaaacaacaccacacatctacaaccatctgatctttgacaaacctgacaaaaacaagcaatggggaatggattccctatttaataaatgctgttgggaaaactggctagccatatgcagaaaactgaaactggaccccttccttacaccttatacaaaaattaactcaagatggattaaagacttaaacttaagacctaaaaccataaaaaccctagaagaaaacctaggcaataccattcaggacataagcatgggcaaagagttcatgactaaaacaccaaaagcaatggcaacgaaagccaaaattgacaaatgggatctaactaaactaaagagcttctgcacagcaaaagaaactatcatcagagtgaacaggctagagaatgagagaaaagttttgcagtctccatctgacaaaggtctaatatccagaatctacaaggaacttaaacaaatttacaagaaacaaacaaccccatcaaaaagcagacgaaggatatggacagacaattctcaaaagaagacatttatgcatatgaacaagcatatgaaaaaagctcatcatcactggtcattagagaaatgcaaatcaaaactacaatgagataccatctcacaccagttagaatgacgatcattaaaaagtcaggaaaaaatagatgctggaaaggatgtggagaaataggaatgcttttacactgttggtgggagtgtaaattggttcaaccatcgtggaagacagtgtggcgatttctcaaggatctagaagtagaaataccatttgacccagcaatcccattactgggtatataatcccaaaggattataaatcattctactatagagacacatgcacgtgtatgtttattgcaggactattcacaatagcaaagacttggaaccaacaaaaatacccatcaatgatagactggatgaagaaaatgtggcacatatacaccatggaatactttgcagacataaaaaaaaaaaaatgagttcatgtcctttgcagggacttggatgaagcttgaaaccatcattcttagcaaactaacacaggaaccgaaaaccaaacaccgcatgttctcactcataagtgggagttgaacaatgagaacatatgggcaaagggaggggaacatcacacactggggcctgtcggggggttgggggcaagggaagggataacattcggagaaatacctaatgtagatgatgagttgatgggtgcagcaactgaatctggttttcaatacttctgttgaaagccataaatatgatttaatatggactataataaggtactattctgctcttcacttcaaagacacatcttttgaatatggcaagtagctagggaaatatcaaaagttccagtattatttcgttatattttccaaattctccactaatctttgagtgtagacatttaaccaaataaaatgattcatattacttaatgttgttactcatgccaaatatatttcataataaaacaaagacatctgagtgtagagagaggatggataggaaatgacaaagaaagtaaagtgatttgagaagggattaggtctaatcagttgggtttatttttttctgggaataattaagatatttactgaggcaatgggttatcataaagcaaaaaacaaagaaactcctaactcactccatgagatcgaatttcataaaagcatttctataaaaatgatgaatagaccaccagaatcgaaatgtatgcaaattgcaaagctagttggaggagtgtgtgtgtgctgccttggtctctcaagtctatcaaaaaaggggaaaaagaaaaggtgacttgctgcctgagcagttctatgcctaacatcagatactgtaataccaccattaaaaaaagggaattcatcataaatgctacttaaaagacagtaaagagccaacacacatgtttgagaacaagtaactcctatcagggaccttaaatgagagagatacggagcttaacctgagggcagcagggcttcctcagtgcccccaccctctacctcccaatccttatagtatcacttttctttagcctacaaagatacgtgtgaacacagttttttgttgttttttttttaaagaaatgtaaggacaaagcacatttgtaaatagagggaataggacatagtggattaaggacagtgtatagtgttttatataaaagattctacaacaaattttcttgaaaaaatgaggcaggtatgagatgtcctgaagcccccagttctcataacttttaggatatgagtaaatttgttatatggcatttcacaggtactgaattgcaggattttggtcagtcacagtttcttgccagaagcactatcttttgtaaagggctacatagcagaatttttgttctattttagttttattttgcttttgtttggtgggaagtaggaagagaaaaattcttactaaattccattacctagaaatatttttatagcataaaacattttccacaaatttttctatgcacattatttaataattttttataatatcatttccaaattattatacatctataataccaatgtaatgactattgtgtatagtctcgatattactgatccatttttgagatattaaggtttttttcctttttttactataataaacaatattgtgatgaacagcttcttcacatatattttggctaatttatctgactatgccctaaagttaaattcctacaaagaagagaaaatcttctgttttggaaagataattggtgctttagaaagatagttcttgctggtggcgatggctgggttgggggagagaaaagactaaaagactaagaagcccataaccaaaactcaggcagtggtaacagaagtgcagatgagggagagcagaaaggatactcagaaggtagaatcaacatggtacagagactgatccatgggaagctaaggagagactcaaggagagagaaaagtcacgggtggcctgaaggctcctagcgtgaacaactggggagtacataatgaatttcaaattgaacttgttgagtctgaggtgccttcaaggcatcctagtagaaatggtcaatgggcagtgcacagtggaaatatatagcattccaggacacagacccacacattcctgacaaacacaaatcaatttggttttacaggagttcataatatcacccctgccaattttaaatatagtgtctatagtgtgtgtgtgtgtgtgtgtgtgtgtgtgtgtgtgtgtgtgtgtgatgggatggggattacacaggaagtttctttggttgttgtccagtcactgcatttgatgtacatttgatgtaacagttctttttttttttttaacattaatgccccaaccttaaagaagagcttttgtcttattataaacaatactgaattaaaatttgcaaatttaaaactagagcaaatatggaaaaagttattgaaaagtaacaatcaatccatcaatgctcccagtgaagaataaacatcatcataagaatgcccaatatttgcagtgtctattgttttttgaaaaagatttacacaggcataagatatttgatttttaccataaccttggaaggcacattagtttttattgctaatttacagatctaaggaaactgaggttctgaaaaggtaaacagtgtttttctgttgttcaaagctgggaaatgcccaaattgaaacttgagccctggctttcagactctggagccggagttcttcctctcacccttcagctagctgcattaagtcaatcaatcaataaataactttttattgcctgttctttctcttcctcctccttattctaatcaagatattttaagttttgaattaaaaatttatctcattcttatggcaaagtaggtttcaagccatttcacggaaatttatacaagtgcctttgtgctacaatggctgaaccagagcacccagctctcaggcagtccccactgtggagacagagcctgctgtcccactggacagagcctcaaccctggctgactcacagccctgtgtatgtcacttggcagcttcttccagtagcatgtccttccactacattcttcagtcacctttctctactgcacaaatcctgcctgataatatgtgtgcaatgcaagcccacactactttttggaacctcattcaattgtcacctcttgcacagaaaacaaacaacaacaacaacaaacaaaaagctatttttgagtgtgcctgtttatcaagagtgttctctaaaaatttatcataatgccattatcattctgtaactccatggttcagatttaaggcaattctatatctctttgtctcttgtgtagtctccagtcaacttcattctcagagatttatagaaaatttttcccatatactgctactcagaagtcacatttatttttcaggttttttaggctgagtctgacctggaagcactttttttatgggttcagtttccctactcttgaaggttaaagtgactttctccggcttcctagtttattttagaaagccattataactgtgacagaagaaatctaaccaaaatagcacaaaaatattctgaccaaactcagtttttacttttggctgaaagctatttaatgtatgtttggtgccacttaaaaaaaaagtttcattgagatgtaactgagataaaataaactgcacatattttaaagtgtacaacttgacaattactgcaaatgtatacaccagtgagaccatcaccacaagcaagggaatgaacatatccatcactcccacactgccgacttcccgtgtgttccttcagaatcccttcttttccctcctttgccacatattctggaaagggagagcgaatatcgttaaaacttcaaattctttccagcttttctatagatctaactttgttttaataaaaatcacaataggagtcttaaaaaatgtaaaaacattgtccagaaataaaagcactttaaaatgatgttacaaatgaggaaataagaaaacaatgaacacatcaatacaaaaccaggcaaagtccataggcagagaatgctcatccctctgaaatggctaataaaaagactgaaatctaaatctaaatcttactaataatcaaataaataaatgacaattaaaatagcatattcatttacattaatttttgtcaaagatttagaagacaatatgatgctcagaatttaaagctttttgaaagtagacactaatatattactgaaaaaagtacagatttccttgtaactattgcaatattaaatgtacattatttttgatgtagcaacttatctaggaattaatactaaagaaataaataaatgaacaatggcaacaacttgggagcaatataaatgtctgtcattagtaaactggttaactatctaatggttcattcttataaaggaatcaccagaggccatttaaatggtaaagtttatctgtatgaattaagtggaaagaaaaagagtggaagtaaaggagatacatatagaatgatttcttttcttttgtacacaaaaataatccactgtgtttttcaggtgtaggaagaactctggaaaaaactatataaaatttaagtaaagttttctctgggaatggaagtaaaacagctttcactttttactatatatatatttaattttactaaaaaatatttactacttttataatttcaaatgttttcatttaataacaatatgtatatattcttattaaacttatatagttttctatgtccctctaaacatatacactgatacggtttgactctgtgtccccacccaaatctcatcttgaattatactcccataatttccatgtgttgtgggggacacccggtgggagataatttgaatcatgggggaagtttcccctatactattctcgtggtggtgaataagtctcacaagatctgatggttttatcaggggtttccacttttgcatcttcctcattttttcttgccgccaccatgtaagaagtgtctttcacctcccaccatgattctgaggcctccccggccatgtggaactgtaaatccaattaaacctctttttcttcccagtctcaggtatgtctttatcagcagcatgaaaacagactaacacatgcactaagaacaaaatcctaaaaaatacactacaaggtgttagagtcattctataaccacgagaagtcttataaaaaatttgttcatctgatttttctaatttttgtacaattatttgttataagctgtataacaaaatacttctaataaactcttgtttaggtaaaatcaatataacaaaaaattacttaaatagtataaaatagtcaatctctacatttttttttccaaatgctgacaataacaataaagtaaataaagtcactatagggacttctgcttcttgcccaaaggagtcaggtttatgcttgctcatgaaagaatggaaaaactggacaaaatgaatgaaacaacagttttcagaccttaggcaacagttagcttagcatggtgattagagaaaatgaatacaatgagatgacgcctatggttgccccagtgtacatgctggagagcttccaggtcccagcataaggaggagggatcactgcctgacctgaaagtctccctaagttgaggagatggagctgggaattcagggaggtcaaggtaactagaatttgctgaaaagagaggagacagtggcccagagagggaactcagggacatctgcacaggccccctcttgagtcttcagctgagtgttgatcagcctgaggaaggtgaaatttctgggaaaaagctggaggaaggaatgacaaagacacgaggaaacttttgggggtgatatatatttgtgtactatctcagttttggtaattttctcacagatgtgtatacctatatcaaaatttactaaattgtgtaatttacatgtagtttattatatatttttttccagtggagttttaaaaacaattttgtaaagaaaaaaatgtatggtgaaaatgaactgatgggataggatattactcaaattagctctttgtgtaagcacggtacaattagcatcgatttacatttacatctcttcaggttgacaagaaagcaagtatggataccaccaaaaacacctatataatttgcatccaaatgtagtaaattactttgaaaaatattggaagttttccctagtggattaaagttttcctaacatgtgactttaatcattggcctattactctaagaaattgtaattcactaataatacataaggccatagacctgggtctgccccctccctcaatatcaataataccaacatttgtagaaggtatataaatgttatgcacttcaagaagagaagtatgccaagagagatgtaataatgcatgagatagagtctagagaatttagaacaagccttggtttagatgaacattaagggattaagggctattcttccagtaggacatttgtaggagaacaggaaagccaggtgaccatattctacagggcaggcctgagctttatctatttcgtggctggatgttgcatgttctctgaatcagcaaattgtcagtgggaaaaatgtatctatattgactgctctcaaccagcttatttaagataaaatagtaccttggcagccagctgaagagattttttggtactgtgttggtctgagtaatggattattgatctacagttaaactgatctgaaggtcagacttctaggatttctctcagtctcacattctgaatccattgttgtcttttaggaatggttatatcagaggtacctgactcatctttggccagaacaacaggagcaaatctggtattacagtatgtgggctgcaaatataacaaaattagtgcctctatattttgctctgcagattgttcctgaattatggtcccacagtcatgctgcattgctcactggaagtttctataatgagaatttaacccacttgtttacactggaacttagttcataggttctcatcacatttatttcaggctttcaggtgaaataccctgcctatttgagcttacaacatttttatttctaatgtaaacgtgtgtatctgtacgtgtattttaatcaataaaatgacagattctcagcttctcgaggactatgccgaaaaacctaaaggataatccaggttacaaatagcacattctgttcagtgaattgggctttcatcccattatcagacaatgccattggttctttaaaattaatcgaggggaatatttcacatgaaagggattacttcttcctatgcaagtcaaaaaattggaaaacaaatgaacatttaaagcctactggagcccagctgtttgccccctgaaaagattatgctattcaatgactggagtgatttaaagaagtagcatgacatttgaattattggctatcaaaaagaacttgtggaggagacttcataaaatgaacttctaagaaataccccttgagaaatggtgctgaactctaggaaaaaaatagaactatttctgtttaactgtaaggacagcttctgtgtttccttaggcaaacagatttcctgtggtctagaaatgtttctgtctaccacagaggtggatttaccgtgaggctaggaagggtgaagcttcagggcccctcacttgcacaagctccttcctaaggcactggaaaaggctcgaggggtgggatggcatgctcctttgcttttagaattttgcatgagtgagacattttaactgcagaagtttaagatcaatgtctacgtactgattttgcctatatcacacttttcccttgggttagttagcactggggtgactgtgggccattttgggatctggctaattagaaactgagttaaagattcatttagtttcagtttggtgtgattatattcttgtggttctcagtctcttccctgtacccttaggttcttgctggctgtctgggtgtagcttccacgaacacacctgattaccatggtgctggtaacatgaaagtgcaagcccagagatcactccaaaatcaatgtgcccagagcttcaggcaccacaagtctgtgtggagtgaaggagacacaatgttcaaaacatataaagccaggaactgctctttgaaaattcttccaaatcttacagttcacaaatgaaagacatttgatagagatatttcccaagtttggtcacagtcctaagaatgtatatgaaatcacccccaaaaattgagaaacttgatgtaacttttctaaactatcggtaataaaatgacagattacaatcaattatactagagaaaagactgcattatcttgttattctcaacatagaaaacataatagaatcatgtaaaatgaagaggcaatcagagaataagcaaccaaaactacagagccaaaaaaatcatagaaatgtatcaagcaattaattttctgaaaatgaagttaattttataaattttgttatccttgtagaatttgtcagctttattaattttataatctggtgtgatttagttttacatcctaaataaatattcaatctccacattcaatacatattccaatgatgtatccatttctcttaaaagggactcctcgagttgtataagacatcagttggtataaagcctggacccactccttgtcaactaccatagtttccctgggatatgaagaggtaacttcctttatattacaactaagtaataaaatggatataaatgtattagccgaactgcaaattgtgatattcagcattttaagggactgattctgttggatactcagaaatataaataggccaaatcctatgaccaataaattaatcaattgataaaacaatgtatctttttcttgattacactaaaaatttaaaatattatattccttatacaacatttttaatttaatttgccttgtaagtgttggtagtatatgcatagttctccagaaatatgtttttaaatatctttatatataaaactgggttttaggtcctcgatttgtggcaaacgttttgaacgcttgtttggcttaaaattcacaaacatataaactagcaatgacatcatgataggctttgtgcatttcttaccaaaagtgataaaatttgtagacaataggccgggtgcggtagctcacacctgtaattccagcactttgggaggccaaggcaggcggatcatgaggtcaggagatcgagaccatcctggctaacatggtgaaaccctgtctctactaaaactacaaaaaattagctgatcatggtggcacgagcctgtagtcccagctactcgagaggctgaggcaggagaatcgcttgaacccgggaggtggaggttgcagtgagccgagatcacgccactgcactccagcctgggtgacagagagagactctatctcaaacaaaaacaaaaaaaaatttgtagacaacatatttaacaagtctgtcatacttgttcagctccataatccttactacaaaatgcacataatctggcatattcacagccttcaagttgaaatggaagctttcatcaagttcatcaaattacacaaatcacacatgacaaaggagagaccacaaagctggtgtacaattgtttaataatttatatgttaatattggtaaactaaagccaaatataaaaatgaaacatatcatcaatgacatcttcagataataaggataagattattattttaaaactgtaaatttagataaactgaggtctgtataattcatggtaatatttcctatctttctctatatattattcatatatgtacattttaaatatatttttgaaattagggatttttcaaagtttttttttttttaattaaaatagtgattttaaatatacctatacctgtttaaatatatctgtaaaatgttcaggttatgacacactttaaataactaaaattcatcttaaaccgtatcttctaccacatcatttacatgtgcaggagataactgcagataagactgaagaaggatggaagctgaaggtttacagagaacaaagtttttgatacttccaactgtgaaaacactttaagtattcagaagaaaaggttgtatcataaaattatatatatgtgttcacatttaaaacctcaatattctataaagatctgaattaaaattaacttagaaagtaattttgtcttatgagatgactgaatggaactattaaacacataacttattcatatgattttatttttatatatctttgcaggaaaaggtatatgtaaaatgaggtagaactaaatcagtgattcttaacccagaatcactacactgtaatagaaatatgaatgtgattccagtggtacatgtaactctaaaattaaatacaaattctctgtgtgattatgtatatatccagagtttccataagagctctgctacatctacttagactcttggatgattccagaactgctaatagagtgaaacacacaaaccttttagaaaataaatttcactaagaagaaaaagaaatgaagttctaattgtgttggtaatgtcccagtcccacccacacatcacgagagagagaaaaagaaattccaagaaggatttgataatttcaaggaacaaagtgctcaggagatatattcactgaccaattccccaagtgctcatgtgtgagcaattcaaaaattctaaaaatactattcagtgacatctcaatagttcttcaaaatatgagattgaaaaacaaggcctttttccaagtcactctcttaaatatggttaacattttcattacacaataattttgaagagtttttgagcctatggataccttagttaccaaaatactatgaatgtgagcttctgtagtcattaaagaataaagatgactaattattaatttaaaggttatgaaaacactcttaaatattaatgactaaacacactaactgataggttgtgtttggactaacactgacagcaagcttcttgtgaagtctgctggtcaagttaccaaatcagaggtgcagaaagacaagaaaattctcaaaaatgcttccacaagaagaatccttgaagtaatttaggcatctaacctcaaaaaaaaaaaaaaataaggtttaatggaggaaattattgctgtattctcttgcattatcaaggctaagaaagattattagaattattttgtatctttctggcaacatgcctcataccaaagggaggaagtggcagggaaacaattcattacaaagaatatttttctaaaaatgagtcctaggcaacaaggaaagagcttgtcttacgagttgatgttctctcccgaaaaggcaattttaagcattgagaatgttctgagatggatttctgcagagtaggaagttggattcttatatataggaaatccctgtcagtacttaaattctacgattctatgatttattaagaatagccacttgtgaccacatagggcacaacctgaaaacagggcagccgcctaagagaaggcccttaaatagttatgagtgaatgcccaatgtgaggtgaagaaagggagaggtcattagaaaggaagttgtgtacaaaacacaagattttactgccttggtgaattttgaaccacagccaaattactttcttctctgagaagatatgaggaagagaataaaactcttcaaggcaacagcatgatataaatccaaagcattttcatactttgggaacgtgcttgcatgcagaagtgtgagccgggggaggaatcttgggtgataagaaaaacacgtcagcagggcagagtggtgaatggccttcaagataaggataagtaattgaaattggttaggaaagcaacagggagccagaagaaggaattgaaatgagtaatgggaagccagaagattagaaaagctagacggattaccttgggaagcaggattttgagatggtaatggccaaaggggagattgtagaatcaagacaggaaacaaaaagacaaggatggatagacctattcccgaaacaggaatagtaccttcatgaggtcccagagaggcagtttgtaataacaaaaatgaggccttcactgaagcttgggagttatataacactgatctaggatggcatgcttacctgtcaccgttgcttggtatccatcaggaaatgtttgttgcatgaatgaagaaaaagacacagttccattctacataaaataatcattcaaaatcaccaatttgggaaacaacaatcaactattagattgttaaaatgttgatagtttgtgaacctttttttttttttttttttttttttttagcaatgacccaatgtcactgtagtgtttcttcagaactgcttagacttttgtgtagaagtaaaagaaaagaccatcagttcttaaggtctgagcctgaaaacaaacgttctttattttgaatttgttttcaatgtacaaaaggtttacatgaaaaatacaggcaggctaatattgcaaacaacatgtaatttcaaagaggaaaaatattcagtactttccctctcactttttaaattagattcagtaacatgattaactcttacctacatgttttcagaactaagatgaataaattagaggggtggttcaatttaaaacaccttttccttttagtaaatctaatgtttatggtagtcaataaaagaattgctcttttagtcatagaaaagcctcagaagctcttctaattcttctattctgttgattgatgcaaattatctctacagggaattaattttaatagttaatgaaatgaggaggctgaagatgcagaaatcagtgccttgagttatctttgtgtgtctgcaagggctaactctgcactctgctgtatagccagcaatgacaagtatcctgaattgactgaggaacaatctgaaaaaaattcacaggaatcttaaaagactcagcagcctttagccaatatccattcttaagtgtgatttaagtgacacttccaagtcttattaaaaaaaataagtaaacataactttaaatacctaagatttctggttagtaacatctaccatgtttaatgttatggtcgattttattgtagcagcttgataaaagatcactacttaataagtaaggtcattctattaccaatttgaaatgttgatttcatatatctatgcactcacttctccataatttgatgtttttgtggttgcctcagaagctgtgcaatagctaaataaagaagaaaaaatgtgactaaccaggcaacagcccagcccaaatgaatgtgttgtagtttttataaagtgctatttgtataaattcattaataaacttttattttataaaaataattgttggccgggcgcggtggctcacgcctgtaatctcagcactttgggaggccgaggtgggcggatcacgaggtcaggagatcgagaccatcctggccaacatagtgaaaccccatctctactaaaaatacaaaaaaattagcctggcgtggtggcaggagcctgtagtcccagctactcgggaggctgaggcaggagaatggcgtgaacccaggaggcggagcttgcagtgagccgagatcgcgccactgcactccagcctgggcaacagagtgagactctgtctcaacaataataataataataataataataataataataataataataataattgctaaatgagagcaaagcttttcaaatcaatagactgtttcattctttctcaacctctaatacagaaaacaaagatcttttatgtcatatttagtgcatgctcaataaatgttctttattttttcttttctttaacaccgagtgaaaaaataattttatctgaccttccttccaaaattttatttggctgacagaatgctaggcttacatagacagggaaggtcacatggagtacttgggtcattcaatatatgaaacttttccgtggaaaatattaataattataattgttgagtgtaataataatccatatcttgacattaaaagaattgctgagttttatgaaaatgattatttcccttccttccttataataactaatggcctaattctaattcttaaaagtatttttggagaagcactagattaggagacagaaagaaagaaaaaaagatagaataaaagaaggaaggattctatccacctggcatttctcagtgtctgctggttccaaaatatagcaccatttgtagtggatgatgtgaagattccccttcaagaatgaaagactcattttcctagattctacaagtgctctcagctgtcagccctctgtaaattgccttagctaaagagcaccattttgttccagcatctactatcaagtgaccaaggatataaaggcctaaccctctcacccgaatttaggacaactctcaagggcatgccagcttcggaactgtctattggctctgctgaggccttcctcaagactgcattgcagaccaacttcttctatctggtcccataattctgccttcttccctcccctccataggtgttggtcccaagaacggtctcatatatgcctcttgctaccccatctcttcttcctcagaggcaatcttcttctcttggaaacctaatctgtgaagcactcactgagaacactgaaagtacaccattagtctctgcctgtggccattcattccttaaaagagtttactattaaaattaagctactgaaaaaatgaaccttagacaaattttcacttctccataattccccttatgtacatctatctcctttgatagaatgccacataagcattcacacatatcagcctagattctttgcttgcccaatatgtttgcgttgtgtgctcaggatgtgtaacaataagcatttggagtacactaagagaatttgtccctgcaaaatatacgaaactttcacagctaatattgatatcaatttaaaatagatatcaatgttaacataattaagaggtgtgcatttcactgtggcttttaaactttccttatgactgtatatttgtttgagagatctcaagactttattgtttactcattctttttcccagaagggcaattataaaaccttgtctcctcaaccattcttcaaatctcaatactttcactaattggagctcaggaaacactcatttcaacactcaattcagatcttattgcatgttttttttttttaattccatcaaggaaactgtcagaaatataaatgcaattaacataggattgacaaacaaaatgctgaattcttttatttagtaagccagtgattctctccatgccaagtaaatatcttagtattgcacagcacataaactgaacttatccaactgtttggttatgcaaaacaaatccattgatatttaataatagtaattaaaatttaagtgtcacattccagaaacatttccatccaaaaaaagacactttatagaaatactaattttttaaactgaaagatatcatccaacatttcaaaactgaaacttgtaaaatacaactattggttaggtctacatagatgcatactgaactgactattcttcaaataatgttagcaaaaaaaaaaatttttttttttttttttagacagagtttcactctgttgccaaggctggagtgcagtggcacaatctctgctcactgcaagctgcacctcccaggttaaagcaattatgccttagcctccagagtagctgggactacaggcgcccgccaccacgcctggctaatttttgtatttttagtagagatggggtttcgccactccctgcccagcaaacaaatgtttttaagggcagtaattttatgtgagactgtaatgtaactaaattcctaagagatcatttgaatccaccgtagtgaaagtgatgtttatacgtagaagtggggtgtggtataaataaacaataagcaggacatagtactctgtaggactggagattcagtgacaagtcaaacaagaaaggaggagagaattcatacttcagaacacttcctattagcaattattgcacataggatttgtcccaattctgcatttgcccagtttattctcagaaaatacttcaaaattatgaaattggaacaattacttcaaatgtatgcttaactataattctaaattaattcattataatatctatttatgagtggggaaggagaaaagagtggaaagggaaagacaggagggaagaaggaagaggaaaagggggaaagaagaagaagggaagagagagaaggggagaggagaagggtgggaggggaggggaaaaagggaggggaggccaggtgtggtggctcacccctataatcctagcactttgggagggtgaggcctgcagatcccttaagcccaggagttcaagcccagcctgcacaacctggtggaacaccgtctctacaaaatatgtaaaaattagccaggcatggtgccatgcacttgtattcccagctactctggaggctgaggtgtgagaatggcttaagcccatgaggcggaggttgcagtgagctgagatactgctactgaactcagcttgggcaacagagccagaccaagtctcaaataaataaataaaatgggaagaggaaagggagcacaggggaggggaggaagggagagggaagaataaaataacaatgacttttatcatctagcgtttttcagtacttgctagttccagactatagtaccatatacaaaagagttgagagttgctcacctattacctgcccctggtcattcatccttgacaaaagcatcagtttactgacagactttgtggtttgaggtactttgttagcacaattgcctcccatcctatctgtaggtgttgatttgtatcaggaaggtcatgactggttcctcccaaactattggtccaataaatgaggaggggccactacttaggaaaattgttctatatttagttttaacacctttatagagatgcaactgaaataccacacaatctgcctgtttaaaatgtacaattcagtgacattagtgcattcacagagttgtgcctccattaacacaatttagaatattttcagtacaccccccaaaccctttgaccctcaatcttcaattccccataccccctccaaccctaggcaatcattaatccactatagacttgtctatagtggacatttcacttaaatggaatcatgaaattatgtcattccggcttctttcatttagcataatgttttcaaggtttatacatgtaatagcatgcattgatactgaattctttattgttgaataatattccattgtatgaatataccacatttgtttatccatcagctgatggctatttggattgtttccactttttggctattaagaataatgttgctgtgaacatttgtctatgtattttcaattcttttgggtatatacctagaagtagaattgctggatcatataactctgtgtttaacaatttgaggaactacaatattctatgttttttttcaaccattgccatatattaaaaaaaaaattctctgaaaaaaaaattaatgccaaattctgtcagtattggttcagtttgcggccacacatcttagaccaaagctcctacttaaaattgtcttagttgtttaatgaattaacactgtaagagcttgatgtgcaaaagagattcgttagctagtctttcttcttgatacaatgttccaaatattgccaataaaaattaacttaattccttgaaggtagaagcacttactgataagttcctcactgcaatacctttagtgtttttttgttgttctggaacttcaatataaaatgtaatgttggaaaagtaatgccactaataaaaatatgcaatattttacatccttgtaattgtttacaacttatcagtaactccaacctgaacatattcacttcacccttagagcagtcatttccaacctgctttattttgctgttattgttgatgagtttgttctgttttgttttattttaggctttagcagccagaagccatggtttttagcttctgtctctgttgataagtggaaaagagggatgaggaaggagcttttctggcccaaccagaaacagaaactaagaacccatgactgtattttctcccttggacacccccaccttagagcatttaagttaaaacttctctaatagaaatgataaaatcaagatttaagcaggctaagcgcttccaaatattaaatagatagttacacagctggctggaacttcatactccaaagttcaagtctagatcacttcaagttatgtctgttctaggagttaaaggaatagtgcccggctatgttcatttgtccagtctctactgtcaccttgcctttttacttcccccctcctcctacacacacaatactcaagtcacatactcaattcatgcatatgcagacacagcaagtgcatacaccacacacacgttttctatataccacagacacagatgtacattcctcatacacaatcacctcacagacacacacatcccacatacagacacctcacacacacttcagtcacaaaaaaactcatgcacaggacattcaaatatacacacatcacacacagacttcacatacacattcacaccttacacacacatacaataaactcacatatatacacactcacagaagggaagaaaagttgtgagtttgcaccaccagattacaacgtattggaccaagttttctagggaggggaagttatgtgacaaggacactcatccaaatctctcttaatcttcctttctccagtgctggccaggtaagtggagtcaagatatgctttcaatcttattagaaaccatctgttaagtccacgtgtcatgtggctgaccagaaagcagttatagccaatgacacagatctgctcttaggggaaagaaagtaggggtccctatctcaaatctaaaccacaggcaggatgcagcataggaggatgtgggcattcctaaccccttagccatattgtcaccactacgtgtgagaactgtaggaagtttcttaaactttgaaacgtcagcatatttattatggtaataatacttattggcaagttaggggaaaaaatcacaagtcttgtatggaattgggtgattctgcagagttgcaattgtgacaaataaattatactttctgagacactcttcagttttagcaattacaatagcaaataattattattcataacagtattaacatagcaaatggtcatattccttatagagatagcatttccaagaagtctttaactttttttctaatttgtcatttcagtctctcagaaaacattgtcttctacaatacctgccttttacagttgtcctaaggcctaagatcaaatacaccacataaaatatgaggcacgtggcaagaattcaataaatggtagctactactactattacagctattttcatcccaaccaaatatatacttggaaatgtaattgcaacacaagatattttgagatattgaaaggacaaatttgaaaaacaaaataaagactactcggaagtgctgtctctataaggaatatgaccatttgctatgttatgaatactgttataaataataattctttgctattttaattgctaaaattgaagattgtctcagaaagtgtaacttgtcacaattgttaacaccattgcaactctgcagaatcatacaattccatacaaggcttgtgattttttcccccatcttgccaataagtagatttttttcatcaccaataaattaaggctatgcctgtgccttactctccaaatcattagagctcaaatgaatctaaatcactgaacagattaaagttttagataaaaaataaatgtcatcatttactttctaaaaataacagcaactctgcatatttccctgtaagcttatagtaattatgccattcatatatactatctaaacatttatatatagtatatacatagaacatgtatacaatctatatactttaactcaatgaggagatattgctaacctattgatatttaattcttgcagaatattattcaataaaatcgcaattcttcttcaaactagttcacacttatgttattagttagctcacaacagcagcttaataaaataaattaaaagatagtaagtctccaaagagtgctaatacattccgcatgttataataaggctttttctgaatcacacttttattgtacaaacactgtttaacatttagcaatccaaatttaatcaatgttttgtgttattcctctgcaaattaacacaactcttatcacagatactgaaatatttgaatttccttattacataaaaattcctgttggctttaacctccctatgtaaacttataaactggtttaagggaaaactgaaataatcctttgctaaattatacttaaggtgaagcttaataaacgcatattaagtagaaagcaacgtaaaaaagaataattacaaatataccatttactgttcgcttactctatgccaggtataaggataacaaatttttaaatatatcttatttaatcctttaaaaaagcatgatagtgatattattttctgcaacttatagattaaaaaaaaaccatgaatctctgagtatattatttactaaagtctcacacctagaaagtgttgatcctgggttgctgaattaaaaccctcaagtctggaaactctattccatctacctaagaacccaaaatggagagccagattttttttttttttgagacggagtctcgctctgtcaccccagctggagtgcagtggcacgatgtcggctcactgcaagctctgccttctgggttcacgccattctcctgcctcagcctctggagtagctgggactgcaggcgcccgccactgcgcccagctaattttttgtatttttagtagagatggggtttcaccgtgtcagccaggatggtctcgatctcctgacctggtgatccgcctgcctcggcctcccaaagtgctggaattacaggcgtggaaagccagattttaaaatgagcaattgggtgtttgatgttgcccaaaggactccagcagtcaacaaatatacattgccaatgccaaagatattcctttattgcatggtttaaaaagttggttgagatctttataaataaaaaagtgtgtgtgagtgttcgtgtgtgtgtgtgtgtgtttcaagaaaagtttcagccaagcaggtggctcacatctgtaatgccaatgctttaggaggctgaggtgggagaatcacttgatcccaggggtttgagggtacggtgagctatgactgcaccactgcactccagtctgggcaacagagtgcctctgtctctctaaaacataaaagaaattttaatgcaacttaaatttttaaggtcaagccttctctgtacaatgaaaacctatgcaatccaaggagattttcaccgtcaaaggagatccttatactgggaagggatatgttgaatcagtaaataaaagcaacttttgcagatttgcaacaaatgcctaatgggagaatttgcttagaatgaatcacttgggtgggtgaacaaacttactggttctgcatcagcaaacatagagtaaatagtgtcttaattttctttccaaagaccagaagaattttgaaaagaaaaataaaaccctaaaatattgttatgtcacacaagaagtggaagtaaacaggcagaaaaaacttctaaagctaagcacttaggaactgagtgttagtaaagagaaacaaccaactgcattttggtttcctctgtaagctagctgagtggagaaaactgtgaagaaaatgaaaatcacaactgataagtgcttttcttctcaaggtgtggcctccaggcctttccgataattatgtcataagaagagattaggagtcttcgtaggtaagaagtcttaaggacagtctattcaaaaatgtttttcatttggtactctgttacagctatctcctttctctgacagtgtccagctacagtaacatctatatcaaactgcctaaagaattttagcaatattttgataactcatctatcataatgttcccttgcccagccatcaaagggcaatccttctgctacagtgtgcacgaaatggtctgaaccacaccacacatccttgagctctgaatgcatcaagataccagcagttagaagattcctattctctgacaactctctcataacaaacttgatttattaaaaaataaatattgaagtaggccgggcatggtagctcatgcctgcaatcttaccacttggggaggccgagatgggtggattgcttgaactcaggagtttgagactcacctgggcaacatggcgaggccccatctctactgaaaatgcaaaaattagtcaagtgtggtggcatacacctgtagactcagctactcacgaggctaaggtacaagaatcacttgaacccagaaggcagaggctggctgcattgagtcaagataatagcactgcactccagcctgggcaacagagtctcactctgtcgccaaaataaataaataaataaataaataaatattgaattagtaacttttgcatttcatcccttggtaatacatatttcttctgaaggtaatagtattttattctaatgaactctttctgccccatgtttagtaagcagagctcatttgtaaccatttgggcttcagacaaaaagcttttctaagttttgtttttatgaaaccaatatttaaaaccacttccttttatttattttttctctctcaaaaacaaatgtccatgaggcttcattatttttttcctcccttttctaatttcttctttttgaaagtaatttattttctaaaattgaagagccacctgactacagttactttagggtaactgaatgtggttgtgcttttgccttttaaagagttagttctgactacattcatataaggctttgttttcaaggatgtctggaattcaaacccctgggactgagaatatcacccaggaaaaaaagatgccaaattgaactaaaaggctactttacaattttgacctgtggattttatttaatgagggacaatcaacaaggctaagtaaaatagttcctggaatatgtctgacagtcatatgaataggataaaagctgctgaaacagtgctcaaagcaagttatcaccaattctgaattctgaatattgcacctaaattcacaacgataatagctatttttaaaaataccactcattatgtcttcaaactctaatctaccactcttagatcataatgccaagagtaacccctactggccagtctattttatggctaatgctgaaaggatacaggagaaagggtggttttactgatatatttataatcccaggagcagtttgccagcactgcattttcatgataatattatatatatatatatatatatattttgtcatctagctcctccagtgatactcctgaagatttaacatactttacttttacaaagttttaataactataaacatgttgaacattttaaatttctggcaatataaataatatttctaaatcaacagataaaaggaattctgctcactttaaatagcttttccttagtattactttctgaagagggcaaattatcaaatgatgtttaaaaactccattacctgctccaagttaaggggcgagacagggcacagaatgaatacagtgggggtgtgtcattaggatgctaatttacacaacaaaaattaatgacagataaagtcagcagcatgttgacatgtccagcccacatgccctacattttgtctacttacaaagtgacatatgactctagatgtttgcataagcaacatggagattcccttcattattgcatgtttaggttgctagtaattgagtcatactcctgagctaaattaggtaaataaacttgtgtataaggaagttaccatgcaatcctattaattttccatatcaagatatccaggaataaagcagaacttagacagattctagaaaaaatcacacatagggcaacattctcacttcttcctggcccactgcatctcttgcattctttatgggtttgtaaaaatcaggttaaaataaactaagtgtagttcatttcacacaggaaagaaagtataaatgagcattgtaggccaggataaagctgtggctggggataggcattctgtcctgtttgcctggggtgctaattttatgaacattatatgctattatagactatattattgttctcaacaattcactcttttgccacttgaatgttcaggcgttctgggaggggggatatattgctgagacccattgtctggttagccacaaacttgcttgggctaatggaatgtgagtggagatgacagtctgtcattttagatcaaaggctttaagaagcattacgtgcttcccccagcctcttgctctttaccctgggccacagttccgttgtcagagttccaaccagctgtactctgggcaaggttgagccatttcctctactttcttctaatggatggaatggtctaacccattgaattgacaggaaaacaagaaaatactttggctggaaagaaactcttacaagagctcaggctaaaccctaaggaattcagacttctctttgaaaatcttatttgtcaatggtcacaattcaggagaaaggacaaggtatactgcaacacctgggcctcatttttgctgacaatggagcagatggagtgattatctgtaaccttatttgcactgaccctgaatatctgttgtttgtcaaaaccatttgaatccttttagtttcagtttcccacacgtataatcttattactcataaagtttactctaaagcaaggtttaaaatgaaatctcatgagaattaaacatcatttgtacacttagattgccattcttaaaaaagttacataaattcagcagaaagaaagcactattttaagaaaaccaccttatcctctccttttaattgcttctaagaaactgggcaaaccaccctcaatgaaaataatttgaataataacatatccgttctcttatattttaattttataatattccatatgtgaaacaatggggtaaatattgaagatgagagtgggtgagagtcctagattccagaaagataacttttacttctgctatttattattaattttcttcctttcaaaatagagttttgtaaattgcagctatttctaattctactcaaacctttgacaaagaaggagatgtatacacaaacacattaaagaaaaaaataaatggttacattttaagttggaaaatattattccactttaaatatatcctaagtttaaagaaagtatttattgtgagccaaggcttcacattaaattttgcaatttgtctccttaatacttctagaacaaaagttaattatttcttaaccacttacataggaaataagatttagaaattactcaactcacttatttctgctgatatttttctttgttttttttttcctttgagatggagtctcactctgtctccaaggctggagtacattggcgtgatcttgcctcactgcgacctctgcctcctgggttcatgcaactctcctgcctcagcctccagagtagctgggattacaggtgcctgccaccacacctggctaatttttgtattttttttttcagtagagatggggtgtcactgtgttggccaggctggtctcaaactcctgacttcaggtgatccgcttgcctcagcctcccaaagttctgggataacaggcatgagccatcgtgcccagcctctgttgatatttttcaaatagaaaatcaattttaagtttttctttatcatatgaagcaaatattaaataatcattttatttagtctgatgcttgcttgattatattgtgatatttctaataatctattagattttataataacaattataataattgtttctaagcaaatgaactattttactgtatgttcaacctcctacagaacgctgtataattttctaaataatggaatctatgcagcagcgggatctatttataaattcactgcattttcagtgtcattattgggatatattcctgagtaactgctgtggagacagaaagtatcaaaatatacagcagaaatttgaaccatataaagcctgatgggcctgacaaaggttaacagaataacataacattcagctctactccttttctcaccctcgtctcatctcaaaatatatgcaggaaatgcctcctttttcaacctccttcgcattctgaagagaatgtagaactttgttttaaaattgaagccaatgtaaccaacatttgcctatttttaaaaagctcttccttcattctgattggctttagaaacaggcctaatattgacaagaaatttatagagttagtgagagttttcatgctaatatcaacattttattcttttttgctcactcagttcccaaagatggatgtatacaaatgctgtagaacttcatacatgctttcctacaccttcatttcctcctcctcaaaagattaataagctctgtttattgacgtttttgtggtaagagtgatgtaaatatctcaagccatataatcaagttgtcatgttggtctaggcacctacaatacaactagatctgtgatttaccaaggtgctatgtatgaatatatttattttgacaaacacaaatcagttaatattttgacaagtatattttgataagtataaatcactgaataacagctttcatatatattatttcattttaggtttcagaagtagtcaacagttgattcatgaactgcttgccttgcttgtagaaaatttagcagacaggagaaagaagaaagaaaaataaataggcaaatcccagactcattcctgccataatggtttcattttgcctgttttatatatcagagttttgtgaaaaatttcattcataaagagaggttttctgattttttaaaagataaaatttgaaaatgtctagcagagagctcagtgcctaaatctcagaaaatatttaaggacagagagaaaacatgaaaaacataaatagtatctgcaaataaggttgataagtctaacctttctatacttaaaagaaattcagcttcttaaatggcagagaaaattctgtatgccagattacaatgaatatattctcgtcattatcattatctttagatacttccagttttctgtggatagactttgtaaaatgccatctatctccaaaaagaatgttactaacacccaaggaaaaacaagtttgtagagtcatacatctaattaccaatataacgtaatgattcttttcattatcatgaccctctgcccctctgtagtgacatgtccccctgaaatttgacccaaatagttcatacaaataaagttgcaatgtctccagtcagacatgaactgattgtcttcctagggtctcctggggtagcaacagtcaatttgccacagcagaaacttgagtatgcacattgagttccctccaggtattttggcaagcaaagtttaaaagcaaccatgaccttgtcaccaatactaatggacagacttcagacttctctgctttatgttagcatagttgctggagtaaggttacaatgttctgaggactattattgatcctgacattccaaacaactgtgagttgatggagtaattatcttatattcctgtgaacagactttttctgcctcaggtcactgaaccatttttatttttcccaacataaaatttctatccaaaaagtgatctaatccacctgaggaaaaagactataacttcatcacattcagaataatctctcctcaggtcctctaccaaaatgttatgattgctttaatttccatattgcccatgtacagaagccaacaattattgcagcataacttagagagtacaaataagctgaaatgaccagctatgatctgaacattggcaccctcccaaaattcaaatgttgaaatctaatcaccaatgcaatagtgttaggaggtagggcctttgggaggtaattaggtcattaggcctccagccttgtgaacaggattaatgcacatattaaagaggccccttcttccaagttatagctcccttgccccttcttccaagtgaggacacagcaagaagacaccattaatgaaccagaaacctggccctcaccagacaccaaatctgtagcatgctgactttggactccccagcctccagcactatgagaaataaatttctattgtttataagctacccagttttttgtttgtttttgagacagagtctccctctgtcggccaggctggagtgcagtgggacaatctctgctcactgcaagctctgcctcctgggttcaagcgattctcctgcctcagactcccgagtagctgggactacaggcatgcgccaccatgcccggctaattattgtatttttagtagagatggggtttcgccatgttgcccaggctggtctcgaactcctgacctcaggtgatccaccggcctcggccttccaaagtgctgagattacagccgtgaaccactgtgcccagccatgctacagagtttatgatattttattgtaacagtccaaatggactaagacatgacctaccttactatcagtgccaaaaagactaattctaccattccctgggatctgaagataatttaattgtcctttctctaaaaataatagtaacaaccaacaaacaaaaaatctccaaaagtttattttagaaaaaaggtctaaggaattctatatagttcttgataatttattaaacatagtcacaaatcttttggaatttttcagcaagcaataaagtgtccctgcctaagcaggtttttaaaagctattccaaggagaagccatacagttccgtcactgcatttggatgctgttgctgtgcactttattcataggaatgcatagcgtggcttactggtactgaaaaagactgctgaatggcagattttaaaaagagtaagcaactgaattgtaaaaggtcctagcaatgatagattccacaacccgttagaaatttgcccctacaaccctcctgacttctgaattccaagaagaatgaaagtgatggcttataattagcatgattgtgttaggggcatgacagatgctgtcggccagccttgatgtcagagtaaaatctgtttcctcattcatagtccagctcttttttcacatgatggactgcagcaccctctttctgattacaggcactaggcttcattgcatgttgtaaacatatataaggcagagcctaggtgcatgcagatgataatgtgtcagtctgggtcaagtgacagcttaggaaatgtcaaaatgaacaacaaaaacagagtaattctatgaaatggacaatgtgggtggatattacatttcaatattattaatgtctaactcaaaaatttgatttgccaactgaagtccatttagcaaaacatacacattgtcagttagcctgagaattttcactaggcttaccccacttccctcctagaatttttttttgggggggaggttctgaaggcattatttttattgtgttgtgttgtgttttgctgtgttgcgttgcattgcattgcattgcattacattttttgagacagagtctcactctgtcgctcaggctagaatgcagtggtgggatcatggctcactgcagccttgacctcctgggctcaattgatcctcccacctcagcctccagaatatctgggactacaggtgcacaccattactttgcttccaagttagacataactacttgcatggtctgcttgtactcaaactcagcaaatcacacccagcatctcctcccaatttagcatcttctcatgatttccctatttctgttcctggatcattattctcccagtcattcagacccgaacctgagaatcatcttagatgtctcactctttttcaagcgccatattagtttgtgtaatatggtatcaaaactttgaaatttctgtagcatctgtccctgagtctttccatatctatagtcatcaaacttagctccacattaccccttgctgagtctaacccactagtcttatatttcttagatcacacatccagtctatgttcccacgaaaccattcaagatggatcttcctgcggcattccatcaacatctgcctgctaattctcttcatcctgtacctgagcttagcagctcactggcattttctccaagttgtaccatacttcctgtttttttgcccttgtccagtattctttcctctgtcttcaatttttctgtttatacttctgtggaaatcctatccatccttaaaccttaaaatgtggagagtgtgtccttaagactgcatataatgactatagcagttcaagtctctttgatgttgactaactgatattgaggaaatatgtcaattctgtgggattcaggtactcctctgtaattgggagtaaagggagaagaggataatactttccctgcctctgtcatatctatcatagaataattaaaatgagcaaaaactttaaatgagatgaatatgtaaaagcaagagtaaaagctaacatgctatgcacagtagaaagccttactatgatcatcctctttactgttacatattcaccacatgcagatgaggcttcctcctgggattccacttattttcatcactattatggtcaatactatgacttatctttcagaattagttagcaggtatggtggctcatgcctgtaactccagaactttgggaggccaaggctggaggattggttgagttcaaaagttcaagaccagcctgagcaacatagtgagatcttttctctacaaaatttaaaacaatagctagacatggtggcccatgcctgtagtcccagctactcagaggctgaggcaggaggatcacttcggtccaggagtttggggctgcagtgagccatgattgcaccactgcactccagcctggacagagtccagagtgagaccctgcctcaagaaaaaaaagaagaagaagaagaaagaagaagaagaagaagaaagaagaaagaagaagaagaaagaagaagaagaagaaagaagaagaagaaagaagaagaagaagaagaagaagaagaggaagaggaagaggaagaagaagaagaagaagaagaagaagaagaagaagaagaagaagaagaagaagaagaagaagaagaagaagaagaaagaaagaaagaattagttcactgacttaaaaacaggcctactgagggtcacagattcttttggaatatacatgcatatttggaggacagaatcacaaactgtttgacacattcagttaggttatgaagaaaataaaaggctttggttgtaatatgatcagatggctagttccctttattctttatttttgagatggagtttcgctcttgttgctcaggctggagtgcaatggcacgatcttggctcactgcaacctctgctcaccacaacctccacctcccaggttcaagcaattctcctgcctcagcctcccaaaagtagctgggattacaggcatctgccaccacacccggctaattttgtatttttggtagatacatggttctccatgttggtcatgctggtctcaaactcccgacctcaggttatctgtccgcctcggcctcccaaaatgctgggattacaggcatgagtcaccgtgcccggccttagttccctctattctaatgtaaataaatactctaaataaatgtataattcaaaataaatatttacataaatattgacagatgaagtgctttttgactcatgctgaagttaactagctgccccttgaaaaattagttttctccattaaattattaaaatttaactaattctggagtttttctatggcatgctggacataataggaaccatggacttgctgagagtcctagtctaggagatttccttccagcacctgaaatacttcatgggagaccacagttttcattccatattttgatgttacaatatgaaccataaaaactttcttctatttctattttttactttttgcaagactaaagacaccccccccaatagtccagaattttattcctactttcttcctttttcacttgagaatgtagaaacaataaataactcaaatctacattttatcagtcagtgccaccatttaaaacacagcattttgggcatgatttcatttaaccccttaattgtatagttatgattccataacactgcacactgtctattccttaaaattttcttaagttttactttcacattatgcaaaattaattaatgctccactctgtggactctatgccaccacaccactatcaatgaattcagaagaggcagtgggagtgttgatagaatgtaacatagcattatggtagagtacagactagattacttgtttctcagttttctcctctaaaatatggaaataataataatatatctaattcagagtttttgtgaagattaattggtttaatacatataaaatgtttagagtagagcctgacacacaagtactctgtaagtatcatctattattgttttgttattaataaaggactccattatttcacaaggtaggttaagcatcattaatctgaaaatccaaaatgcaaaatgttccacaatccaaaactttttgagtgctgacatgatgtcacaggtggaaaattccacacctgacctcatgtgacaagtcatagtcaaaacacagccaaaactttgtttcacgtacgaaagcattttaaaatattgtatacaattattttcagcctatgtttataaggtatatacgaaacataaataaattttgtgtttagatgaaggtcttatccccaagatatctcactatgtgtatgcatgtattccaaaatccaaaaaaaaaattcaaaggttgaaacacttctggtcccaggcatttacaataagagatattcaacctgtatatgttaaacatatactaattcttaaattttttgagagaaatgtaattataataaagtggaaaaaactatatcaggtatgagtattaatattttggtttaattactgcaatgatcaacatagctactttaattattattctcatgagagtttttactttttttttttaaatagatggcggtcttgctgtgttacccaggctggccttgaactctgggttcaaatgatcctcctgcctcagcatcccaagtagttgggataacaggtatgcactattacaaccagcccatgctaatgagaattttaatgcatatacacacaacatatacccacacactttcaacacacattttcattatacagagtgtttccataggtagagtagaatgagatatgagttctggttatttagcctggcaactgcagcagagtcaaatactgttagtgtatctatcctggttcatgtcctgttatcaatacaagaggcaaagtataaatggagatcaggtttccatctggttacaactaacagcatagccttgattgcctgctttgagttaggggatcaaaggaagaaatcatcagagatccaaatagcaactcaggcaggcagatcgccatttgaaaaaaaatagtaacttctctaccttaaggaaggataactcctgtttggctagcttgattcctttctaattataaaaataagcttggggtgagtagcaggggataaaaatacaaagtatcatataggagttaataaagaaaacaatcatgataattatctttctaaacagtaaagagaaaccaagtatttcttcatattagaaatataatacaattttacagccaggcatgacgactcacacctgtaatcccaacacttcgggagatggaggcagaaggactacttgagcccaagaattcaagaccagcctgggtaacatgtccaaaccccttctctacaaaaaatacaaaaatgagacaggtgtggtggtgtgagcccgtagtcccagctatttgagaggctgaggtgggaggatcactggagcccagcaagtagaggctgcaggagccatgatcataccactccactccagcctgggtgacaaagggagaccctgtctcaaggaaaaaaaaaaaaaaagtaaagaaataatttttttcaaagaaaccctttacattaaaagcactacttatgatggaatctttaggaaatgctagaattccttgtccctagatttttttctaaaggattaaaatcttcattttctaggagaactgacatttaaatgtatgattcctaaactcaagatttttaaaagatctgagttgctcgataactctatagcacactcttgaagatgagatattcatggaccctccctaaatcttggaaagtcttcaggctaacggcagggctggagctaaagttgaggcagaacctcatttctgccagtaacagcatgcctagccaggattaaaaaatttgccaagaccacacagaaagagactagatggtaagttggatttatacttctctttgcaactgaaggccattctgaactcctgcctaaagttggagaaagtgaagagaggccaaatccagaaaccattagggctcagagataattattatggaaaaccaacaagcatgtacctaatgattccccagagtcactcctagagcaaggaatgaaatgaaaaagtttatatcacccacaaaacaaagattcaatgcagtcaatgaaccaaagaagaaaaattcagctctgaaatgtgataataacctgatattcctcctcaaatctctggatatttggttacattataatttgcttgatgcacgtattcttaaaataccaacactcaattaaattcatcacctaagaaacatggtcattagtaattatttttgcataatctcttttcatttttattactgcaaattttttgtttctaagtccacaaaaggaaacttcaacttgatgtaatacaaaaagtccagagtgtatcacaaattaatttatctagaatgtaatcaccatatagaaaaaatgatgcatatgatcttaaaattgcatccaggtttaaagttctataaaaaagataaagggaaggatgttactattctgagctgatgatgtcttaccatcccaaactgtaaccattgaacatacacatttattgacaaactgctttgaaatcataacaagatgtctcacaaatgtattgtgttttgatgcactagtgtcttagctgtatgaaacagctacatccatgtttttccatctataaaaagggcaatgaaaagatatcctttgagtcacttttaactcaactttctaagtgtctccaattttataaacatgaatcatactcctataaagaagtcttccactccaccttcacgagtgtatatctttgatcaggaagtttaaatggacactctatatgcatccttgtgcttttggggatctgacaatcctttttttgatggaacagtaaatggcccaactgtttgcctaagactaggcagaatgcaatttatcttcttggtttgcagaaaatggctatgtaaactttaccacatttgccagtatttccattccttaagacatagctcattgactaggacccagttttccaagcaagtataagatgtttccttgttactagtatgtttttggaaagcaaaagagaccttccgaattacctcttagaggcatgcttcacttttgtcctcagtaatgattatttcaatatactgtttacaaacccaatcgttactccctttttgaatgcaaagtaacacgtgctaattgttgttttgatgatattagtgaatcaaaaccttatgggaaatacaattgtctcatcttccaggtttctatgtgaaatactcagaactgcacttgcaaattcctgagcagcttcattctaagggaagcatggcgccatctagtgatcatacagaaaattacatttatgcattttctctcaaagctctgtattaaaatgatgagttggcccatacattagaattgaaagaagagaaatagaataaaaattcctagaaactttacctagttatttgctatatgcaccatcctgcatggtcattattaaacatatatgggttataacaataataatatgacattgtccctctcttggggtcacttttttaacttcaacttaccattggtttagtcatgtagtttccgaaataaatatcttcacatggaacatttaattccaatgaactatatttttggttcattaaaagttaatgaagtttttgaaacaattccaaatgatctgtaaaatatatttacttaaaaatgcttcattttatttctctagtgatgccctgctaggatgctacctaaattgttaaatatttaaaaacacagaggaaaaagtaagataaaataaatagcatactatttagagattaacctattccttaatatggaaaattattcctcattgtcagaataaaacatattattgtatttctagtttaaggataatattgtacagatatcaataggataagatatgcttgcctaagccggaatagatgcccactctgtcccagcagggtttttccagttttaccctgtggaaagttctatgaagacaaggaccatgtctgatgcatcttttcatctccatacgccactactcacccaaccctcgcccccaccagcacaatgcctagcatgtcataggaactcaggatgtttcttcaatgaaccaataaattaatttattatgtctgtctctaaaatcattatttagagtctatctaccacaggaaacagcttttcacttttctattgtatgattctctgctccttttctgagatactctctctacaagtggcaccttatttgatattcacactgccacctcctaaattctttaaaatcttgagtatccatgtccaaatggctttctttccatgagttatccatcttacagaaagggcattattcatcaacacatcatttgatgaaataaatccaaaagggtggaaatgagaaactcttatttcttactcttttcaataggtagtattaatattctgtaacaaggagatttcaatagtgtaacacataagatattactcacaatttgaaacaggtgcttttggcattataggcacttggccacaatgcatagtttaatatttgtgtggctcaaaacagctaacttatcttgaaatgttgcagaggaaacttccttaatcacattcttactgtccagtgactgaggtaaatcatggcatacatgcgtcattatgaatcacatactatctatacctacacttcaactacctgtaactagattttcactatacggtgtaatgagtttcagtgagaacattcagataacccattcctcaagtaaatattccaaaagcattttatttcactgtagagaaaatttagaaaaagtagatttctccttctctagtattgctgaattgtgattcaaatctataatacacagtaaacgtctcagaatactactacttttgaagtacaaagattgccacgatgtagaatagaatggctttttgtttttaaccaacatccccatcagtacattcaactcagccttgcaactcccactcataatgtcacaactgtttgtccctaagctaattaagtgtgtctgcgagctgtagcgtgagttatgaagttatcatttctccacactttatagctgtttgaaggatatgaaatggcaatggacaaacagtcatgatatttttggcaaaatatcaaatgtttttgatggaaagtgaaagggctttggagccctctgacctgggttcaaatcctaactcttctactttatagcctgagcaagttactgaacttaagtttctttatgtgaatgtggagatgctcttggacccaaagttctaattttggcacatacctatctttaaaaacaataataattttaaaagtaattttgaaatgtgttggtgaaaaacgtaggcttttttgaaaaagggtctctcactctgtcacccaggctggagtgcagtggcgcaatcctggcttactgtagtctcgacctcccaggctcaagagatcctcccacctcagcctcccaagtagcagggactacaggcacgtgccacaacacctggataatttttttgtattttcagtagagacagggtctcactatgttgccctggctgatctcaaaatcctgggctccaattatccttccacctcagccgcccaaagtgctgggattacaggcatgagccaccacactcaaccaaaaaatatagtgttaagagatcacactgtgacctataacatttatatatttagaacacctttggagctaactgagattagggatcaagatatatgtatatgtatatacacacacacacacacacacatttaataacacaagcatgcacttttgtgaaatagaatacgtaagttctaagcaaggagagtgcaaactgcatttatttttcaaaaacaagaaaaatacagtcataagaggttttaagtaactagttttaatcaatccatatggttgcatacttagagttttcttagaaatacattttacatttagcattgaccttggtatgtctaatattttctaggtatttttcacatatttctaagggctaaaaatatttattcatttatactttcattcagtcaatagatatttattaacagctttctcttatccaagcacatgtttgggaacagtcaacttttgttttatgatacagattaaaccaaagggacatattaatttgtgatcaactaataaaccaacagagagcttctaaaagctgaaggattttctaattttacagagcataaagaaccattttattcattttaaatctcaaactatgctgtgtttcataaggaaatcaaaggatatataaggtgtatacacttaggtacacatatatttttagatattttttaaattgatacataataattgtacgtagggatgtttcaatacatacaatgcatagtgatcagatcagggtattagcatatgttccaacatttttcatttctttgggactattcaatatcctctaagtatttgaaaatatataatatatcgttgttaactatagtcatactatagtgctatagaacactaccacttaattcctcctatctagctgtcatttcgtattcttaacaaatatttctctatcctccccttctccctactgtttccagcctctagtaatctctgttctcctttttacttccatgagatcaactttttctagcttacattttttgagtgagaaagcagtagaaaagaaaatgtggatggctttaaaaggaaaaaaagagaaaaaacagccctatctccaaatactccaatcttgtgaattgaaaaaaaaaagttgagatctttttttttaatcagttgctatctatttgtatatatacccacagaaaaccatagttaaaatgtaggcattataattctaagacatatgtacagaaaggcaaatgctggggggaacatattaaaatgtttctctgacattttgcagtcttacacagtgatttaatttatacgccatccatatattagtgatctggactctcttgatccaccaaaaagcaccctacttagcatttatctagtgttttctaagtagacgtttaaggctctttttaattaatcattttattaactcttgtcacactaatagagacagcaaccaacctgaaccatctagggcagatgagcaatggagatacacagaaagctaagttgcactgaaaataattttttgagaaagaacaacgggagctgtggagttctccaaatcataagttataaagctcagttaaattacttttttgtacaatgtagacagaaatgacaaaatggcagttctatatgcctgtaaaactcaaactgaccaaacactgacacttggtaacagcaggatgtgtactgatgttactataatgatgtttagcagaagagttgaaaatagaaagggtttccgaatcagcccagcaccaaccaagtaatccagggatccagatcattccaatacccagtgagttgtcccctttggcccctcctaggtgtgacccatccaagagaagcattgtatttccctagtctacattgttcccactttgacacagcctatcatatacttctctgtaagtttatgattatctcctccattaaatttttaattcttggggaccaaaaatctcatttctctttgtatgttcaagtgctattaagcacataagtactgaacaaatgctaaatcaacaaataaataatcccatgattacttaaaactgaggtgcctgcacaaatcagcaaggcactaaaatgataaactcatcctctaacaattgatcaaataccttaaactcagtctcaaaaagagtaaaaaaaaatgtcttggcttgctttcaagaaatgagcaatgttaaatcaaattcttgctagattattttcatggtaatagtttttcacaacttcttattgtaaaagtaacaacattatttcaaaatttaattaaggtataaataaatataaatacaaggagataaagaatatttataatcctattactcagagttggtttcatactttagcccatatacttaaaaatgtgtaaagaattacattatgtgtagttttgtgacaaatttcaatgctaatatctctatcattaaaaaaaatatggaagtaccacaatttagtctgttttagttttttgtttgtttttgagatgtagtctggctctgtcacccaggctggagtgcagtggcaccatttcggctcactgcaacctctacctctggggttcaagcacttctcctgcctcaggcgcctgagtagctgggattataggcacctgccacagtgcctggatatttctgtatttttagtagagatggagtttcaccatgttggtcaggctggtcttaaatttctgacctcaagtgatccgccttggcctcccaaagtgctgggattacaggtgtgagccaccgcacctggcctgttttaaacaccaaccctccctagtcctttactattatcaactcattgacggtcaaaatacataaaataatctttgcctacttcttgttacttgaggataaatgtctacaagaggcattgttatatgcatattttgacatggagtgttaccattgtaactgtacaaaatttacaatctctcaagtaatatatgtgtgcctgtttctttacccctttcctagactgagcattaccaatctttctatttctagtaaattgtcaaattaatctcagagaagacttagagacagtcttattcacttagtttattttctctcatgtggcaaaaggcaattataataaaagtcaacgtttacttttaactcatgatatgtattacacaatcggcctctcataataactcaatccttatttttataactctgcaatcaggaaggaacaataaaatttaattccaatattgctaaacctaggataattttgtagactagagtgtctaagtgtcatagtaacaatggctgaaagaaaagatgtttttccataccaactgaaatatatggattatcttggtacaacaaaactcttctaaatttattttattttattagttttggccacatgagaaacagcaagaaattccactgctagtcctccaaataggtaatcagatatatctgtggttatcttccctccataaacatttcctagtgattttgttaactataattctgtaatacaaaccctttgggtaatactcctatagacatcccacaatatatgcactccacacaaagagataaatgacagttatcttctgtaatcaagctcctgccaacttaaggtaagtaatgtatgagaaagataacctaatggcaaggctggcaagtcattctactatgtgtactaagctctttctcaacatcaagtaaccagacttaacaatgatttaaattactatatgaagactttcatggaataatgatttaatattttgacttataacaagactaagtataagaacatcactatttattcatgattaataatgtacatgtatgtaactcacataaaaatactattaaacatattattgctttactttacacaaagaccctaatgaaaagtcttataattaattatagaaagataattttctctcaagacataaatattatcaggtttctctatttgctgtatctttgaggaagctattaatattttaagacctaaacttaactccaagtacgaaatacacttttacatttgtgtttctaacttagctttacataggcattttatccatttttaaagttaggattgcttaattccttttttgaaacaaaaagcataaaaaatacataattaatggcattgcttttatacccaacttttattatctacaataaagatgtgatcatgtacaaataaccagatatgaagagccacaaacccacatatgcatttggaatttactcagaactatgtttgaaaatactcatgcactaacatttgtcccgttgtttccagattatcctgaagtttggtccaagacaaacttgttcagattttctgatttagatcacagctctatactctaggaaaacatggatacctacacctcagttaactgagtcttaaatggtgctagagatttcttattattaaggaaaggaaattattagttgatattttaaacatagaaacagaaaatatcattccagattaatcgattcaactctagatgaaaacaaatttatatattaaaacaaattaactgatccatatttaaaataagtaacagaaccgtgaagtgagtggaagtggctgtgagaaaagaactaaccaagtgaattttgagtacagaattaggcatataaaacataaataatgctaaaagtctacttactgaaatacttttctttgccttacttctctttttccatagaggcgtgagtgggtaattctgaaagtaatttttgaaaccacattccacaggtaagaaaatcctatgcaatatataatatattgtgaataatgggagccaggcttctcaccgtaacttctcacagagttacagatacgaaaatggagaagaacagaatgagcactgcaatgatggattatcattgtgaaatcctaggtttaatgtatacaaatatctgaatatacccatggatataggtatgtgtgggtatgcatatatatgcacacatttatatatgagtatgtacatacatacactttccccctagatatgtctactaaaaggacctagaagcaaaagcacacctactctccaaattttgatttctaaaaaccattctttactgaaaggaaacagagagccctataaaagtagctgattccaaggcttggataaaagaacaagagtctcatatctaaaaccaaaaagtaaaaaagtactcaaagaatgatagtaacgtgttaaaatgacaagggagtcaactagaagtaccttgtactgtccaaatccaggacagtatgaggattaagataaataatgatattaaccaacaatattaaaggataacaacctgctaaataaagaattcatgactccacacagaaacaagcacgaagaaacatttttatgcataatagaaagccaactaataaaagaggaagaaatgatgaaattacaagatttccccttagcaaaccactatggtttgaatatgtctcccaaagttcacatcttggaagcttagaccaaaacgcaacagtgttaagagttgggacatttaagagatgattagatcatgagagcattcccttcatgaatggattactttatctgttatcataggagtaggttccttataaaagaatgagtttgggccaggtgcggtggctaaggcctgtaatcccagcactttgggaggctaaggtgggtggctcacgaggtcagcagatggagaccgtcctggctaacacggtgaaaccccgtctctactaaacaaaatacaaaaaattagccgggcgtggtggtgggtgcctgtagtcccagctactcgggaaactgaggcaggagaatggcgaacccgggaggtggaggttgcagtgagccgaggcggagtcactgcactccagcctgggtgacagagcgagactctgtctcaaaaaaaaaaaaaaaaaaaatgagtttggcccccttctccctatttcttgcccatgtgatacctttcatcatgtcatgatgcagcaggaaaaaggactgcaccagatgcagccccttgatcctgaacttctcagcctccagaaccatgagccaaataaattctattcattataaattacccagtttgtggtatctgttacagcagcattaaaccaatgaaaacagcaaccatcataataacacaagtaactgatttagacaggaatcaccaacggattccaaagctattgggtaagaaattgaggaataacagcatatttacatgctctcatattatcatggtacaaaatgctttttaattacaaaggaggaaaatagtaactttacagtggagaaatctggtaggcaccacttgaactaaatgatcaaagctaaatttgtcagtaatggtactaaacaacagcatctacctctggatataaggagttagcatccctactgtgatattcctgcccaagttgtatgacctgactatcatccccaggaaacacaaaataaactcaaattgaaagatagtctatgctttagactgaatgtttacgttgcctccaaattcatatgttgaaacttaatcagcaatatgatggtatttacaggtgtggccttttggaagtgatgagattatggggacagagccctcatgaatgggattaatgcccttataaaagagaccccagagaactctctcttcctttctgccatgtaaaaacacagcaaggagacagctatttatgagctagaaagctgatcctcaccagacagaaaatctgcttagcacagatcatgggatttctcagccttcagaaccatgagaaataaatttctgttgtttataaaccatgaagactatggtagtttgttatagcagcccaaataaatcaagagagtgtacaaaacaattggcatgtaattctccaaaaatataaatgtcatgaaatagtctttcacgaagactcagaaactgctccagtttaaaggatattaaagagacatgacaactgattgaaaagcatgattttgtaatttcattggctacacagaacattattgggacaattattgaaatttagaataaagtctgtagattagataacaacattttatccatgttaatttgctaattttaaccactgaactgtacctatgtatgataattccatgtttttaggaattatttaagtatttagaagcaaaggagtatcatgtctgcaacttgctcttaatgtgtatcaataaggaaacgtgtgtatgggtagacggatacatagatgattagatagacagaaaggtagatatgagagacagagattgaataaagtaaatgtagtaaaatgttaacatttgggggatattggtgaggggtatctgggaattccttgtgctattcttgccactttacagtaaatctgaaattacatcaaattaaaaatcaaaatcaatataatatattaactttatggcttatagatatttaaagttagaattgtcaagtgacattctggtgaatgcttcaactagttataactattttccaaatattataaagcacactcagcataaaatcctgctttttgataccttacatatttcgaggacaactagatttttcagttatgtctttataaccacactgtacagaaagtaaatatatatcgagcagaaaatagctattcgtgacaaatctcacacctgagattaagagtctgctaaatcgttccattacattttggccttatgccctatatttttatcttcttttatcaaaatgtgatttcttcattgtaatttattagtagtttttagatatagacaacatatttaaatatatagtatcaccatcttttttgtttggtagaatcataccattttagtatgccataacagaattatatacatcaatatttttgtcattcagcctggcccacatgactctgagatgttctgaattggattgggctcatagaataaagtccaaactacttgccaagacccgatgccccatataatctggctttaggccaattttgcagatttctctttgaccgtaatcccataaattccctatgacatgcaaggctctctgtactacaaaccttttctatgctccttcatataaccatgaacttgaaaatgatgcctattcaactgtcaactcctaacgagctagtcaccctccaagacaaaactcaatgtcaagtcctgctttaaatcctccatccctccctgagcactgccctcccttctttcccaaaaggttattcttccttcttctgtctcctcatatcttttgctcatacttcaaacatttctgtcatattttaatgtattctacagtattatcttttccattagactgtcatgttttatcatttttttctgatcctctcccccacagagcatagaaaagtggctagcacaaatgcagctctcgataccatttttttgaataaatggataacaaaaaacaataaatatcacagaaaaatacaagaatttttgaattacaaaagagaatggtaattattagccactaggttgtacagagtaaccttcatgaaggaagtggtaactgatttgggcatgaagaatgagtaagatgtggagatagaaggcattgtaatagaaaataagaaacagaaagaaccaagatctaacagtctctgtgtggggccgtgaggatatgctgcagacctccaactataggaactataaccagcaaagggccccaactgatgcctctgaaattcactgcaacattttagctaaggccatacctcccatgccctgcttcctggtatttactgagcacagagggcatgttgtggcagacacattcctgggaaacaggattcctctgatggctgattttggcttgaggactcccatatgcctttggctagcccaatcaaggatgctctcaccaattctctctcccttctttactcagagtcaaacttggatcatgctttgacgtttccctcagccttaactggctccctccttatattcctctacaagggcatttcctaaaattcttgcatttctaatcccattttggcatgggcttcttgcaagactcagactaacacatagagtatagagtatgtatggagtaaatagggaattaaagctgatgaagcaaattgggactttgttactgagaacaacatgccaattcaatacattgtgccaaggcaggataaatctttattttctaatacgaacataactgtctatgtagtttttagatttcacaagtggcaaggaatttataacttccttttgagaactatttcatagtttaatcatctttcacagctcacgtaggtctttactaaatcctttgtgatttaagatcatttcttccagctcttctgtggtgatagattacagccaactttagacatactaaattaactacatcaactcttagtcataacaggaattccttctacaatattatgcacacatggtcttgcagggccatttgtcactttttctatttgatacaaaattatttctcattaataatctaatcatgaaacacctgtttgttaggcactgaaaaaattttccctgtttgaaagcagaaaaacaaagatttgtatgtttacttcagagaggattttgtgatttctaataggaagcaaacaattgtttttcttttctcaagtcttttaaactactctgccttctattgacagagtaagaaattaaatcttcaattatttaacatagcattttatctaattaaaaataacagattttttttttctgccaaagatttgaaacagagatggaaagcatgtgtgggaaattctgttacctttccagatctctgcttgaataaaataaaggcattttctgaccacgataagcacactgtctgatccagatcctccaagtatgcaaatcaacaggaaaagttccagcagcaagacttacccatctgcacagagtttcaaaaatggtgatgtacttacctaaaatagaaagagagatgacattagtgacattcatcgcagcttagacacatagtgaaaaacacattctagaaggcagttagagcatctgttcccctcaccattgccaagacccagttttaaggcttttgtttatgacacaacaggccagatggtggtgtctctcactgtccaagtttactctgagtacacttcataggtatttgttcaataaatactgaaaaagattataacaatcaactaagcaagaactatgatttaataacagcagcaaatttaacatctattgagggattacttgcctgccaagcccagtgcaatatgctttgcatattttcccatttactctttagatagtggacatgaggtaagtactattattatacctattgtaaagatgaagtaaatgagcttagggaagttcattaacttgcctaaagtcgctcacacaactagaaagtgttggagctgaagttttcacaggctctcagattctagagcccactttcatgatctttatgctatattgccaaaacccactgggaaataaagatatatatcattaccagtactttgttaaataatacattttaaaaatagaaatgatcacaattttagaatttgggaaaatgaacaatgcctagtacacagcagctgttcaataatatctgttgagtgaatgaaagaataagcaaagaaatgtcactgatatttaataaatatacacaggttatatctcaacacaacaaatatttacccacagagcactctactgtacagcttatttctttcttcctacagatgactatgtaccactattttaatctgctgattatttgaaggtgagaactaaatgctcttaagtgagaaagatgatggatcaatctagaccaaatgactggggagttaccaaggagaggatggaattgtcaaatcttcaaatggcatgttactcaacatataaaatccttctgtaattgaagaagcaattaacaaacaccatttaacagttcaactttcttcagccctttggttactcattttggtagaggttctcattagcaacaaaatattaaagaaagaagcagctaagagagaaatagaaacatgagactggctatttgaaagaatgctgtaattgaaaaacaagaaatactcagcacctcaaattcataaagagataatcatcaagttatctcatgttttgacattgataacatattccaatgaatcaatttttaaaataattataacaccctaaaagaaaattaccctctagtagaatgccacaaagatactcctcgagaagagcaactccaagacacataattttcagattcactaaagttgaaatgaaggaaaaaatgttaagggcagccagagagaaaggtcgggttacccacaaagggaagcccatcagactaacagctgatccctcggcagaaactctacaaaccagaagagagtgggggccaatattcaacattcttaaagaattttcaacccagaatttcatatccagccaaactaagtttcataagtgaaggagaaataaaatcctttacagacaagcaaatgctgagagattttgtcaccaccaggcctagaagagctcctgaaggaagtgctaaacatggaaaggaacaaccagtaccaaccactgcaaaaacatgccaaattgtaaagaccatcgatgctaggaagagactgcatcaactaatgagcaaaataaccagctaacatcataatgacaggatcaaattcacacataacaatattaaccttaaatgtaaatgggctaaatgctccaattaaaagatgctaactggcaaattggataaagagtcaagacccaccactgtgctgtattcaggagacccatctcacgtgcagagacacacacaggctcaaaataaagggaggaaggaagatctaccaagcacatggaaaacaaaaaaaaggtggggttgcaatcctagtctctgataaaacagactttaaaccaacaaagatcaaaagagacaaagaaggccattacgtaatggtaaagggatcaattcaacaagaagagctaactatcctaaatatatatgcacccaatacaggagcacccagattcataaagcaagcccttagagacttacaaagagacttagactcccacacaataataaagagagactgtaacaccccactgtcaacatcggatagatcaacgagacagaaagttaacaaggttatccaggaattgaactcagctctgcaccaagtggacctaatagacatctacagaactctccaccacaaatcaacagaatatacattcttctcaacatcacattgcacttattccaaaattgaccatatagttggaagtaaagcactcctcagcaaatgttaaagaacagaaattacaacagtctgtctctcagaccacagtgcaatcaaactagaattcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacatatttaaagcagtgtgtagagggaaatttatagcactaaattcccacaagagaaagcaggaaagatctaaaattgacaccctaacagcacaattaaaagaactagagaagcaagagcaaacgcattcaaaagctaacagaaggcaagaaataactaagatcagagcagaactgaaggagatagagacacaaaaaaacccttcaaaaaatcaatgaatccaggagctggtattttgaaaagatcaacaaaattgacggaccactagcaagactaataaagaagaaagggagaagaatcaaatagacgcaataaaaaatgataaaggtgatatcaccactgatcccacagaaatacaaactactatcagagaatactataaacacctctatgcaaataaactagaaaatctagaagaaatggatgaattcctggacacatacaccctcccaagactaaaccaggaagaagttgaatccctcaatagaccaataacaggctctgaaattgaggcaataattaatagcctaccaaccaaaaaaagtccaggaccagagggattcacagccgaattctaccagagatacaaaaaggagctggtaacattccttctgaaactattccaatcgatagaaaaagagggaatcctccctaactcattttataaggccagcattatcctgataccaaagcctggcagagacacaacaaaaaaagagaattttagaccaatatccctgatgaacattgatgcaaatatccttaataaaatactggcaaaccgaagccagcagcacatcaaaaagcttatccaccatgatcaagtgggcttcatccctgggatgcaaggctggttcaacatatgcaaatcaataaatgtaatccagcatataaacagaaccaaagacaaaagccacatgattctctcaatagatgcagaaaaggcgtttgacaaaattcaacaacccttcatgctaaaaactctcaataaactaggcattgatgggatgtatctcaaaataataagagctatttatgacaaacccacagccaatatcatactgaatgggcaaaagctagaagcattccctttgaaacctggcacaagacagggatgccctttctcaccactcctattcaacatagtattggaagttctggccagggcaatcaggcaggagaaagaaataaagggtattcaattaggaaaagaggaagtcaaattctccctgtttgcagatgacatgattgtatatttagaaaaccccatcgtctcagcccaaaatctccttaatctgataagcaacttcagcaaagtctcaggatacaaaatcaatgtgcaaaaatcacaagcattcctatacaccaataacagacaaacagccaaatccgaagtgaactccaattcacaattgcttcaaagagaataaaacacctaggaatccaacttacaagggatgtgaaggacctcttcaaggagaattacaaaccactgctcaatgaaataaaagaggacacaaacaaatggaagaacattccatgctcatagataggaagaatcaatatcatgaaaatggccacactgcccaaggtaatttatagattcagtgccatccccatcaagctaccaatgactttcttcacagaattggaaaaaaactactttaaagtttatgtggaaccaaaaaagagcccgcattgccaagacaatcctaagccaaaagaacaaagctggaggcatcacgctgcctgacttcaaactatactacaaggctacagtaaccaaaacagcatggtactggtaccaaaacagagatatagactaatggaacagaatagagccctcagaaataatactacacatcttcaaccatctgatctttgacaaacctgacaacaataagaaatggggaaaggattccctatttaataaattgtgctggaaatactggctagccacatgtagaaagctgaaactggatctcttccgtacaccttatacaaaaattaattcaagatggattaaaaacttaaatgttagacctaaaaccataaaaaccctacaagaaaacctaggcaataccattcaggacataggcacaggcaaggacttcatgactaaaacaccaaaagcaatggcaacaaaagccaaaattgacaaatgagatctaattaaactaaagagcttctgcacagcagaagaaactaccattggagtgaacaggcaacctacagaatgggagaaaatttttataatctacccatctgagaaagagctaatacacagaatctacaaataacttaaacaaatttacaagaaaaaatcaaacaaccacatcaaaaagtgggcaaaggatatgaacagacacttctcaaaagaagacatttatgcagccaacagacacatgaaaaaatgctcatcatcacttggccatcagagaaatgcaaatcaaaaccacaatgagatatcatctcacaccagttaaaatggcaatcattaaaaagtaaggaaacaacaggtgctagagaggatgtggagaaataggaacagttttacactgttggtgggactgtaaactagttcaaccattgtggaagacagtgtggcgattcctcaaggatcttgaactagaaatactatttgacccagccatcccattactgggtatatacccaaaggattataaatcatgctgctataagacacatgcacatgtatgtttattgcagcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctgagcaaactattgcaaggacagaaaaccaaacactgcatgttctcaatcataggtgggaattgaacaatgagaacacttggacacagggtggggaacaccacacaccggggtctgtcatggagtggggggaggggggagggatagcattagtagatatacgtaatgtaaatgacaagttaacgggtgcagcacaccaacatggcacatgtatacatatgtaacgaaccttcacgttgtgctcacgtaccctagaacttaaagtataataaaaaaaaaaatgggaaaagagacagagccaaactattttaagatgatctagccatgatgtgcaaaaaataagcttaataatataataatgaaagttgtatgtaatactttcctttcattcaataaatattattttatataggaagttcattttataatacatgtcaagtcataggggtgagataggaaagaggcacatttatggccttcattattaagccatatgaggggtaagtttagaaacaaaacaacctgggcaaaatataaattggctataagtaggtcatagatatttacgtttcttgttaaaatatatgataggaagaattcataggtttcatcctctggctttagactgtgatattacctattcatgtgggaaaagttcttcttaatgtataggaaaaaaggttctgatacgtagaatatcctttgttccatttttgaattgatagtgcaattagttaagaaataagacataggaagacttgagaacctaggtattttacagagttttaaagagagagctcttggtcttcttgggagggtcttaaggatccgctttttattgttgtattctttgttcatgtaatttgtgctgcttgccttggtttgaccatggttctatagcaaagcagaattccaaggggattgggtgaaagaagaactcttaagttatggctggttttcccagaaccagtttcttaaatagcctctaaaatcttcatctttttccaaataaacattattagtaatctctttaagagtaaaccccatcacctcatattactctcacgtactgagcttttaatatacatcaagaagattaagcacacacctcaggtattaaaatgtgtttcctctgcaatctcattttatatcaaacatcagtatggttatctcatgttgtagagtattgctgaactagattctatgttggctgagctctaatttaagtttagatacagctcaagccctacatagaagcacatttaaatgcatcgctttagcttgtttctgtagcatttaaaggttctggcatcatggaaatgattttggaggtattctgagtgcctctgttgattttaccagacttgtgaccttaggcaaatggcttaatttctcttcctcacttttcattttgcaatgagaacatgaatattaaccatttacataattataaccaaagttatgaggctaaagtatgagaagagtgacagggacagacaagtattcaaataagaagttgtttgctaaggtctatttaatgtattatagtatgagcaagaaaagttttcagatttgtgcacattaattataatattaaagctgacagggttgagaatatttgctaatttaaaaattataaagttgttcatcagaatgatgtaaatatactctagaagaccctgaaattgtatatgttttcaagttttgaataaacaacataactgaaggaaaaaaatagtaaaaaatatataaataaaataaagaaagaaaattaccctctagtaattcaagtcccctttttcataagcggtgccagagtaaaataaaccaataaaacatgagagacttcactcaaatgtccagaatctttaccaaaaatagtcaacatgaaaagtctttatacctgcaatgttttccactgcttttctcagtattatttatagatctgagttatatattaaaagtggttattaaagctaagccaaaaagaaggaaggctgataaagttttaagcagttttgtttcaagatcaaactggacagatctgcaaagaaaatcacaactatttgcgaattttagtgaaacaaatggaacttttacagcaaattcaatgtttacccttaaagataactgaacttaatgactcaaaactttaattatgaggtagttacaaatgtatgtggttccattttgataaagacctgggagaggatccaaggagcaaagttatttgcaaaaaaagttaggcaagatttgatggagtgtacttgttgaatacgaatgactgaaaagtattttttaatctacttccttgtgatgataataaggttctgtttaacattagatctgtcagtgagcagataaaggaaagaatctaaataagattcactttcaataagctcggagtagtctatggattaggatttatacctccattctactgaatatgtggatcagttctaagagagaaaatattatgaaaataagacatcaaaggttgatgccttaagggctaaagaaatacaggcaactcagaaaatgaatagcatttgaatttatactcggggaggaaaaaaaggacttcaaagaacagtcatatttattcactagattaaggcagacatttttccagtacaaagtctgtgacacaattcttcacccctgtccaatcccagcctccattttcaaatatcttggccatgcagcagtttcttttcaaacgaaatgaaacaaaacaaaactttattattttattgaaattctagtcacttccttcacaaactcccaataactcagtgtatttattcctctataaagtaagtgcagatcagaagaatgagttatacaccaggttggccgtcttcgctgggaagatggttaggtcagcttgaagtgaagtcagtagttgtggtttactctatgtctatgtctggcactgcgcagtgagcctctgttcttaaaggaatcttattttaatcttcttgggaaggcaagacattcatacttgaaacaactattaaatgatgcaaaacaacttacaattaaatgtaaattacacggtggagacatcaaatgctacaggaattaaaagaaatgaagaaaagatgtttcagctgttgtgtgggattacagcaatatgttgtaactgggtgggagactattaagagactcctgatagggaatgtgcatccagtacatcttcttcttgaccacattcagagtcccgcatagagatttctggaagagcgtgggagctgcttcagaacaaagccaatgtcttgagaaggaccatggatctacggtgatgtttgaagagcaagattaaaatgtatactgtatccctatgaccatttgctcctacaaatcacaggttattaattgattataactagtaacacacataacagtctacttctaaaggacttttaccaaacattactattaataacttttgctgaaggatgttcattaattcacacagtaactactcataggtcagctctccaccaaggaggcacagagaggtgctcataatcatgaaactttcaaattgtattaaagtcgggaccccccaggaatacccatctgacttacacttatatctaatcaaggtcagccactttgaaatctccatggtctctaaccttttaggatcttttctttcaaaatttaatgagcagctcaaatccatatcttttatttatcatagaacccaaacatccgggcttcaataatgcttctgcatttttgaaaaaaaaaaaatatcgagtcaaggagcatttattccagtgtgagtcttctgccaactgctaccctactgacccacccctcatttacaagggccccttctttactcttagctcctcacagtatattacaattgcttccccaaggcaggaactgcaccttttattgccataatattataccaaatgtcatctctgtgcataacacgttatgtatgcaacatgtttgttgaaatagccgaattgtttcactagttatctgatagtttaactactcaggccaatggtcaagtcactcttgtctgggccctagcaactctctgcatgatgcatattggaccttgaagtcctttcaagatgaactacacagactggtgacatattcaaaaatggtgtgtatttgattttattctattttttttctttttgagacatggtctgtgtcgtccaggctgaagtgcagtggtacaaacacagttcgctgcagccttgacctcctgggctcaagtgatcctcctgcctcagccccccaagtagctgggactacagacatgagccaccacacctggctaattttttgttgttgtattttttgtagagatggggtttcaccacgttgctcaggctggtctcaaactcctgagctcaagtgatccacctgcctcagcctcccaaagtgctgagattacaggcatgagacactgctcttggctgatttaattattgttaaactgatttcaactcatattatctggctcaaagtcattcaactcgacatgtggaaatattatgttttgaatcattatgtgctaatacctttagttattgtcttctttttaaaatgagaaaataaaatatgatttacacatatataggaaagaagagtaagttaactttttaaaaagtcaacttttgttactatgaacttgctggtttacatgtattatgcattccatcctcccaacaaccctagaaggtaggggcatctgggaaatgaaaggctgaaagtaaataatatgagattatatagccaagaatggtaaagccaggattcaactcaggccatttttccagagtcttagtgtataactgccaatccctacttcattcataatttcatttaataaatgtccatcaaatgactactataattgggcacttattctagggatacatcaatgactacacatcctggcccacatggagcttacattctattgaagggagacagacaataagcaatatcttaatatacattatacagcatgaaaaaaagtgacaagtgctatgaaattcattgatgtggaaagagagggtaagaatggcgctagtggagaggaatgcatttgcaatggtaaataggatgttcagggaaggccttgttggaaaagtaagtacatctaagcaatgatctgagttatactttaacacatttatttgatgagaaaccagtaaaagttgagaatacaatagagcaaaaaactgcaggaaaatactgaagctcttggtttttataaggtatttattccagtctcatactttagtcaaacttgcacatgttttgtcacttgtattatttttttaagttccttgaccggaataactgtgcttcacacagctttaaatccttccatagtgcttagaagagtggctgtcacaacagaaagtatctgttgaaggaatgaaggactaatggaaagagatacacatatgagaagtaaaaaacagaaaaaagaccacatcaatagttacaatcactggtaagaaaaccccaaaatagatctagtctagaaaataaattcaaggaagagtactttctgatcatggtaatgaaactgagagaagatatttgggaatagaaagagagtagttttgctaatcttgaggatgagaaagttgaataagaaagccttcctgatggggagtaatttggggtgaatctaaattaaaggccacactgagcagactgaataaagttattcatccattgaatcagcatttactgtgagccacctaagtactaggcactagaggaaaattcattaatagatagtccctgaatttatgtgcttatattctacaagagacagctattaaataaaaaagttacataatcaattaattataattgtgttaaatgctataaaagaggcacatagagggccaaaggggcttaatctttctgggggtaccaggaaggagaacctgagacctgaagggcaagtgtgtgggggtgggagtggaataacaggaactttctatgttctatgtactacaggtattcaatgaatatctatcaagaattgttatgttcctgcactacatacaccaacacttaccatctcatttactcttcaaagcaaaccaatgaacaaagtttcactatgctcatttaacagaagagaaaattgaggctcagagagataaaatatcttgaccaaggtcacacaggttgtgagccaagattccagtccaaacctgttcaggattttcccatatcagtcaagtgtcaggcaacctgttaccaagatctctgctattctgatgagttgttattatgtacttgctaagaaacaacagcctaggtaggggctcagagttgattcaggtcagggcaggttgatatcagctagaataaccaatgaaaagccctgttgaattgtcccaatggatctagcccttggtcctacttgatgtaacaaactttcctgcctttatttactgattttatgcagtggacaaatactgaagctctatagacatcagtttcagcattgtgaacatgaaaatgaattatacatgctcctctctcaagcagtttagtctagtgaagattcagacccataaaataaatggagtttaatatggcaaatgttacaaaaatattacaaaaacagtatagaaagcattcatcccactataagaggctcctaattttgcctgaagtcttctaaaagaaactggactttggcttggaggttaaatggagccacaggatattaagcagagggatggagaaaagcattctctttagggacaagataaagtctgccatgtttttcaaacagcaaaatgttggttggctgagatgtatctgagtgtgttgaaggcgagggaaatggccctgttcccacttaagcagatcacatagtaatcatcttgaccccggactttctacattgcatggatatttgagaagttgactatgttgtggtttactttctggcatgagcgctttaaaactattacccaacatgaagggtcaagcagaaggaaagagatctgaagcaccaccacatacacccacattcaatcctattacagcaaactttacctgtaaactgacttgtttaaaaacattagaacactaaatgtaaaaagaatgacagcccacacatagtgcttagagatattttttctatttatttatttatttgaggttgaaagatagcaagaacatgaagaaatggaatttgcgtgacagtcccaaagcaaatctattcaaaagaaaaccataattacatatgcagctctcttgacagggatgacagcagtgaatcaacattctgcgctgaagacctaagtcaatatgcatttgattcaaaaaactaccttcattagcacagactatcattagtgatcacagatctatataaggctgaaaaacctaatctctgtgtctctgaaaactgcaaaaccaccttagcagttgcctaatttccctgagagtggaggtttcacttggccattgggctcaagaggccttaaagtgggcaattagcttgctggattatgcagtgtactttgtacctcttcattacattttccaccaggcttgagtcgaacagaagagcttacaatgtcaatgactttgaccatttgagattttgaagcagaatttcttaaccttttcatttctactgtttctcaattgatctacagctggggaaatgtaattctctcataattctgttaaaaaattatattaatagttccatggaacacacagaagcaggtatgttaaattatcaaattgaatttgagaggggagaaataagaatcagaaattatgtaaattaacaatttaacatactcaatgtggcaataaattatagcttcatagctggtggttataagtacgtcaacaattaaaagaaaaataataaaataaaaagagttagctctctggccacatcttccaaaattatataaaatagaatcatgacttattggatccccaaatcatttttaaattatagaatcagcttttcctgtgggggtcttctattaaaaagatggtattaagactgcaggaaattaagaatgcaggctttggagctagaaatgtctggttcaaacacaagcagacctgagtgtccaagaagtggtagctatatataattatgatggtggtggaggtaatggtgactgcagtgacctaaacaaaaaagaggaagatagaaatgatgatttggtgatcaaagatcaatggaacctttgtttatggacactgacttttgtcatttttctgataagtacttaagaaccaataatataaaatagggactattttacacctctttttcaacctgtagcaaaaaggtatttattttttcaaaatcttatcaaggtcagattgatgccaattaagtatcagtatatccctcatttcagtcaccatctactagttagatccaatttagatagtctacctcctaagagaatcttaatagcttcatttgcacaggaatgatagactattgatcagacagcctcaggcaggatccctttagtttgagtagatatatttaatctaatagtgcattgaaaatctaatagctggtctcctgggatccctggtcacaaattttaataccctgcacaatgaaattgcataaccattactgaactctatcctgttgccaactaggaatatctagaaaaccaataaaaggaagaacaaaacattcagaactgcagggctgtgtgattacagtctctattgtttctggtttaaagtgaaatcaattaattgcaaacacaattaaagtaactttgcagtagttggctaaatagaaaaacattttgtggtattattattttaccaacaacccaactttggcctatcatacctatgacacttttattttccttctataaatcatgccacaaaggttaaaaaattaaataacgacataggccttttattacaatcaaaatgggtaagaatgtgactttgcagagattaaataaaacagctatctcttcatgattcacatttattgaataccaaaaataatatgggagaaaaaaatcacgtagatttcacacctaataaatgaacaaagaaggagaataagtgtatagatatcttatataaatgtataggcatatttacttatctatttacatgtatttacatgctagatttccccaccaatgccatggacagaacctcaatccccttattacttccaaaatttacactgcctatccccaaacctcaccttctttggtcttatttatcaattaccaatatcaactcagtaaatgactggtccccttctccagttgcattcagatcacatgccaatcatatccactaaacatttatgaaattagcattctcctctcaatcccgtagaatcacaaagctagctcaagcctatgtgatgttttgcccaagccacagcaggagccaccttttacattcccagccttcaatcttgccacttacatatttattctccattcagcccctagaatctgatcttgtcacataattgcttggaatgcttcatggtttgaggatgaacccaaagtccttaacctggctcacaaggtccccagaacctaaaccttatttatctccaggctcatgtcttgtcactgaactactaaatcatcccttcatcacaaataccatgggattccttgcatcagtgtctctgttcctgctattcctctctccctgaaatgctcttcctattcctctctccaccctacattcattctttaagactcagtttaggtcacacttttcaccccagaaaaggttaggttctgctttttgccactcccataaaatcttctgcatagtgctaatcacggcactcactacacattttccctgataatctacgtaaatatttgcttcccctgctccaatttgaactactttaatctaaattccctgagaaaaggttattatttgtattatttatgttagtgtcttcagtatacctagaacatagtactgtagatacccatacaggttttgttaaatgagtgaatgagtgagtgagtgaatgaatgcttttctctagaacaattaatactgaaaagcaaatgtaagcacaatggagaaaatgccattccttagaattcaagaatgagtgtgagggataagcccaaggagtttcacaattatggaaagtcacactcagacagtgagaatagaagtgctggttgtggaaggtgaagactccaagaggagcaacacagaggtgaggagatggtaccagcaagacaagaaggctgtgtggtgcatagttgatgtgaatcttcttcacaacttctcaaagctttagtacagttcacacatgctatgtgttcttggatcccttgtgaaaaacagctcaattcctctacagctttgcatccagacctgaggcccagcagaaggtaaaaacatataagatggacacagagttctggaggcagagagtggcataaaggtgtcaggtgtggcactaacatagaggtcatggcaaaagttaatcacatttccaagggccaagaaagcactggtcaatagaaatatgacagaaaagaatgaagagggaagctaggtgaaagaggttttcatacatcaacagcaacatcacctggaaacaatttttgattagttaggcacttactaattattccctgcttttctttttttgagatgaagtctcactctgtcgcccaggctggagtgcaatggcacaatctgggctcactgcaagctccccctcccaggttcacgtcattctcctgcctcagcctctcaagcagctgggactacaggtgcccaccaccacacccggctaattttttgtattttttagtagagacggggtttcacaccatattagccaggatggtctcgatctcctgaccttgtgatctgcctgcctcggcctcccaaagtgctgggattacaggtgtgagccactgcgcctggccaattattccctacttttaaaataaattataatcgtgctgagagaataaaaaaattaaaggaaagagttcagtgagccgtgatcatgcaactgcactccagcctgctcaacagacaacaaacaaacaaagttatcattcaaaatgtttcccatggccagatgcagtagctcctacctctaatacctgtaatgcccgcactttgggaggccaaggcaggaagatggcttgagtccaggaatttgtgaccagcctgggcaacatggcgaaacctcatctctacaaaaaatacaaaaattagctgggtgttgtggcacatgcctgtaattccagctacttgagaggctgaggtgggaggatcacctgagccaggagaggtcaaggttgcagtgagccatgatggtgccactgcactccagcctgggcaacagagtgagaccctgtctcaaaaaaaaaaaaaaaaaaaaaaattagaccaaaaaacaaaaacccaaaaagccaaaatgcatccaagtatcataagtgaaaaagtgagcttcttagcagccaatatgcaaagggaacataatctcttacacagtttggaattactcagaaaacgtggaactgtcttcaatcctaaagcgtcacatagaaatgttccctgagtctcactgggacaacacactgagcaatagctttaccagaatgttttgtgaatatggtatgatatcaagagtaataaagttattttggaaaaaaataactttagaataatcacttaaaagtctgctgtttttgaccataattgcacatggatatattgccttatataaactacaaagaattgtctatttcacatcacattttacaacttacattgcaaacctcacttcagccttgaggtacaactatcaataaaagaaacaggtcttatttttaaaactttttattattcatatccttggtgactttcagacaataattaacatgtggttagtatcaccttaatggaggaagtaccttatacttcaaacaacccttaccaaaagaacagataatacatatgtattgatacagcattacaaattgatgataattcaaaaaggcaccatgtagcttgtacttgagaaggaattttccctttgcatattgaagggggttctggtggtgttttctttgtccccagccgacttcacaatgaaatgtttctactttgcaccctttgggttcagttgttcaaccagttacaattagttagattagtaactggttgaacaactgtaatcaaagagcacagattgacttgttgtggtctactagagagagatttgctagtggtgttcagcagggctctgtctgtcctcttcaatgtgtgcatgaatgacttgaagcaacatacatacattcaagaaaaattcattaaacattgaatcatcatctaatatttgcctgctattatgacaggtcctgagggaaccaagaaaatgtcagttacatggctctgatgcaaagctgggaagaaggagaaggagtcagaggtagaggcagagagagtaaaagaaagagggagaaagtgagaaagtgagacagagaaagagagggaggccatgttacacaacaggaaatgtaacacatgacctccagctcgaaaaatttgaataaaaagatatttcaaggagtgcgagggaggtaacccttacaattattagaatgaacatttactcattgtcaacactatggagcacatatttgggaattcacctttatttatgccacacaatattatgtaggtgacaagctaacccgtcgtatttaacaatataaacaaaaacacaaatatcctactttattaaactgaaagcagaggactctcatctccccaaagcccaggccattccctgatattagtaaggatactaggtgaaactccttctttcaacatttattgtaattagtgaaaacatgcttaatgggacaccatcatctacaatgatgacaccatatctcaaatcactaatctttctgccatggacagatttctgtatcaggggacacctttgtcattttgtcatccaaattttgaggattctttttcaattctccagcattgactgagaatttaaatggtgccagcattgtgctggaaactggataaaaactgagataacacacttgagttcctactctcagagaatccacttattggattgctttgctataattcctgaatccagtgagattaactggtattttctgttgttcaaaaaactacttttcccctttttgtacagatcagcaataaacatttacatcgagattgtgtggtgtccatgaacaaggcattcagtagggtccaagtctagacttgaatggcgtctctcacatttttgactaagagacaatgtagacataaaagtatcataatccaacttacatacaaaatggaaaaaatggaaccagaacaccttaaaatgtttcctttgaaatatgtgtgtgtttccatcaggtttattttagttctctaaaactctgtaatactgaatactccaactaccaatattagtcaaagctgtttaaaaccagccttcccttatttacaaaaggcagattttacaagacaactatcagggataaacacaaaaagaaatgaaaactgttccatgtctagcaattcgccagagtaaactggctgtatattgaacacagctgtttctgtgagggatttttctttttttggaatttaatattgactgtgctcttgtggcaagaatatagtaaatgaaagattgttccaggcctgagaagaagagaggccagaaacaattgttcccctaggtcctccccttccttaataaccaaactgttgtctggagcctccttgagttaaaagcctaccatttttcatgtcaattacacacaaacaggacttttcttgtcaccttccctaaactgaggaagacacaaacccagcaggaaggcaattgtaaagataaatttaaaagtaagaaggcaagcctgaaatgcaaacataggaaagagcctcttattccctacacttctcacttttcatggaccattgaaggctgtttcttaccaaattgaattctttgaaaagagaaaccatgacaattttccccaggctacggtaaatatattttcttgcacatttagtttttgtttcataacaatcctaataaaattagatgcttttagcaccttacttaaattaagaagacctttcctgctaatgtgcccagaacctatctgggttactaatattaatagttccattttatcatgtacttaactttgtgccaggaattgtacacagcaccctatacatgttatggtatttattcttcccaatagtttgagggaatcatgcttgacatagtaatccattgatcacttcttactttgatctctacttatcctcttgtaggatcaactatgcaaagtggtggattatagcacaatgttaaagggcagtgctctggagttagatggtctgtatttgaatcctagctgcaggaagttggggaaagtacaaaatgaagatagtagtgctaccaatctcaaaatataaattctggagattaaattaggtttaatatgattgtttggtccatctctagactagtaccttgaccactagtactctttcagagatttttttatgttttcaagaatgacaaaaacgaaattctatacacaccctgatatccccaaagacactagtgccctggggattggccatgtgggttactaggttccatttatttggttatggaggatgttcttcacccaagttaatcctttcacaaaagctcatttttgttctttttcctgcagcttccctcagaagaagctgtggccagtgaggatttcagggtcgcttgtccccaggtgatatgggagtttcagctcaggaagtgactaggttagatgtgggggcaaatcaagaccttttcagccactagcttaaggctaacccaccacagacctaccttcttgaacaacactgggaatttgggtaattaaatgctaggatatcagacatgatgtgattaaatcgaagggctgaaacaaatctgacattctgtgctcaaattataaggttagcaaataagaaaactagaaatatctctcttctaggcaagaatgagaacataagtctacccaaatgtgctctacagaggtttcaggtttagcatcttgcttaaggatgatgcttcatggtttagagagaaatgaattctagaatgtatcctttgcttataggacataacccatatttatagagatattttcaatatggtggagctagtggtagggtagaaagaacataaaattgactataaggaaatataaatccttttccgagctccttctccttatgcacacatatatacatatttgataaaataatggccctgaaaaaatattagagtggttttcttaaaacctaaagaaaatggtatccacatcagtgatgctcaattgctttttattatggacaatgaaaccaaattagattaatcataaggcaaaatttcaaatgaaaccagtaatacagacatagtgtctgtaaggttttatagcagaacatcagcaagatagcagaaacttaatgcatgaagtaacctctcaaccttgttaaagaatttcttttatatttcttgataaaatagtttttgttacagttagtaacattattttaaaaactgtacgtcttcttagctgtacacagaagtgagacatcactaaccagagatttcaatataaatatcttcaagtaaaaatgacatagtacatgttcagagatagcaaatggaaaaacagtggattgatttttataactcttcgtgaataaattctttaatgcaacaaacatttattgaattactgtttttcttggcactgaggggaataaaaaatgagaaaatacagtctctgcctttatggagctctcagtcttgtggaaactcatccacaagatggtcacatgcatatgttggtctagtcccaggccttaacaaactatggccctcaggccacatctagcccatagcctgtttttgaaataagattttttttaggtttttattttttttgtttttggttctggggtacatgcacgggatgcacaggtttgttacataggtagatgtgtgccacagtggttgctgaacctatcaacccatcacctaggtattaagaccagcatgcattagctacttttcctaatactttccctcactaaaccccactccctgacaggccccagtgtgtgttgttcccctccctgtgtccatgtgatctcattgttcagctcccatttataagtgagaacattcatccacgtccctgcaaaggacattatctcattcctttttatggctgcatggtatcccatggtgtgtatgtaccacattttcttcaaccagtctatcattgatgggcatttgggttgattccatgccttgctattgtgaatagtgctgtaatgaacatacctgtgtatgtatctttgtaacagaatgatttatattcctttgagtatatactcagtaatgtgattgttgggtcaaatcctatttctggttctagatctttgaggaatcgccatacagtcttccataatggttgaactaatttacattcccaccagcagtgtaaaagcgttcctacttctccacaacctcaccagcatctgttgtttcttgactatttaataatggccattctgactggtgtgagatggtatctcattgtggttttgatttgcatttctcaaatgatcagtgatgttgagcttttttttcatgtttgttggctgcatgaatgtcttcttttgagaagtgtctgttcatgtcctctcaaacaaaccccacagctagtagaagacaagatccagaacagaactgaaggagatagacatgaaaagccctttgaaaaatcaaggaatacaggagctgattttttgaaaaaattaatagatagactactagctagactaataaggaagaaagagagaagaatcaaacagacataataaaaaatgatcttccatgtaagacgcttatcacaatgtctaagggacagaaagctgggagtctatggagcttatgagaataggctttatgatagttgtggctccttggtaacaaaagcttgccagtcaacaaaattcagtccaaaatctgctttcattactacattagacatgatggcttagttgtgggagaggacacctatgtaccttatcctctttcaattaatgtagactatgatattcaccaaaaagactctgataaccatgaagggtcaaattagctatgtcaattcatgatgattaatttgaacataaattattaattttgataaagaggtattacctaagctttaattaatgaacgttccacttctacttaggacgtgaaagtcaccctgagtttatgtcaatagcattggctgaaaagtcttaatttctcatctggctttttttttttttttaatcgaggatatcccttcctccaacccaaatatattttcagcaacactcatgccaacccttatctgatgttgagaagctgtgaatttgatagcagaatcataacattttagacttaaaaagtgctttaaagatcatctacttcttctacccactcaactaatagttttatacttgaggaaacagagttgcatggaagtaaaggaactcgactaaaatgatcaagctagagactgaaccaggatcagagccctttcccctgcagccccgggaaaaagaattcatgttgaggaaataaggaaaagtgtttaatactttcagctaagcataaaattcctaagaactcttctctataaacagaaaatctaaactctccaaaagaatcgcacccccttagctgtaacaaagtctctgcagttatttcacagctgaaagccaactgacactgattcctgggtggtttcactaaaatagaattttctgaaatgcaaactcacctcccaaggaagaatatgaatttgaaagaggaaaggtgttagtggcgccaacaacttgctaccctgctgagaagcttccagatagccagaaacacagcagggagtagcaagaaacagaagttacagatgaagctgctctttagtcacaaacttgtttctgacagctcttgttgaaaaacctggggacagctgaacagaaacgttagtccagaggcagcctcagggctcaagtgctcaaggatctcatctcagtgtaaatattccaacttcctctcatccttctcctactgaggggaggaggagaccaaagggagtagacgatttgaaggcagttgctaaatgagaatcgctgggtggtatgcagaaaatagcatggttagcttagatcctacaaccagttttcaaaaataaaggaagtaataaccattagcataatgagaatacaaatcccaagtctccattactttagacagaactctgcaggagaccacctaaggaaaatctgggggaaaagaagtttccaatcaattgcagcagatttaactgattcccttctgtgggcacagcatggtattgagagctttggggattattagggaaagagaggacatgctttctttccttgagagattctgattctgggtgagacatggtgactatgtgcatctgaatatgctacaaggatataaacaattatacaacgaaccagaactatgctggctcagtgcccagggaagtcggaagaattcaagtcaggaccttgagtcagggatgaaacaggaatggttttatgaagaagtcaatttttcagctgagttttatacatgaaaggccatctcgtttagccgaaagtacaggaagggcctgtacttagcatgagaggcaggaaagcaagaaagcctttgtataaaatatggtgaaagaatcaacaaaagcttctgaagcctacatttatatacagaacttattctttatccaaaatgtaatgtggggattcatgaagatggcagaactccagtattctgcacattaataatgcaatgagcatgtctatggcactctaatcccttaaaatttcatttgtaaaataattatccttgttctcataacagggaaaataaaatcctaggctacagtaacaaaatatattatttaacttaatgtcaatgttaaaaataaaatagtaagaaacagtctgatattatatttcacagttatcaggattgtgattgtaaatcctataaatgtcatatcctgattaaccttttaggagaaaaatactccattggtgtagttctaacactgtttttgagatgaagcaaaatttctcatcaatatttctattctgactgtttggatatttaaaagtcatataacctaatttcaattatgttataaagaatagggttaaccaatagctaccacctgaggagcactgactgaaccaggcatacggtaggaattttacatggttttatatgtgatactaacaatagcctaataaggtaccataactccatgtacattttacagggaaaggaagatgtggaaagttgaatgaatgtgcccttgttcacaatgcaggcactccaaaccacagcatattaaccaatttgacaatcacctcttagagggttctctattgtcttctctaataggacctgcagaggaaaagatacaaattccattctgctttacctctgcagtaagtatggaaatgtatctcacattgtttcttattcatgtcttttcaatctgcctatgtcttcagagaattcttatcactacattgggaaaattttctgcaagctgacatatcacacttccagggaatttttgttgatataagaccattattttgtcccaagagttctcataattgcccttagtataatcccttaagtctctttccactgcagtatttatcttcttttaaaaataatagttaaataaaaattaacaatgtaaattagctaaaaaaattaaaaaaaataatatatccattcatttatctagccaggctgtaaatactcctctgttgcataatctttcaattctttcatcatactttcttctgctctcttcactcccttcaaattgtctgcatattttttatccactaggattgagtttctgtggttgaggctctgcctaaaagctagttgggaatcacaatcaaaatggattgttcatcatttactacaacctaactataacttcctagtttttgtctaatacaagatctgctctttatgccttcatcatttccaatgccaaattattccagcgatttttaattggtagcatattattaatacactatgcatcttcttttgtatattatgatatattacttcttgttgacatctcaaccagaaaaaaatggttgaggaaaatgcttataaaggttatataatgttcagatcttattcattagcaactctcatgaaattttctttggtaaggaaagggaaacagcccaatgacatttgtgcttatttgtggattttacttatccattcactctttcattagctctcatatttgactacaatttcctttgccaattacattataaaaatcaagtacatttccttcaggccttttcaaagttttccccagtgagttttaatttgacttctgatgcatggacctgctttgacaatatttaaatagaatatttatacaaactgatgcttcttttctactcgttttagagtatataaactgatatcagaaggctaaaataacatcaaacaaagttatcctagagcagtccataagtaaagaattataatcttcagctccatctctctctaccatattcattacctttccatagtctcataatatttttctaaccttatggtctaaatgatctcgttctgtctgtctatccatttgtctgtctctttctctccctctgcaaatcagataactacattatacaaatataagaataaaggttaatattattcatatatatatatatatatatatatatatatatatatttaagttgttttattctaagttctttatgttactcattaaaaccccaccattgttaccagggatttataacagatttattagtccactgaatttacccaacattgctaccagggatttataacagagttattagtctactgaatctattctgccaaaaaatgtgctgatacagattctgcccaatgagcataaagctatttttaaaaatataataattataataatatatctataatgtatatacgctatagggttaatagggtaagtttaatttgcaaaacaccaaacacaaaattaatttcataattactgaaactagaaggcaaaggttctgagcaggggcccaagatttatgtttcaggcataataacattggtggacaaggttgtcacatttcagagatgtggttatcatatctcacatttaaagttacaattattataatgaaataaataaggttgacaactgtttaaagaatttttgagtgaatagtccagtataaatgttttactataacactggaatatttaaagttacttatctaagaatttaaatttcaactgctttggcatggatatcatcattctgaggttagaacttctgtgacataagcaactattttaggaatttgacagcattaaaacaaagttaaatagtactgttcaaactggatgcaagaactcacaggaaaaaaaacaataagtgaacatttgagaagataggcaactttgctagcaattaggaaaaaataattaaaacaatagtgacagacatacctcatctgacaggcaaaaattttaaaaatctgatttaaggaaaatgtatgcgctgcagtcaataggctgaggcagacatcaggtccagcatgactcagcaagtttggagtgcaggtgcacaattctgcacattatgtaactacaccacgtaaggcgcattaggtgatcacccacatgagcttgtaactggctcagagccactattgtctgtaaaaggtataactaccggactgacactgtacctatggtttgcacctacggctcacactcagacagtaaaggcacgttgaaactgtgcatgattcctctagtgtttttccagctacccaccactcacccactgactcccctcagacctcagttagaacctgacaattggcatcacgaacaggatcccaaggtgggcgagcctttggtccctgctgattctgggttggcaatgtggccacgacatgggttgtggtacctggtcacagctgtgctgcaagggtgaactctgttggaaacctggccagcagtagatgggtaccccacgagcacggagaaagcactgaagcagctggaagtgcagagcaccgagaaggaatgagcctttgacagcagagttggatgggcattttttctgtgctacaagaagtacactcccaatccctgagggatgcagtgcaggaaagggccttttgggcacaggcagggtgcctggaggcccagctacacagcttagaaaaagagttagaggctgccatgaatggggatctccaggtgcaggtggggtgcctgaaggcctggcatagggttggaaagggagttagaggctgttgtgaatgcaggcctgggtccgtcatctcagccagagacccctgcttggtctgggtctgcactgtaaaaaaggggaagatgccccacctgcagagcctccccatcatggaagaaaagggggccccaacaagtgacccactcacagatgtggatagatttgactttggccagggttgactgagagaaaatcgataagcagcccaatgaagtactcttaactttgtggagataactgtctcaagagcagcaattccaggaaatgcagaaggggaaggaggacattgctgtatgacctggtcccactcaggtgcttcaactcaaagactacttgctgcagccaggtggaaatgttgagctttttctgtttgattagggaactggctgaggtgcctggcctggggggacaccagacaaatagaggccacatgtgaaattagcaatccactggtcctccaccaacatacagcaagtgctggcactggtaaacaccagcgctgatatattctgggggtggatgttttacatggcctgacagccatcccatctattacagatttgatggaccgcttgatgatggaatttggacagtgccactatgtggtggacttgattaatgcattttcaattaacattgctctagagagccaggaacagttcgccttcacgggaaggtgacagtggactttcatagtgttgctgcagggatatatgcatagccccatcatatgtcatggtcttattgataatattatgttaacctctgattctcttgcagatttagaagcggcaatgctcctcttgcctagaattaagatagtgtggctgagactgacttcctggcagctaaataggctattcagcaggcacaagccctatgggtagttgaccaagggtgctcatttgagttggatgtgcatgtgaccacagatggttttggctggggcctgtggcagagcatggagtgcttgagaacaccagtaggcttttggtcccaactatggaaagaagctgagctccagtattcactgatagagaagcagttagtaactgcatatgctgcccttcgggctcatgagagcatggcaggacaggctacagttgtcgtgtagacgagttacctgatagcaggatggatgtgttcattgataacaaccccccggactgggacagtgcagacatccactttagcaaagtggggcacctacttgaagcaacagagtacgctgagtacaagtcccttagcagcagagttgcaagaggtcttgagaccagcagtcctaatgcaagataaggccatggggcctaaggacatggggcctgaagcacccctacatgctgagccttcaccatttaaggaagggcatccccccctatgcccgatggggcacggtacacagatgggtctagctggggtgctgctactgcctggactgctcacagtccagcctagtactgactccatatggtttcataccgggtatggacaaagtagtcaatgggctgaagtcagagcaatatgaatggtgatcaccaaagaggtgacacatatgataatctgcaccaatagctgtgtggtctatcgaggcttaaccttgtggttaggcacctggaaaatacagaagtggctagttggccactggcccatgtggggctaggccatgtggcaagacctatgggaggaaggatgacctcctatgaccaggatggaaacggatggtaacctgttgttgcatgccccaatgcccctaaaggtagggaaataaaaacctggcttaatgcataaagtaaattcgggtaacatcatcatggggtgtttgcccgtcataacctggagttgttgctccttgtattactgctgtggcctctgggtctggggttccaccctgtgggcatgtttctccatttaaaagactccttcagcctagggagtagaatttaaggcctatgtgtcagacctgtgtgtccagggcctttgtccccagagtgtacgtataaggcctgtgtcttagacctgtgtgtccaaggcctgtgtctcctttggcattgagggtggagtgtaaggaaaatggatgtgctgctctcaaaaataggccgaagcagacatccggtccagcatgactcagtgagtttggagcacaggctcacaactctgcacattatgtaaccacgccacgtgaggcacattaggtgatcacccatgtaagcttgtgcttggcttggagccactattgtctgtaaaaggtacaactacgctgctgacgctgtacatacatcttgcgctcatggctcatggccagagagagagtaaatccatgttgaaactgtctacagttcctcacgtgtttttccagctacccgccacttgcccaccaactccccttggacctcagttagaacctgacatctgacaaaatcaaatgttacaacaatgtgataaacaggtaaccctcatacaccgattgccagacagtaaactagtatagccattgtggagaggaattgagcatcgtatagggaagttggtaatcctcttactttaagatccagcaattcaacctctggtcacggacctcaaagaaactctccaaatgagaacaagcaaacatgacaagaatattcacagtagtactcattcattcatttatttattcatttcacaaatatccattgagttcactgctgtatttgcttgggatatctctgggactgaaacaattctccgtcttcattggtatgttccaggacactgcttttgggtactgaaaagtttaaaatcaccttaaccaccaatgaggcaacaaagtagtgtgtaatcatataatgaagccatgtaactcaaactgtgtgcctactaagcacacaccagaaactccaggaaatcacgacagctgtacactctaattttggacttgtttttgcatcagttttctgaaagattgtcatggatgcaagcatgttattattagtcattgataaaagagcacagaaagaggatgtgaggagagcccttttttccttagggataaaaccctttcatcttggctttcatgaaacccattaccaggcaaaactgatgcgaattcctgactagaagaaaatgttctcctgcctttattctctctcagatgactcccattaattgatcccaggagattttctcattttgctgccttccctgcatccagccttcatttaccatgaccatcaggcatctgcagggccttgacctggaaaagctgccaccattcctagtagaggatgaacataaattctcactctcagaaatgcaaatatttcccttgctgtggggatgcataacttcagagaaaagctaagcatatggagcaccccatgtaaattaccatctcatacaacaactcactgtaaccttatctttatttcttataaatactgtttgtaaagaatataaaaaattgaattccacatgcaagataaaggcacagccacaatttcagaatgacatctaatatttctgaagtaataaaataaatgtaaccctgtggaaaaataaaacatttaaataaaatagttacaaatgcaataggaaactaagaaaaattattaggatagatccaatgttacattaaactgaggacagctcttcactgtgctggcttcattacgatatttaagaaatctgacagttgcaataattagaaacatttaagtttccattccagctagcacagacaagcccttgacaaaacaataatagtggcaagagccaacaatagagcacttactgtaaaacagcagacattgtcctaaacactatacatatatgtactcattcagtcctccaacaaccctacttttataatccccattttgcagatgagggaattgaggcaaattgtcagttacctttgctaaatcagcacgtctcaacttcagtgtacataaaaatcttctgaatatgctgtaaaattgcaaatgctctagccattcccataacccactctgattcagtactgttggtttggtatagactgcccacaatctagtgttacaatctccattttcgagaggtctgaggattgggcttggaaaacactgctccaattacactattcccagtgatattcccatttatcttcaatgcctctctgatgtttgggtcattgtttccatgtttctgaagattccattttgtttcatttcagagtaagaatacttatttcgatccaatgaatttgattacctattctatgtccatctaaagtttaatcaaaacaaactatactgatatgtttacaccttaattatgtcagcttgaaccaaagacataagactgttgaagaaaactcatttctcttttcacaaggaacctctagtaagctggtgaacaccttccttaatttttaaaacactctaaataggaaaatctctggaatctctcctaaacagacatttgcttaagtaaggattacaactcttgaaggcatacatgaaaaattcagaagtttctgaagaatgcttggccatatcatcattcaaacgcacataaagtaattttatcagcacaattttctttcttcagggccctcataaaaggaagattctttgactcctttgcagagctataaaccaagagtaacatccatactgtaagaacagaggctgttagaaagatctcgagattgtgctcaactaaaaaaaattcattttcttattttcacagtgatgaagaatgattttatacaatgaaagaaacaagtcattgttttcttcatccatggcaatattctccctgtctttcaagaaagattgaaaatgtctttcagattgtagtaatttgaaaagttgtaaaagattgtaaaatagaggcatatttatcagatttgggggaataaattttttttgaaaaagttctcagatccttttgaaaggagtttaaattgaagtacaataaaggtacctgctctcttctgttacaactaaagccagccactcttagaattaaaaaaaaaaaaagcctcttgtttctggtttcatataaggagacataagtggcttcaatgctgaacaggaggtaacactaaaggggtgaacttttgagtcaggccatgtaccaaaatgaatttctaccccaaaacaatgggactattctaaacatgagccattggtatgctggtaaatatttatcagttggctctccaggagaaaaaaaaaggcctgatttgtgcagtatgtccatttccatggtgtaactactatcagcatgtcttatttcaagctaccaatgtgatggccctgaatgtggagttgggaagagatttgtagctgcacctcattatatagtatttccacgacacagatacgatggactacataacctcaagagcatggataatagtaaaatataatgaagtacttgggaactaatgagttttgagtattgattacctttgcatttcatataatttatttaattacgggtttatataatttaataatgcctgtgctttccaaccaggtctcaaaatcattgaatacgtaacagttagtactcctgagctggtactactacctggctccaggctaccattgcatgtatctcaccttaagcaaaccttccacaatactgatccacttttatacacatgcattaatgaatgaaattacaatattatttaagtagaagttttatcccatgaatacaagctaaggctttattaatacaactcaatatctacatattttatagcataacactatacatttcagtgttaagagatattttagagatcatctgatccaacccttcctaagactagccatgacaactattggggatgccatctttattcattctcctattccaaaattccaaaattaccactttatgcaaaaagccacattcaattcaaactctgctatttctcaagaacatccataatttcactcaactggtatttttcccataaaattctcccaaccagcatccaacataccaaatcagtggtattctcactatcttctgtaaatgctatgtttattctcccttctgaagctgtttcttccactctgtcacacattcattcatttgcattttcaaggtgtgtatgtttgtgtgtgttttaagagaatggtagactatttacacacttgttaaaatgctcactttttttaagagatgggatcttgctctgttgcccaggctggagtgcagtggcatgattgtggcccgctgcagccttaaaatgctgggttcaagcaatcctcccacctcagtctcctgagtagccaggtatgtgctatcatgccaggctaattatgtagagagagggtcttgctatgctgcccaggcctgtcttgaactcctggactcaagtgatcttcctgccttagcttcccaaagtgttggtattataggtatgagccaaagtgtctggccctaaaatgcccatttcaactacagaataagagtacctgagcaagagcatctagaaatctgctttgtaaacaaggacccctcaggtaagggtaagatttctaaagtttcaagatcaactgatttagtgagtggtaactaaatgctaaggtgagaataagagagcatgaaacacaagatcaagtggtttaatggatataaacctgtaaacagttacaactctgtgttttaagtacaacaacatagtggtgttcaagaccatcattaaagacaaggaacactgaccagtgaagggaaactccttcacaaaagaggggagggctaagccaagtgctgaagaaagttctcttttgctggttctcaggggtcaaggcccagagtggctgaaaatgaaattacatagagtctaaacaagggccttagtatgtttagacttctctaagatagaatttccattatttgcttgataagaatcacttgggttctatacaaatgtagatttccaagcactgtcctcttgtattagaggttctcatttagtaggatggagaagagctcagaaacccagcagttttaaccttaaagaaactgttataggagcaagggccacagagaagtcttactaaaatataggggagtaacactttcagatttatgttttaaactaatatttataagtcttgtctatttttctcagtttagatcgagtttagcacctagtgaatcttatctgattgttatagcccaaactgacctcttcattttatacatcattaaacttggagtttgaattatacttttacttatttcctgtgtattattatttctcttctattgtcaaccctgaggaatagaaagtttgtctctctgtattcttcgtaatgcctgatgcaggcataagaacacagacacaaagtaaaattggttctatgaattctcagtacgtagccctagtttttaggcatgttaatctggaatacaattttaaaagctaacatttaatgagtgcttatgtgctagggactactggaagtaatttacttatattatctcatttcattcaatcaacaatattgtgaggtagatgctagtattgtctccattttacatataggaaaattggggcttaatcattttccaaggtaggctgggtccagatcatatgccctttattaccaagctacactgcttctccctaccctgccccctaaaaatgctgtttaaacaatgaatagataaaagaaagcaacaatgagattataatcagtagcaataatttttgaaataattaggtcagagtcctgcataaaagatgctactataaactataaagcaatccaaattattctaaatattcccaggctgaaatctgcatctgccagctatgcatcattgactcctacctatgctcttgattaaaaatctcctctgtgtcttcacattcccaatgggagtcgcatatcaggagaggcgcatccatgggtgcagcaagagtgacaatacatcacagcctcgacatctgtgacaagcccagccttttgacagtctagtgagggggtgtgcatcttgaatattaccagatgtgtcacaatctttgttccccaaatacttactcccttttggataacaaaacagcagaagacactactcagaacaattaaaaaggtttgaatattcccataccctataattaatcttcattcaatcacaagcatttctgttcaatctattgcttgaaatgaaatgctaataaggcaagaaagcacaactttaggacaatgccaaaaatggccttcgtttctcgtcttttgacataaataagatgcttttgatcatattaatgagtgagaaatgtgcaagtctctaatacaagattcagttaaattacattcatccttggagatgaacaacctgaatttaaaaggacaatttaggctgaataaaaagtcaaagcacagtgcaactaaaagtttattctaacttaatttaaagtattctagaacctttgcaaatcttcattgtcacacattttcacccttttcctccagtagtttttttcccaacttctgccatttctttaattctttccatgttcctatgatagttatatttattctggatttcctatgtctttaaaaattgttttaggtgctggttattatctataagaaatctaaagtgagtagaatgatctgtctcaagacattaaatagaccttgttggggtttattaattatttcttatagagttacaaacagtttagagggcttataggtgaaacctatcataagaaacaatgttatatgttgaacatttaagctccttgtataccaggacattactaggaatttcacttgaatctaactgggctcagtatactcctatataccaaaagcctttattgttgaaggtgcatagtaggaattcagtatatatacatggaataaacgtgtttgccctttttctgttgttgaatgcttttggaaattcaaggaatgaatgtgaatgctttctgatttttttacaattgcttcattattatatagtcatggttcagccttctttataaactaataatcttactaaatgctttcaacactgatcaggatgtgactcacctctgtgtcaaatacagaaggtactgaagtcacatcaaaaccaaagcaattttcatccctcatattcaggtctagtggaatagaacaggaaaagagaatctgcatataccttcaatgttcttgggtgacagaataccttaaaaaaacaagtatacaaggcgtttcctaggacagtcaaatgatgaaatatgggcttcaatctcctgggtcctctagttttctcatgaccagtatgtgaatataggcaaattacctgaataactcaacatgttttcttacccatataagaaaaggagagtaaatacctcatagaatgtggtaaaactaaatgagacattacatgcaaagcatttaacacagagcctagaacagagtaaatgctcaagaaatacggactattgttatatttctgggatttggataatttttactaatgtggataaatacagatgaggcgatcctacaatgagaaaaacagaagttgtgatgtgtgagacttttcatttacatacaaacggatatggaaaatggattatggatgcaatgtccctgataggaatggcaagggcctatttgggcattatactttattcctgaatcatagaagaaatcctatcaccaaaatacccatatgggttttcacattaaaaaatatttaaacactttctttagagatgcattctgagacccacgtaaggagttgtccaaactaatattgaatgcatttgacatgacagctgggtttgaaaaagtgctttcagcaaaagcagaagccactggttaacttttctccttgtagttaattacattaaacaattttatcccaaaaagggaaagagagattaaaatccaggttatggagcattcattgaggttttcttttcttttctttttccttctctccttccctcaggtagcagaaaatcatgagcttaaaaagaagctgacctggcaatgtttcccagacttcttttattcttgacttggaaaaaggaaaaattgagggattgagggatggtgattttacttggtccttctaggacctatttgaagactcttctagagtcaggtgttggttgaggttcacagctaattaatcactggaaacctggagagaatagcctgaggtattacaataacctaggtatgaaggtttctacaccccaaatggccaaattgctggctacttctgggattatctggacacctgaatcctaaagaatatgaagtcccaggatcacttcctcaagatgtcaaattactctgatagagaaagataatttttatcttatttattttttcctttccaacctttattttaggtttagagggaacataagcagctttattacatgactaagttgcattttgtaggggtgtacagatcattttgtcacccaggtaatgggcatagcacatgataggtagttttttgagaaagatgattttcaagcaagactggaaacagaacaggtagcagttagaaaatacatgtttttgtttatttatacttaattatgcataaataaaagtgtaaattatgaagtcacgatgccagtaaatgcttttattggcttgtccacagatgtcctcccttctctaaccccctttctcccaaagtgggtgtgagtgcaccaccaggtggtgacataatgaaatgacacatagggcatataatgtcaggctgaggagaattttggaggttccaaggattgctggaaataactgcacaaacatggctctattactagagcttttgtgtacttgaggttttatttttgtttttgctgaagcccaatacaaatatataacaacattaaattgccatttatgactagaattttaaaacctaagtcaaacatactttcattgaacctggctctgcttttcatttattttgtcacacagggcaagttatgtaatatttttgaacctcacttcttcatccataaaattcaggataataatggctgccatgaaatagtttaattggaccttaagactgactatctctccaagattctttcctcttctccctccattccccaccatctccattgtctactttgttccttggctttacctttccttctggtttgcccgggggggataaatacccacttgtacatcacctcctcaggcagcgctgctcagcccatacctccgtgctcatgccaggactcatatagcctttagcctttgcattctccacactgtttagtgtcacttgtttccctgagttttgctcactgctgggcctgtagcactgggtccatatttctatgcatcttattaacctaggcattacacccaagatataaacacattgtagatattcagtgactttttgttgaatatttttaaagtataacaaaaagcctttgaaataccaagcaaaaaagagtacgtaaaagagcaagaggactttctgaaggagtatattcattgcccaaaaaaggagatctatcccttgagagagaactgtaaatctcttctactcagcttgcaaatacaactattaagatcaatggaatgcactgcatataaagttgatttatagccctggttctttgtaaatgttaatagtaaacctaatttgaaatgttatttaaaaagaagctaccatttcagtctaaagcatttactttaaatcattaaaaattactttgtgttccttctcattgggatctcttggacttaggaaacaatttgaaatcctaagggctttatttaattaaacaaactccataaacattaaagttagttgttttttttcatataaataacagataaggtccctaaaagattgattggaataaagaagacattgatttgaatcagtctctaaacaattatgtgactttggccaaattagtaaacttctgagtctcaatttccccatgaaatggttaagaccaccctaaggactgctatgagggttgaattattaatgcccacaccactgtgtctggcactgagaagggttagctctcttctttcatttcatccacacctactcttcaacatatacatttctctaaagtcaatgtgtttaattttttttaagttcaatgctaacaaatattaaatgcttcttttcccaacactataattttaacaaatgagtttcaggcatatttaaaaatgagtttcaggcattagatcatgtgaacataactaattatgtgaaacatttttgtccaacttctacataaatcatagcttcaaattatatggtcataagcctacaagatactcattgctatgcactgaattatgtccccttcaaaattcacttgtggaagccctaaccctttatgtaatagtattcggagatgggtcttttgggaggtgatgagatcatgagggtggggcctgcaatgatgggattggtgctcttataagaaaagacaccagagagcttgctctttctccaccatgtcagaaggcactgactgcaagccaggaagagggcccccaatagaacctaaacatgctggcaccctaatttcagaactttcagcctccagaattgtgagaaaattaatctgttgttgtgtaagttatccagattatagtattttgttgtagcagctggagctgactaaaaccctcatgtgccaacgtaatatcgttttagttataaatttaatattgatacaactttagctaaaggaataaaatctgtatgagaaacaatataacttttcaacagtatgaagatatagttcttcttattcataaacacacatatacacttgcatacatatatgtaaactatattttgaatatagaagatcaactatatagaagatcaactatatagccatctagtttaactcattgatcatttaattcaacagagttgagcgcctgctatgtgccaggcaatgcactaagcaccgatatacaaagataagggagatacattcttatcttaattgagcccacagcccaatagaggagaaagtcaaaacatacgatatataataaggtatgataaatgctccagattataactaacataatattaaaagttgttctcatactgtagaacggttcttccctaaaactgtatcaactccacctaaattaatccaacaatagcctcctgacatttttacttagagagactaatttagcaggcatctaaggcagaataaagtgtttacctcaacttttctatcaacaatgttagaagtggaaaatacaacataatttttgagtctcagctcctgtcaatttaaatgaaaatagacagttggttcagcatatgttgatttcttaaaatcagaaatagattttcccagcaatacgcctcagggaaaataaaatgtgtgggctggtttatccacgcattaaaagcaagcttccagctgatgtttgattacattcatgaagaaaaaaatattgtaatgagaacatccaattactctttccacaggagtaaaaatttctggtctgagaatttgtttcaaatcagtggttagaacataaacaaacaaataaaaaaggggaaataagtgagaatgagatcctcagaacagctactaaatttgagtaggcagagcatggtttctggagtccaaaagcctgtttaaagtcctgactctaatgtctactggtaaggtgctggtgggcaggtttcttaccctctgtgagcatgttcttttactcagcagtaacatggaaccaaataagacccattgatagagttgctcaaaagttcaagagaataatttgaattctctttctctcaatgcatgccatgtgtctgacctatgacaggctctcaatacttggtagacaataggaattattattattggaaggaagagaaataagaaggaacagcaacttgaaagactactattggcttcattgaaataggatctttgcattttgccttctttatctttgcatcttgtcttctttttactttctcttcacacacgtgacctaataataatagcatctgtagtaactgttgtgttatcatacagtagcacccagttttgtaggtcttattttacttaatttgtagtcagtaaacatattatccccatttgatagatgaggaaattgaggcttagacacgttaaatgtctttcccaggtcacacagtttggaagagatgacattaagacttgagctctgatctatcccgactctaaagttcatggtaatatgaacataatataaaagggaacatagtataatacaaaagaacataaaaataatacaacttatacaatgttaactttcaattcagccctccaatgtaatctgaaagatctttggtttgatttaaaaatcaagtcaaatctttgtatggcatttctcctgggaggctcaaacaagtaaacattctaccctgacgttgttctttccttttctctcctttcaagttattcaaatgctcagtaataagcagctttcaactgaatatggtggggcaaagccagctgctctttctccatgtggtagctcagatggacacctcactcttggtgttactgtgtagctgtactcccttaatagcctggccagctgtcttacataaacaattattcatgattttaaattattaataatttagaaggaaaacagatttcctgtgactatatggcacaatatagtacataaaattgggtttgaatatttgttttctgcacatcctctatagttataaaatgtaactaatgatttgtgtttaatttgtctctcaatccaattttggtagagcaagatttaaaataaatggctgtagatttcctaatttgatcagggactctcagttgttacaagtacatatgttatttcatataaatgtgaaaaaaatattttatgtttttatatgagatccacttcttatgcttataatattatggctcccagatgttattaatgtgaaagtgtttagagaatttcctctgaaaatgtcatcctatccctacacaacccaagattattgcaatagtttcacaaatgtcatggtttataaccttacatttatgaagaaactgttgacatcctatctttagagaatgagaaagaaagaggaatcattctgaacagaataattccaggaagcatcttggcctgacacataggcctgcctagactcggtagattttactaatatgtctttccaattcatttgttgactatatttagctttataaagttaaaggtgagagagcctcaatgtttaatatagcatctactccaatggttctgaaacactaaatcttctccttgagaaagtttgcaccagaccaacagaaagtttcgtatatttgtgattaagctacatttatcaaattagaagcacgattcattattctgacatgatctttaccatttttaaaatttataatagccatgattttatcaaaggataaatgcagagtataggatattttcaaaaatgagctcacctggcaaactaaaagtaggcagtgtaagtcgccacattccaaaaatcaatatttaaaattgcaaattccagaaacagatgaggtctgtagttttactagtggaaccactaatacagtgacttgagtatttttttttcacttagtatattttaactatcttcatactaagaaaatacctacgaaagtaagtctagaaaacccaatatcagcctgtcaatatttatattattcagagggatgtatatacatcttaatcttttgttgtattcctatataattctagctatatttaattctagttacaaattaattaaaaataccactcttaacttttctgggcatggggttgtaaccatgaaaccaacttcttatgccttctgaaaccaagtcaaaagtcagacaccttaaaaatgcagtcttttgtacacaaatgtacaaaatagccccagaatagaaacctaattgtgagtccttagataactaggactagaaatccttcatcgctacactcctggtgcttaggacaacagtgacaggtaaaggcactcaacagactatggaatgagcagattctaagagtcaatacttagggtgaaccttgctctatcacaatacttctcaatctaaatgatactgcagacctagtaatataatttgttccaagccggaaaacttcaggaatgtgcaagctggaatggggaagaaagaagtcaaatcctttatcactgagaagagaaaccaagggagaagcaggtatggagttccgatacgtgcaaagcttcgtagatactaaactggggacaaccaggttaaagtgaaataacattacagctatgtacaaaacatgtttctgcttccaaaccagggtaattaaaaaattagaatgcagttatttattttattagtattagctattagttgagatcaatttttaaactttaaaatgcagtcactttaattacaaacttttactttcagactcacatatgcacggaatagtggagagtagagacatttattatttaaactagctctgacaatgagattcatttaacaagctatttcagatcaaaacagaattggggactatcaatcagtttcctcattctcccctttcatttttggatcagctataaatagtcacaaaatgtgtccatttggcatcttctgtggcttccagggtttaatttcaacactccttgatatcacagaatcactttaaagaacagagaggttgcagatcaattattgtagtcatgtgccatatagactttgtgtgactaaccccagactatttgtctattttaataaaaggaggtcatgattgtgcagaaagtgaaaaactttttattaatctgaatttagcatatttatggtattatacccctaacataatagtatacaggtaatatcatctgatattttgtttgaaaacccttatgttatattgctttttatatctcaccaactaattgcttttctaatcccaccaaatttagtggtgtccacttaactataagactgtggctgacactgctgattgtatatacgatatccattctccctttcattcttatttatataagcctaatgttaatcacccaataatatgtctagttaaaaaaaacaagctcctcagcttccctggaaggtaggggcaagtatatgaaattgttcttgccaaagaacaggttgtcagagaggggcaaggtagctgggtttatataagctgaggattcctaagaaatccttgtttccctgatacagacaccatcccttcctacttcctttccatttctcttctttaccctggaatgaggagatagtgccgtgggagcagtatcgccaatggtcgtgagatgacaagcacaggacaggcccatatgctgaggatggctggcacagaagaaagaataaaaggaaatcacatatttgagggtatcatagaatcactgtactagccctagtttgctacctcctgatatccttttccacaagaccaacaaacccttagatgattcaaccattgttagttttctattgcttatagctgaatgcattttaaactgacaaaaaaagactttctaatgattttgcaataaagactttttagcacacctgccatacttttaaaacatggccattttgaaggagctggtgccagactacaatatttcaagcaaccgccttcttcctaagtttattacattgacacacattaatttaggttttgttggagttaatgtttccttcagtcatttctttgcttacaaaatactttttaaagtaaatatacacaaattatctaccttagaaaatgcaaaaaagcagatatttgtaagtcatctaagtcagctcttgcttcccttcctaaactattcattaatttggtgtaaagtgcattataactgaatgttgttcttgtatttcatggacaccagttgtcatgctaatgtgcacaaaaggttttttccagagtgaatgcatcaagtaaatcccaatcattgccactgcaaatgctgacagactaaacaaaattgctgacatcttccaaaatctgtctagatagatcactgctgcgcaaacatcattgcagttcctaatgaaaaagcaaataattcccatttgacatttatcttaatttcaaaataattattatttaatcatatctaaccatttcctatagttctcttgtaattcattgtacatagtgtgaatttcaataaaattcactttcctcttcctctgttttacctaaggattaaaaatgaagcaagctaacctgtccttctctgaaaacctgtacattaatctatgcttacaccttttgtaaaaagctatattttattattttattgttaaattgcactgtgaatttcaaatgtcaggagacattcacacacacacacacacacacacacacacacactcactcacgcacagagagaaaggaagagaaaacaaagagacagaatttcctccctaccaaaggggctttgttttgatcagcaagtttttttttggctcattgaactaaattcacaaattaacaaaactccactatgaagatctgatggaagaaggaatggaaaactcttgaccttttggatcccagtcccctgaccggcccttttcatcttcccttattaaatggaaatgatcagtatgagctttcagatttaggcaagacagctaaaagcaaaatcttgccttctgaaaaagatggtaaaggaaaaattggagctaattaaataatgaaatctgtttaaatgaacctatttatgccaatgaaataggcagaatcattcattatgtaaatatgacctttaaggacatatcacaagtaagttgtgaataataaccccatgaataattgagaattgatggtatttaatatttattaagtgactttcacatggatttgagttaagtaagtcaattccatgggcccagtgatggtatccatttaatgatttattcagcctctaaatatgatagtaatgttctgtatgacagtgagctagaaattgcacaatggagaattcaaaatgaataagacactgtccttgtttgcaaagttttcatgtggcaaatcccttaaggagaaaataacacttatttacaggatgaaaaggtcagctccacatagttgatcagcatttagagtttgaaataataattgggtgaggtcttgagggatggatttttattggtggtgatattaaaaagagagaatttcaagtatatggaaggtcaaaatccaagggcaatgaaagttcagaaaagtaatccttttgagctgggatacatgcaaaacgtgagataaaatcctggacagatataggataaaaccatgactttaaagggctcactgaagagtttagattattttgagaagtcagtcatggagacagaacaaatggatgagatgtagtataataagttccagtgtctcccataccccaataaggatgtacatgaattataatctaacaaaagagaaggaagcttggaaagtgttaggattctatttctttctgctttttctacttatgattacatggattagaatgttatctgctgtgctgaaacagagttgaaatgttactttaagtaatctggtaagtatgttattaaaatgactattttaccaagattcaaaaaattgaaatgtcaacatatgcctaatcatcaatgttgtttttgtgaatggtaatagcatccatattaccatcttttccttcctctttcttcccttcttcttcacagtctttaatttcttaattatttaacctttgtggatgagtattaagcatataagttagaaaataccaattttattactttttaaatgctgaaataattatttttaatgagagtattattgacaaccacttcttgttattactgaaagagtaaacttgagttttgaaccaatgggttaaggattaaatctgcattaatctaaatagggaattttaaggaattttttattccagagtctatggtatcataaacttctatttaatgaaatagattatcagaatcacctttcaatttcatggtctgatgtaaaaaaaattctccctgaaacagatacagggctataatcctcagattacacgcacacccaaacacacatacacaggtttgtatatatttgccacctccaacccaggtactggttttatttaaagcattcattttttttttcttaaactatgctcaaaccatggttgacagtttaagaaaagaaccaataggataaaatagtgtattctattcacagcaacagactgaaatagactcaatatctgatgttgaactttccaaatatatacagaaaattacatataagttataactcacacaactcttctatctccttattctatttgtcctaagaatttacaatagaatgaagttccttcaagtaagagacattacagtgctgcattgctgagacaagcctataaagaaaaggaagacggtttgattttgtctactgtggtctccttgtagccctggaatgtgaaaatgtacaaaataatctaatatctcataaacaaagtaaagtgggtttttttggccagatattttctagatagatatgagagaactgtcaagaagcaaaagatattaagataactccatgtattaaatcatttcgatttcattggatatgtcatggacttaaaaaaaattctcttttccttttgtaaagaaaagtcacagttaaaaaacacagaaagaaaagagtttggaaatgtgtgagggagagatgaaaaaagctctctacaactggttcagagattaacctgagtgagtccagtcacgtgcaaaggcttgcggaggtctagactgcaatgtctgtaattgaattttaaactggctttacatattcccagagagagcatataccatgatgtgctcatgaatgcaagccttaataggaattacatactttcacaagcactgtgcttataaaaccccttgaaccctattaatcctatattgaggttttatgtttcttctactcagaaaaatatcagatttatctattgcccataggatatttgttttaaagtgatacacttcagttgggcctgtctcctgaagaagttttgtataaaaattattcacttgaatgccaatggaatagttgagtacagaatcccattaatgtatcatagagtgatattgcagttatgaaacataaatcttaaagctgtgaatctctgcatataaacagattgggagtttagacttgagatgtatataaaggaatgattactaatgtcaaagaatgtaatttgaggaaatattttgttttctattaattgtattcaggcaatctgcagcccaaagtttgagttctaaattattcaccaactgccttgaagtaccatcaaacaaattctaagatgtgacacttgagggggatccttctgcctcaattttttaagtcagtggaataggactcttcaatatatcaaactctgaaattaaacaagctttacaaaataagaaagtgagaatggtacattttataaataacactgagattacatatcttgcgttattcaccaaaatatattttagatggaatagatttagtttttctaaatataaaaagcaagcatgctaagcaaaatatctatcacagaaacaaaacttttttttttcgagacagaatctcgcttcatggcccaggctggagtgcagtggcccgatctcagctcactgaaacctccacctccctggttcaagtgattctcctgcctcagcctcctgagtaactgagattacaggcatgtaccaccacacccagataatttttaaatatttttagtacagacgggatttcaccatgttggtcaggctgatcttgaactcctcgtctcaaatgatccatctgcctcggcctcccaaagttctaggattacaggtgtgagccaccccatgcctggccaaaacaaaacttctttacaataaaaatttaaaaaacaaaaaacaaaagactagaaatagttgcttaaaataaagagtcaaatttatgtgacaaaaagaaataaaatacatgtataacattgtgcacatgtaccctaaaacttaaagtataataataataaattaattaattaaaaaaaaagaaaacaaaccaacagataaacattgattcatcaggtagatattgaaagattccagcagagagttcaagcaaatggaaatataaagggtaaacaaacaaatggaaaataatattgagatagtattttataccatctaaagacaaaacatgttaagaaaattatgatattcaatacagctaaaataacagaatattctggggcactgtaacttgatataaattcctttgaaaataattcttacaattggccgggtgcagtggcacactcttataatcccagcactttgggaggctgaggcgggtggatcacctgaggtcaggagtttgagaccagcctgaccaacatggcgaaacactgtctctactaaaaattcaaaaactagccgggcatggtggtgcacacctgtaatcctaggtactcggaaggctgaggcacgagaattgcttgaacccgggaggcagaggttgcagtgagccgagatcatgccactgcactccagcctgggtgataaagtgagattttgtctcaaaaaaaaaagaaaaagaaaaaaaggaaatgattgacaaaatataggagaaatcatgaaagaagcaatcagttccacagaggttaaaaggtatgtgcaataaagatgttcacagcagcattaactataccagtaaacacctggaaacattccaaatatctaacatttgaagaataattatttcaaaggtaggattataacggttttaaaattttcttctttgcaatttttggaggcagtcttcaaacatttaatacaaaagtattactttggtaatcagaaaattacctgttaacaaatatttaaaaataatatgtgcataatataatatgaaaaatgaatataaatgtattaggttacagatgtttttcacagcaatgagaaattactaaggaaacgacttaatactgttatactctttgaaattctctttggtaattctgcatttacataataacatttaattaattatagcactattgtctaattgagtacaatgactttgatgacataacataaagcctaggcttttaaagtcgcattcctggaagtgagggcatttggaataatctttttttaaaaatgttaaaatgttattttatgactattcttggttttgtatagtttctgatatattacaaaatgcctttcggtatgtattaaattccctagctttgtttatagtagggtaattcatgcgtattggacaggcccctgaaatttttgcctagaaatcagccatgaaatttgaaagaaaaaaattgtgacctgggcaagttccttaatcttactatcattttcaatatttgtataaagaaagagttgacatacataatttcttagcaatctaataggccacggtattgtgaaaaacaactttacaaatgtaagaaattaataacataatatttcattaatcttaaattctcacagtacagtaaaacatattgttagtcttatctataaaatttcaaatgtccacatgaaaattaaaaacaagcccatttagattttgcaaagatctgaatgtttaatattatttttatatattgctattgacccaatgtttaaatcattagctggatttttaccattttcatgagtataaatgaatgtgtatatatgtgcatatatgaatccatatagttatgcacattcacatacatactatatataatcaacataacatatagaatcaaaatattatttgtcttttgacttcccggttttacaaaggcagcattagacaaagctatatttctcaaaacacatttgtttttcaagaaaaaatatgcagagccctatttttctatcagttcgtattatacattaaagatttattatgcacttgctactgatgttaaaatactttaaaattcagtgagcaagagatactgtttctatggcatattttgcttcaaatatccacatgcataaacatgaatagattgtgggacaattattatttaaataaatgtctcaattttttatagacaggctaagtgatacatgcaatgctcagtaatacacgcaatgctgagcaacacatgcaacagcatacataagctgacatatttgtaccaaacatcacatttgtcatacaatgtattctgttgtcagatttgcagaatatggggcagtacaatataagaatgacaaattttgaacaaaaagagttcctttccccatgaataggacagagaaaagtggtgtaatatttattataataaatatcttagtaaaacatataaaatgcaatcatgggggggaaggcagaattatttgttttccaaagtgcaaaaaggaactgtctcttttgaatacacacctattcaagaacatactcaagaaaagtaaacacataatagtagttacctctgggtgggaaggaaaggtgatagaattggggaagggtacactaggggccccagttttacctttagtgttgtatggtttgaactctttgatgcataaatggctacactatcatctatttttacatgcctgaaatatttaatattttaacataataatataaaatatatttctatactctagagtatatttatctttaatattctataatttgtaaaataatacctattagtttatcattcatgttcattctaaacactacgcatacttcttactcatttctttttatccttttcaatctgtatcaaaatagtagagctttacacaaatttttatctaaatatcatctttcaattattttcacagtgattaaaaacaaagtttaaaaaaaactagaaaaaaataaaggtgaacattgacctgagggtgaggaaagcttttatatgaatgaaagtcatagatcaaattttccaaaagaaaagtgattcttttgtctatagttgtatattaaaaagcaatgtaataaattagatggcaagcaacaaactgagaaaaatattttttccaaaagtgtgagggagaaagggctgggtgcagtggctcacacctgtaatcccagcactttgggaggccaagacaggtagatctcttgaagtgaggagttcgagactgacctacgcaatatggtgaaaccccatttttactaaaaatacaaaaattagctgggtgtggtggtgcacacctgtagtcccagctattcgggaggctgagatgagaggatcgcttgaacccaaaaggcagaggttgcaatgagccaagattgtgccactgcacttcaccctgggtgacagaatgagactctgtgtcaaaacaacaacaacaacagcaacaacaacaaagacaggaaatgttaatgtctcaataagacactaatgtacaattcacaatagaaaattcttttacactataaaaatatttgcagcctcaatgttaatcaattgagataaattagattttatccaacatattaattttataaatacttaactataaaaaaactcaatatttgagatggtgcagtgatacagcgatacagcagtgtaatacgctacaagcacactgctaacagtctctgaaaagcagaacacgatgtcacctttaaaatgttctttaactctatacatcatatttctgagaatgcatcttaatgcaccaatccaggattgaccttcaagtatgcttatcttaaaacaattaaaaacagccaatgtccaatatgaagagaatggttgaataaaaggtaggaatataaaatcatgttatagaagattatggaatataggatggtatgaaataacataaatataaatctcagtttactatttttaaagactaagtattaaaattctcattggaagttgaaggtttgaatcctaatcactccaacactgtacaattgcattataaaatattttctttacacattctaacacaagagttagtgtatcactagataaaagttccatatgagttatttataaaagtagaaaatactttattgctgctggtgtcctgaaactgaataataaattcatctataaatcatttagtaccttaatgtctgtgggcccacttactgtgttaagtgcagaaaattattaacagtctggactttctaagtacataattttctattgtttattctttgttttataaagtgcccacatgttcaaaatatttttgataatgaccaagtagtctactttcttgatgacctggaacagtcatccttttttttcttgctggtatttttgttctaaaagggaaaagagtgtggaaaaggataatggattactttataagcattgtcttgacgacttggcaacaataatcaatactcaaaaacttttaagttcttaacacatttataccttgtaaataggggcacaatcacgtggaattcataggcagtttgcttttcttgtaccatcactcaattttttgaattaaagattttatatgagacttcggaattaatgatacaaagatgcatgaatgaaaatagagataaacccaattgtggaattaaatatacaatcagtagctaagaacaaggagataatgatgcttcagcaatcttaggaattattcaggtaaagaggggcaagcacagcactttgcactgaagaggactttagagatcaactacccaacactctccttttaaattagaggaaactgagcctatgaggatttaagtaatttgcctgtgatcactcagctaactagtagcataggaggaacaacaataaaggtctagatttacagtaaatttatctattaattcatttctacataactgcttcttgcattcaatgcacctagtgtaagtcaaagtcaggtatgcaatatggaaaatggtttagtctctttgtactccaaatccaggatcaaaacaacagaaaaataccagaaagacaaaaacaaaacaaacaaacaaaaacctcaagagggcactgagcagagatactgaatcaatgacaagctcttcccaatctccttccgtccccatccccaaaggctctgggtcagactaaaaagactactgaactacatcaaacaatttgtgtctatgtcccacattttcctaaatgtgtgaccttggacacttttctgtgccatcctgaacctcagttttatcatctagtcaaaactcaagatgatctctgaaaggtcccttcttcctatatgtcactacgcaggtgaaatacaccaggatttgccctgccttgtctttctgttctttttaaaacccttcgtccagtcaataagcccagtttttaaaaattcttgcagtttctattcaaaagaaaaaaatctaaagggtgtgtctaataacaagtgctctcaatatgaccataattgtactattgacattttggtgtttcagggtaatacaatttactgaaaaagaagaattaactctggctatataaagttgccgtatatttatttaaaatttcacgtattttcttccacaaaacttgattttcctctttcaaatcataggatatgaagaacttttcattagtaacatgaaagctactgactacatgtctaaaagattcatctttatttacatatctaggttcttctcttttaatcaacctgaaattacgtttttctagtagttaaaactaaacattctcttagtaaaatacagaagataacaggagaagaaaaagctgactatggaaaatttttctaactgtatgtcatctaagtttaacggtaaacttctagtagtctctcgggtcctaaaatgcttcaaatgaattcataatctgaatgggcttttaaacaacattgggattaggagtctggccctaccttctctggagcaaacatattgttgagaatggtttgcaccagaaggatcttctatcaccagtattactgttgttgttactgatatcaattatcatcatcatcatcatcatcatcttcttttggggggagggtagggtgtggatggagttttgctcttgtcgcccaggctggagtgcaatggcgcagtctcggctcactgcaacctccacctcccaggttcaagcaattttcctgcctcagcctcctgagtagctgggattacaggcatgcactaccatatttggtgaatttttatacttttagtagagacggggtttcaccatgttggtcaggctggtctcaaactcctgacctcaggtgatccacctgccttggcctcccaaagtgctgggattacaggcgtgagccactgcgtctggccatcctttttgcatataatcatttataaagtacataccccacaaattatcatgtttagacacatggacaaccattctatactattcatgcatgttatttattcctatttagcaagtgagaaaaccaatgttcagaaggattatgagatttactccattttatatccaaaatatagtaaaccaggctttgaacaaccctaattctagaacttcttttatctgtacctcaatgtggtaagcattatgtgatgtaggcacaagggttttctattttcataccaggtgtgcagtaatcaggcattctaaatttagcccaagaaacacacttaggtaatgccctgaaacagtcattgctattccttatctgggaattctgttatcattttgcatttgcaaaaatagtcattctataatatagaagtattctttcacattggcctcccacattgctggaaacatttctttatatttactcttcccccaaaaaagaatgagtgggaaacatagttaatatttattttgaaagaaaatagggcttaataaagggaacaattacatatttagtcaaggtagattaatagctgaggtttaccacttagcacactgcaaacaaaatctaacacgatactattgcactaatactagagcaatcattacaccagtaggtgtgccaaatgtggaactcaataacaaagcctacttaaaatgatcaagtattataagttagtacatgatcagtgattattctataaagtggggtttgggaagctaaacaaaccctaaattttttccttattcttcataatcaaaacacattacagatagacaaaagttaaatataaaaaaagagagcccccaaaaaatggtaaagtaaaaaaagatttaagaagcttaaaatggagtcacatttctaaacatgacataaaagcacacagaggaatgactgttaaaccttgatctattcaaaacattttagaaacaaaagattaaataactccaccaaaaaatgagtacataacttgaacagacatttcttcaaagatgatatacagatggccaacaagtacatgaaaagctgctcaacattactaatagagagatacaaatcaaaacctcaataagatataatttcatgcccattaggatagctactgtaaacacacacacacacgtaagtgttgacaagaatatggagaaattgaaccctcgtgcactgttgataggattgtaaaatggtgcaaccactatggaaaacagtatgaaaaaatatattaaaaatagaactatcttaagacacacttagatatatatcccaaaagaattaaaagcaggctcttaaagagacatttgtgcaagtttcttctctcaaaagcagactcatattgtacaagcccatatgactgctgaacagagtccaaatattctttatttcctttcattgagcactacaatcatcactcaaatcattacacttcaatcagcctgacacagaactgtgttctttaggactcagtagagagtactatgtaacaatgaagatcagaaaatgtctttggaagcatggaaccagacaaaacaaaagatgacagacagatcgatagatagatacagatcgataatagatccatagatagaatgcagttaataaggtgatttatataatctaaatgcttaatgtcagcttgttaaccaatagttcctcactctcataaacagtgtttgaatacatactgccaattgtttatgcctgctcaaattcttaccagtcctaccatctgattgacctgtcaactcaatctctttaaaacattgcatcttagttctgatgcattaagtgtagattttgtatgttaattcataatggaggaatcttatttctctgattttgacatctcttctttcccactgtactgtatgcaagcagtatagaacactttggagttaattgtgactgtaatattaattctagacaaactacaacagaagacacatcatggcagaatatactttaatattcctatattgtaacccacaacttttgatcactttacaaggtcaaactttgttattgctgagcatcacagtaatccaatgactataacaaaaagctgatgaccttaactttccaggtggccctagtataaagcctgactttgatgtatctaaacaagcacaaatatagaactcatcatgaggtctattagaatcataaaatcttctgagaggaagctatctagagccaccctgcttaagagatttaaaagcagacagatcaaagcatgtgtcattgagaatcctgctggttgtcatgagagaaggggtaaaattacaaacccattcagttgtatccattactgtaatgacctgaaatagactagaatgatgaaaatgaagggtgagtagcattgggtcataataatagtaatcacatatcatgtgacagtagtattgaatttttcttttgtacagcaaagacagtgttgtatttttttcctggatagctatggtaacaagctttatttctgaatgcctgatttcctgtctatagacccacacatctgagtaatatgcctatcccaaacattcattgtgatatcaaggatgagtcaaaaaacaagatggacatatgccaaacaattttatgtgaagggtaaaatctgtatttccattgattaccaaactgaattttgcacaggtaaaaagcaatggtgtcacataatcctgcatcttatcagctttcacatctcatgctttcttcaatgaatatggtgttcagattatatggttagggaaagaagaggctaaaaatgcctacatatctagcatgctgaaagaaaaagtctagaacagaaaggttctcttttcaggataagccagtctctagaagttagagcttaggacaatctccaggggaaaaattctcgggtgatgctagttataattctatgctccatggagccttcaattgactgtgtatttcttagagttctccctttaaaatatatttctcttcaaattgacgctatgcctcttttaaatgggccaccctgtatattctgaatgagctttttccagtaaagaactgtgttgatgtaaatctacgttggcaagagcgtcatcagagtcagctgggagtgacaggcatgttctagccaattctggacagtgtgttgaaatatgcttcccaggctgcaagagcaaatgcacaaaagcaagcccacgtcttgacaggggtgacgtgctgatcagcaaagccctggctctgtgagaacataaaatacgcaccaggagcatttcttgaggagaagccaaccaatcaatcacagcaagagccacataatccttacaggttaaaaggtgccagagcttacccttttccttagggcaaaaaaaaagaaagaaagaaaaaaatgtttgcacatgttgcttgcagggcgcactcctaagacacagaagatcgtatttcctaataactgccagccagtacaactaatataaatatgcaagcaggcagtaagaaccaacaattcaaactccaaagagaaagctatacatttcatatttgttttattaacaattatgataatgaaaatattcctgtataaatgttaaaacctggcatcatcttgtaaaagtatttcatgccaacacataaaacctatttatttaagaaaagcaatatcattgtgataattatgtgtataaactgttgtgacaaatgcaatatatatattttttcaaaaatatttttcagttcttcaatatctaggctgaacatcatattcaagaacaggattttgtgtccaaatcatggaaaaaatggcaatttcatattagaaaatctgtgccagggctatacatctgcaaactagcaatttcccaattgtttttctgtatcttctgtcatctgtctcattcttggagcatacacacacggccaagatgtgagaataatatgactttaccagacaggaatgttgaagtgaagatgactgggcagacctggccagtctggtacccaccacctctcccctcaatttctataaatgcagtgaggatgaattactgtttctggaactaattaaatagaccaaagaaaccggccatcccagcagaggagtttgtgcttgtctgactacatggtcttaaaaccaaggtccttgtcttgaatacacaaccgtcaccacacaaagtccaagactgccaggtcattgctcatcaccagatggctctgtaaatcccctactttgaaatccccagccttccccaattcctgcaaactcgccagcgtgactcctagcgttcagtctgtcatcagcaaaatctccttatgctcctgtatcttcagcatgttctctgactttcctgcaccatcttgctctgacactactggctgcccaccgagaatacggatttacttcagccctctgatgcagtggctatttttccttccacatgtttgtacctctgcccctagtgaagtaggagtctttctcattcttctctgctgcttccagaccatgatctcttccttgccctaaaatgtctttgtaactcacatcattaatctgctcccctcctaatccagttttctactgacctaaaggtctctcctctcagtctttaaacattttagccctgtctctctccagcgcaaactcttacataactcataattatcttttcctcccacggtctcccagtttctggatctcccttcagataatcttacctgaaacctcctttccttaccataagcaaggccttgccatgacagataacggtgccccataaccactgttaagcgtctctccctaccttctctctttctagctcatcccctccagtattctgactccaaaaatcttccaaacccaatgagtcctccagtgcattgaccttagaagttgttctgaccctcaccaaacttatgtccccttttccttagtgagcttagagtaaatatggcagcataatcacttctttgcatatccttttaaaactcagacttcactgaaatatctcatctctgttaaaccaacctttttcaaaccgtgcttgttgtggcctaagcagtcaatgatagttgaggaaaaacacaaccatgatgactttgaatttgtaactactggcctgaggtggctccttagtgccgtctgggaatttcacatttctctagacaaagcactctctcctcccagagatgatggatcatttctcaccttctctctcctcaaacctccaacatctgttctctgtctttacattgatgagcttattattttatcacaaaatagaaggaattaagagacacttttcatacactctgaaaccagatctatcaagatactgacctcctatactctcagactgtcctactcttctttctcatttattgtgaggactgaacaatcagcactcccattaagggcaactccttggcttgtgcactatctgaacttctccttacccctattcccccaaagcctcctcaagaatattgctcctgcaattgtccccagtttctcatgatcaaatgtcccctttctgctgcttctttctcaaaaccacacaaacataatacaattgacaacacaccctttgcccatatctcatttttcttcctatcccctccaactgactttacaacaaaactccaagagttaacaattgccaccacttcttttcccatcatctcttgaatccacttgacttagtccttttataaggaggccttcacctccagatactcacaactttgagtagtcctctctcacactgtaccagggttggcacatgtgagcagaagaatatggcagagtaatagtgtgttgctgccaagtctgggtcataaaagtcgttgtggcttctactttgcactctcttgaatcactgactcctgtgcctgaggtaggaacacccagccatcccattactgggtacatacccaaaggattataaatcatgctgctataaagacacatgcacatgtatgtttattgcagcactattcacaatagcaaagacttggaaccaacccaaatgtccaacaatgatagactggattaagaaaatgtggcacatatacaccatgaaatactatgcagccataaaaaaggatgagttcacgtgctttgtagggacatggatgaagctggaaaccatcattctcagcaaactatcgcaaggacaaaaaaccaaatatcacatgttctcacttgtaggtgggaattgaacaatgagaacacttggacacaggaagggggacatcacacaccggggcctattgtggggtggggggaggggagagggatagcattaggagatatacctaatgtaaatgacgagttaataatgggtgcagcacaccaacatggcacatgtatacatatgtaacaaacctgcacgctgtgcacatgttccctagaacttaaagtattaaaacaacaacaaaaaaaagaacacccagccctttggagaagcacaaacagtgaggaactgaagtcttctgccaacagccagtgtaaagcaaggctgcctgcggacagcaccatcttagaaaactgatcttccagtcccagatacagcttcagatgactatagccttcactgacaacttgagtgcaatttcttctaggaactttagtcagaaccagccagctaagctgctccctgatttctcagaaactgtatgcaataataaatgcttgttggtttaagcattggggaaatttgttatattccactctagtcagtcctgtatcatcactactctactgatcgacttgtgttgtatgccaccaattggctgcatgttgccaatgcaatgatcaattctcagttcttattttagttgacctatgagcagcatctgccacagtttatcacttttctgttgttgttgtttctttgtttttgagacagagtcttgctctgtcacccaggctggagtgcagtggcatgatctcagttcattgcaacctctgcctcctgggttcaagtgatgattctcctgcctcagactccccagtagctgggatcacaggtgcctgccaccacgcctggctgatttttgtaattttatttgagatgaggttttgccatgttggccaggctggtctcaaactcctgacctcaggggatccgcccaaagtgctgggattacagccgtgagccaccatgcccagccacttatttctcctgaaacagtttgttcatttggcctccagatatcactctcaatttttcttcaacctcactggcctctctgctgagttttcctcattttcctgatttctagattttaaagtgccccaactgtctcaggtcttttctctatatatacttgctccctgggtgattcattcagacttatcacttttaataccacctacattttaataactctcaagtgttcatctcaagtgctaatctgtgctccaaacttcagactcatacattcagttatctaagtgaaacctccatgcagaaatctaagaggcatccccaaaataaattttttaaaactaaactcctgatccacctcccctaaaaatgctccttccacaatcttcctcagcttgacaaatgacaactacattctacctgttgctaagtccacaaacttaagagttattcttgattcttctttctcactcttcacatccaatgcatccacaaattctgttggctgtgtcttcaaatggtagacagaattatgaccttttttttttttttttttttaactacttttacctctatttctctagtccacactgccaatacatgttacctgggttacttcaatagtttaactggtctctgcttccattttccccacatctttactttctacacaggagccgggatgattcttccaaaacttatgatagactgtgtcccttcctaacacagacattcctactactaacactttttgcttcaatacatcacagtcatcaccaaggaatgacccaagtctttactacaggctcaaagcactatgtgatctgatgcctttctgtggctcctacctcattttctataacttcccccctccctcaaatacgccaaccacatttggcgtacttgaaatcacaatgaaatgtacttctgctggataatcatatagctcgttcagtcatctctttcagatctctgctgaaatgtcttacatacaactctgtaactccttaccctgacttattcttctatactgtacttgtctttctctgacccactggaatatttatttgtgtgttgtcttctcctttattagaatatgtgctctttagcctgatgcagtggctcatgcctataatcccagcactttggaaggccgaggctggagaatggcttgagcccagaagtttgagaccagcctgggcaacatagtgagacccccatccctacaaaaaataaaaagttatctaggcctggtagcatgtgcctgtagtcccagctacctgagaggttgaggtgggaggcctcttgaacccagagcccaagaggtcaaggcttaggtgagcagtgatcatgccactttactctaggcggcctggacaaaagagtaagaccctgtctcaaaaaaaaaaaaaaaaaaaaaaagtatgccccaatgtatggaagactgtctatttcattcagttctctatctccagaagaacaataggtacacaggaaacactcaaactattttttgaatggatgaaaagaaaataggatatttcactcctgactctcaccttggtgagctagtgataaaatagagaaaattaccttcagagtaagatggttttctgtgtccagcccctcagaactgctagatgtgttctaagaattgtatacttttgcaattcagtaagaaggaaggcacagtcctcacgtaaataatgcctctgttctatgcatcagaacacaagtgccactagtagaattaacacatctgatttgaatgaaaacagcattgtgtatctatttcagaaggattatcttgggaaaagtagaagagcagtagctagctgaaagatggtatagattggtctaattgaactgagtctcaaagtccaactattgaaagtgttcagtgcacatacttgtggcttagcaagcttagcatggggtaagaactcaaaatgtcacttcctgttatgtggagtgaagctgttaggaaagataacatcatcatgtttcttttatacatataaatccctggtgtgtgtgtgtgtgtgtgtgtgtgtgtgtgtgtgtgatgtgagagcgagcgagcgagcaagcgagagcaagagagagagagatgttagcaatccttcaaaatctgattccaacctaccttccctagaggcactcaaactcacctaaaccccatgtaatccccatatttgttcacactattcccttggtgagaaaacacctcctgtcacttcccctccttccacacttcactgcagttctctccctgctgaaatctcccatgcttcacattcatatcaaattccttcctaggcccctctctctttgtgaaatgtgataataaaacctaaacctaatcaagttgcagtgaatattcaatgagatcatctaagacaatgctcagtagggtgcctgggacttctctgtgactatttcatctcactcatgaggtcttaagtgattcctagtaccagatacaatgtctccctcccataaattccaaccactctttatgcttagttatggcaactattgttttatggttgagtaatcatattctaacacctgttaggtcataatccttgagaacaaagacaatgccccaataacatcccatatagtaatttgtacagtgtagacagagtatgtgagtcaaattaagcttctagatttcaataggctcagatcaccttcagtgttctatcaattgtatgtttaccttttatttgaaagtactactgtctttcaagaggtctttttgttaaatatatcatttgaacttctaaataattttatgaaacatgtatgaattagtaatagttccacttacagatgaacttaattgtgatttgtggaatttaaataaccctaggatcccacagtgagtagcagagttggactatgcaatagattcctgaacctctttgtatatcacaagactgtgctaggtgctagggatacacctgtgaatgaggtagaactggttctccccttcacaaaatttactccctagggcagtagttcttaactgaaaacaatccctcgtcccctacaagggaaaactggcagtgcttggagacattttgaattttcacctcatggtggaaattaatgtcatctagtgggcagtggccagggatgttcttaacctcctacaatgcacaggagagcccccaccacaaagcatcattctggcccagtcatcagttctgctgaggttgagcaaccctgctctagattcggcttcaaaacgaaggatgtgaagtatccataggacacaataacacatagggttgcagagataggtgcagaactgatgacagatgcttagatgccatgttaaaggtgtgaactttatcctacagggcagggatcggcaaattacggccagtgggcgaaattcagcctatttgtttttgcaaatacagttttattggaacatgctaatgtccatttgtatatctgggcttcttttgcactaccgtggtagggttgaatagttgccccagagaccatagggtccgcaaagcctaaaatatttattttctggtccttttgttcacctctgctatagatagtggacaatcaaagcagaactgtagggtaattaatgagacagtataagtaggacatccttagtgggaaggagctagtggcacaaagacaagttagaatgttattgaaatagatcaaacacaaatctaagtattaaaatacctggtggtattgggagggaacagaacagcaagagataataggtgaaataatccataggcctaggcagaaggagggcaaggcagaagtcaaatatgattttttctggttttttgggaagataatggccagataaacagaagtagaaaaatcaaaaaggggggcacagtaagcttggttttgtgcgtgttaaatataaattaagagtggatcttccacgtggaaatgtccagaggaggcatatggaacttgagcctgggaaatgaggtttaagagtagggtttattaaaagagctgacagttggaattgaacagaggagagacacttgtggtgcagggaacatactgaataaggtcaaaggaataattatgtaaccgggggtactttcaattaaggtgctggaaacagagacaatgaaaagaaaagggagatctcatatgaataaagttaatccagtaaatgagacagtatcaacaaagagggatgagcatcaatttcaaatgctaataatattttgccatgactaatactgtgcatatcagtaagtgactttaaatgcaaaggcaatgctgctttaagtttgtttgtgtatgtacgtgttcatttgcaaagaaaactctcaagatgaatgtaagataatgtttctctttaatttatagctggtccaactctgacttttcttggaacttctgtttttttacttcaacgcatatcattgtcttctgaagtttctatcaacagtgtaaaatgaggagcttatgaataaagatgttcttttaaggccaggtacagtggctcatgcctgtaatcccagtactttgggaggctgagacaggcagatctcttgaggtcaggagttcgagaccagcctggcaaacatggtgaaaccccctctctaccaaaaatataaaaattaggcgggtatggtgttgcatgcctgtaatcctagctactcaggaggctgaggcaggagaattgcttgaacccaggaggcagaggttgcagtgagctgagatcgtgccactgcactccagcctgggcaacagagtgagactgtctaaaaagatgtccctttaagacagtttctcaacgtatggcttccacatcacctgtagggcttacaaagtcgactttctgggcatcacatcagacctattgtgggtgcagggctggcttcacaggtgtgacctatgaagttatacaggatcctactctcagaagggccttgtgctggattgaatgcagtgctgttgccatcatgaaatttgtaatatttatttgcgtaacgggccctgtattttcactttacctgggccctacaaattacgtagccagtgctgtgtgagcattctagcatggaaagtaattagtttacagagtaaaaaagattacagggtagaaaaatgtggttccttacttagctctcatttatttgcattgagacatactttttaaaacacccatgtttacactctttggaagtaaaacttggaatctaccattggcaggtacagaattttccacagaacattttttttttttttttttttttttttttgcatctgtgcagctaccaggtaagaacttaataattacagtgtgggaaaacagagtaccaacatactttctgcttagggattagcatcacccaatccaagttcagtgtgtttacctgcaactaagggattgagaacagaagaacttctgcaagaacaaatgtccctcttcctatggtggaagtatcagtggttcaggttggtatattagatggtttgaggttgtacaaagatggtgtttggcatagctgatgtggcttattgaattttaaaatgttgaattaaataaggagaagcttatttcctttccaaatccctttcagtaattcttattaccttaagaagaaagacttaattgtggtctttcatatgtctatattatttgctaaatgccattttaaacagagaacagacctcaggctcagagtctttggaaggtcatggttatctagctaaacttgaatctattttgccttgtttattgtatattttttcaattatcttctatgcataataaatgacgctagttccaaattacagtaatatacaaagctttatttttaaacatatggccttttaaataaaaatgtaagtctactagaaatattaaatgtaaacagtataaatggcccacagttgcacctaaaattgtgaaggtgattcaagaatgatcaatgtgttagtgaaactgctattcttattagtaagaaggctttattaaaggaagcctggttctattcagaggagaactgtagaaatcagccttgtgcattatcagcctgcaattcatatatattttagttattagtatccataaatcatacgctgttctatttggcaatcactcaatagaaggtcataaaaaaaatcacactgcacaaaataaagcaaagtaaaacaaatactattaacctaaagaaggcaaacaagcaggaatgataatccaagtaatcttaagtcagaaagttgcttgcttcaaaaggtcaacaatacacacttcaccatttataaatgtgaaattagccatgtatgaaaaaaaaaaaccaaaaaactggtaccctactaataacatgaagaggaagccactttattttaataatagctaatttaatcagagggttatctcaaaagggtaatggggaaaaattggtctcaaattactgcaatttaaaaatgatatatataatatttaactgtataaaaatatttatattaaaataatatttctatgctaaaccccttcaaaaaggttttctattattttagttcttctgaagatctactttggaaaaatggtacttaatttctgccagttaaaatttctccaaattaaaacactgaaaatgaaactatgaagggtttttttttgcaaatttctcaaaatcttgacatttcttttgtaagcttaggtcttgatatataatttaactgttatgaattctaaaagataaggattagtcatcagaatttaacaagctagttattcagtaatttcccaagaatcatagatacatttacacagatttttttcagaaatataacaggcataaataattttcaaagtataagctaaatattaaaatgcatgtatttgacaaattattgtgacagaataataagatacagaatcattcatatacaccaaagccaactataccaatctatgtgcatgtaaacccaaaacatacacacacacacacacacacacacacagagacacacactgagtcatggtgacaaagtccacacaaatggttaatcattgagttcaaagtttttttccactatggcaatcaaaaccaacatcaccaggacttctagtctggaagggtatggatccccctgggtgttcagcataaaagacacagcaacagaaggtatgtttctcaatcgatcaaaaaacaactatttattgaatgtatattatacaggtggcacttgtaccttcacagtggatacaatgattgatgaatgtggaggttcttacttttttttttttttttttgaaatggtatctcctctgttgtgcaatggtgcaatctcggctcaaagcaacctccgcctcctaggttccagcgattctcctgcctcagcctcccgagtagctcggattacaggcatgcaccaccatgcccagctaatttttatatttttagtagagacgaggtttcaccatgttgaacaggctggtctaaaactcctgacctcaagtgatccacgtgcctcagcctcccaaagtgctgggattacaggcatgaactaccgcacccggccggttcttactttttaggaacttacagtccagctacatacttgaaatacaaacatgaactagaagacagcataacatagaaaatgacaaataaatgtcaacacattcagtctgagagcccaaggaaagaaagattgcacccaatgaaggtaggtagttttggccctgtatacatttgcttacgaaaaccaaaagtcagaccaccaactcaaatgtttccactttgtttgctcttattaaagcttacactttttaaataatatattgaatcacagaaaacaatctctgaaacactatttctgagaagaaagacaacaatattagcttctagtcccagagatatttccattctaaaaggaaatatctcaagtcaaagagactattctataatgtggaatttggcatgaaggctggcaaagtggaaatggaaggatattgttttgaggtaagatgggtcttggtcctcctctatctggccacctaggtcactcaaagagagcctgtgagtcaggccagatcttgttaccaagcagtttgctgttctgttgcttagtgacttgaactagccggccatcattcccagctggctcttccagagtcaaaccttaacagatttctgacttgatctttctccttagagctcaagacttttttctttccctgaatgattgactataaaattattctctggctggctttgtttttacacctcttatgtaaaaacaaccctgaatcaaatgttctccattgaccccttttcaccaaggacatatatttctcctacacacacatatttttataagaatattttataaggatgtcaacttctatacaagccacatgtgtaaactaataaactgagattccacaccaaaaaagggctctgtctctacctttctgttaactactattttgtaaaatctttgaatattcattgttataacttcaatacacatgcagggtagggtaacaaatgtgaatgtgattcttagcccaaaggaaggtaatgctgaaagaaagaacacacgatggagagttaggaagacttgggttcaagttttaatgctattggtttcatagctgtttagctgaaagatcttggttatgtaagaactttttctgggcctcagcagctgcatatgtaaagtacggttaacaatacttacatccaaccttggttgttttaaggggttaatgtacacaaagtacctgacacatggcaggagctaaatcattgacgtctatgttataattaatctaaggttataaagctatattattatgaacctaagtgtttttattccaaaatgaaatcatgtaatttcttctcagatcaacttttcaagatctccttttgagaataagtgcctcatctgaaatacttggagagtatttatgtccttaaaactgcacataaaatgatttttctgttttgcttatttacagtagaagagactgatgtgttaagatggtataaaattgaagtctagtaaaagagaattttaaattagaatctttacagtgatctatacatttccctatctgttacctaaaattatgcctttcagatggtggcctaacgtgaataccaccaataccttcattctgaaggccctgaatcctatttatgagtcacagaattattaaataattctgtttcctgtttttacccatgtagcatctaccttactttcttacagcagcaagttggaacttgtttctaattgctaatcttaaatagactgtagtttgttatcactttgtaaatttaattagtcattactttttacttgtaaatgccaaatgcctttataaccatatgacttattaatagagtctccaagtcaaaaaggttgaataactaaggtcaagtatcaaatgaccagaagacctggaaatatgtgatttcaatatactgaatgaatcgcagctttaaaaacatgattttttaaaaagcaaaaccattaaaaaaaagacattattttgctacattagagatagtaaagcttcttcctgaaagtgctacttgaagaacaaatttggtagctttctatctaagaaaaaaaaagtgctgaaactcctttagttatctgaatacataggagcttttcaattataaagaaatttacacaaagaatattttttaaaaaatcaaagccatgattttcattattttaatgaactttaagattcaagtttttattttcttcttatcaacatttctgccaagtttgcaagaaagaccatgtcttcttaagaagagattttaccatcagtagcaacggcttcagctcgtacgaacaggcttcacatcttttctctttaagataaatgtcaatggtcatgggaagcacacgtgaataataagctgcaaggttatccaaggttttcttcacttttttctcaatgccaattgtcataatgtaatccctgtaattccttaaacatgacaagccaatcggcatgttctttaaaaggaaaatcttcctcaggtcttttgatttcgtggaaagccaactatgcctttcaaatggtacagacaccctcaacttgcagcgcctccacctcccatgatttccacagagggcaacagccagttatgccacagacatggctgaaggttagggctgactggtcttccccaaacattccagcagcacttcctggtgtgcttctcagatgatttcccccagaaacttgctccccaccttctggtattacactttgcctacagccctcctctgggttcctagttcccaggagactggcagcaatgctcttctccgggtattattaccataagagacagagaaaagataaccttaaagctaagcagggcagaagtaagagagatggaacgagggagaaagagacctcaaagagaaatcactaaataatggctttgaaaatctactcagttgtttgtgtgtgtatatgtgtatttttactctacaaactctaagtggctgtatttctcttttataggtgacaaatggtttctttccccttctatgacttgcaaatttatatttctcttaacaaccataaaaacaactacagttgctgaagaaataatgactcagaaagcaaatgtttacttttaaatatgagcaactttacatctaatgccaatgcctgataaagagaaatttatagtaaacaaaaaatatggccaaaatcacttatttagcttcctaaacacatttaagatttattaaaagtctcctaaaaggccttttgaaagtccacctaaagaaattattttgttgttaagattgttactaagtacttcttctactgttggatatgttttaattaaaaatacatatgtgtatacaagaattataaaaattatacagttgagtattacctagtcaccatgattcctaaagatatcctactacctaatttcgcttatatacacgctggaacattttcctccattcagtgcatcgagcacagtataaattgacaatgttttcatctagtccttaatcaggaatataatccccatgaaattacttatattagaaaactgtatttggttttaattatatttggaattaaaaatgtttttgagagatatatcataaataacaaacctgatgcatcttagtgaatgctacccatgaatattagtttttaatggttaatgttttcaaagtagcttgaaaatatttcactatgtagcctaaattgactgttaaattcaggaaattacatcttcatttccgttatagtaaaatgactcaatgtttttcattgtgacattcacttagattggagtgtgatactgacagctatagtaacaatattttaagagtataaacagctgggtttttagaggcaaattgacacagagttgtgcattgcttattctaagttctgagaaatgtgtcattaggcaatttcatcattgtgcagacatgttagagtgtacttacacaaacctagatggtatagcctattgctcctagcctacaaacctgtacagcatgttattctactgactattgtgggcaatcataacacaatggttaagtatttgtatatctaaacatagaaaaggtacagttaaaaatacagtataaaagataaaaaatgatatacctgtatggggcactgaccacgaatgcagcttacaggactgaaagttgctctgggtgactcagtgagtgagtggtgagtcaatgtgaaggcctgggacatttccacacactactatagactttataaacactgtacacttaggctacacttaatttataaatatttttatttctttgatataagttaattttggttactgtaactttttactttatacaactcttaattttcttttaattttttggctcttttgtaataacacttaacttgaaacactaacattatacagctgcacaaaaatattttctctatatctttattctataagcttttatttttaatttttttttactttctaaatatttttgttagaaactaagacacaaacacacattagcctaggcttacacaaggacaggatcatcagtatcattatcttcctcctccatatcttgtcccactggaagctcttctggggcaataacatgcatggagctgtcatctcctatgagaacaatgccctcttctagatacctcctgagggacctacctgaggctgttttatagttaacttttgtatataagtaggaggagtactctttaaaacaatggtaaaatacataaatacataaaccagcaacatagttattattaagtataatatataactatatatgctatatgtttatgggactgacagcatggtaggtttgtttacaccagcatgcccacaaacacaagagtaattaatgcattgtgctatgacttcactaggtgattggaatttttctggtccgttataatattatgggaccaccatcaaatatgcagtccaccattgactgaaatgctgttacatgtgtgtactgttgagcattttaaaaaatgatccaggtatatatatatgtgtgtatatatatgtaggtatatagatatatatatgtgtgtgtgtgtatatataggtacacaggtatatatatgtatatgggtacacatatgcgtatatgtgtatatgggtacacatatgcgtatatgtgtatatgggtacacatatgcgtatatgtgtatatgggtacacatatgcgtatatgggtacacatatgcgtatatgggtacacatatgcgtatatgggtacacatatgcatatatgtgtatatgggtacacatgtgtatatgtgtatatgggtacacatgtgtatatgtgtatatgggtacacatgtgtatatgtgtatatgggtacacatatgtgtatatgtgtatatgggtacacatatgtgtatatgtgtatatgggtacacatatgtgtatatgtgtatatgggtacacatgtgtatatgtgtatatgggtacacatatgtgtatatgtgtatatgggtacacatatgtgtatatgtgtatataggtacatatgtgtatatgtgtatatgggtacacatatgtgtatatgtgtatataggtacgtatgtgtatatgtgtatataggttcatatatgtgtatatatgtatataggttcatataggtatatataatatatgtatataggtacatatatgcatatatatgtatatatacacacacatattttatatatatattcacaactctattcctatactacgtactaaaaaagagcaaactgcttaaggatatatatatatatatatatatatatatatatatatatagcttgctctttctcattttatagtatggcatattatggagatatatatacatgtaccatctctatatataaaatggtaaacacacaaacaggacacatacatatgaagttaaaagacaatgacattcaaggaagaacacactgatttcaggatcctctgcgaaggaagaagaataggatgggtgacagctttagacattatctgtaacattttattcttaaaaaaataaaagaactgatgcaaacaatgacaaaattttggcattttaaaaatctgagtctggggtcaggggagcgggtagggatagctttaggagatatacctaatgctaaatgacgagttaatgggtgcagcacaccagcatggcacatgtatacatatgtaactaacctgcacattgtgcacatgtaccctaaaacttaaagtataataataataaaataaaaaataaaaaaaaatctgagtcgtggatatatagatgtgtattataaaaatatgaaaaaattataacttaagtgattataatgctaaattactttttaaaagaatatgtgaagataacaggttttatgacttaaatatgactaaacagcaacttttaagttcccaaagactgaaaaccagcatttctaccttgttcttctaaaacttatttaggccttacaccccaaaactgtgcttaaaattcaatgacgagaaaagcctgaagaatgtgaagaacttcctgatttcaattttcctgaaataaactagtactggaagttaagttttcttcaccagagattccattgactttgtagttcctgctgatgatagagggaatcccctaccagatgaaatctgaatcatgtctataatcactagaactacaaggcattgcatgtttagtaaaagcagtcaaacagattagtgaaaagcagagacacaagagaattctaatcctaacagatggtgccagaccaaaaccagtgctcaacacatactagctagtgataaaactattactaataagcattgagagtatcagagacaagaggcgcaatagaaatctgttccttgaaggaaggaacggattacttccagttgggagaactggaggaaccttttaggaaaaccaggaatttgaaagatgtatttttgcagtgggcagagaagagacaccaaaccccacagttctgcctcagtagtatctctcatttctgccttctcctttcctacagtaataaaactgacatacactcgtttctttcaactcttgtctcttcactctaattcatccacaaatgactgacagagtaatcatctagaaatttaaacatgatcctaaaggttcatgcagaccaaggctggaataatgggcacagagtacataataaaaaaaatactagcttataatgacacccactaagggtccagccctgtgaaaccacttaatttatacataattgtacttaattaaaccacaacccccaatagatactattcccagaaaactgactaacggggaaactgaagcacacgttaagtaacttgaccaaagtcacacaattactaaatgcaaagtaagaatttaagtttagtctcttttctaactgctttggtgctgagtgacatagcacctagagtatgctgtcaattcagtagctattctttaaatggatcatgaaaacccaagagaagtctagataaaaactacctggtaaatatagcatatagaaatgaaataacaggatgtttacttaagaaaagagaagtccctttttttttttttttttttttggtgacagagtcttgctctgtcacccaggctggagtgcagtggcacaatcatggctcactgcaacctccgcctcctgagttcaagtgattctcgtgcctcagcctcctgtggagctgggattacaggcacacatcaccatgcctggctaattttttgtatttttagtagagacggtgtttcgccatgttgcccaggctggtctcaaactcctgagctcagggactccgccctcctcagcctcccaaagtgctaggattataggcatgagccaccatgcttagcccaagagaagtcttttttaagagcatgagaacactaaaatattgattaatgaatttgtttagcagacatttattaagcttccaccattgaccagccatcatgccaagcatgggtataccaaaatgaatgaatagggccctggttctctggtgggttactccaagccacttgccttagggcttcataatggaagggagcaaaaattcaagttgtaggattcccaaagcagatcttggatccatggatgatagttgcagggaaggagacttctactgtttagaagcaaggtctttccaatcaacagccctatcaaacaacagaagtgcttctgtataatcttcatcaaggaggtttgacgagaggttcaaggacttgttattacagatgttattctaagaattcaacaatggcatatgttattacagatgttattctaagaattcaaccatggcatagagggtaaatcagatagcccttaacatactatataaccaagatagattagccaccagcactttaccttatgccttggaacagagctatgtttcccagcctcctttgcagttagatgtggccatagaactgagttccagccagaagaaaacgagtataagtgacatgtgcacttcccggcctgtctcataaaagttcacacataccatcctctttcatggtctttctcctgattcatctgagcctggcaaccttgggaatcacatgttgcaaataatggaaccacaggatggtagaattccaggtccctgaggcacccagtggctagggcaggctgcctccccacaaaaagcagaagcaagaaataaaaattcactgtgtcaatccaatgagatttggagactattttgtagaacagcaagattatcttagctaaaacagatgtcttccaatattattgatttattctaccatggtataaattattggaaaccaacaaatggttcttgctcaactttgtaataattaggtacagaataaacatgttagactcagtaggtattaagtgtatgcatagcgaatggaggggaataccaggagcaggaaactgtgaggcagaacactgtactagcaacaaattagatacaaatatatttatatttatgtcagaacaatttgaaacatattttcaaaattctccatagtgcttagcacaaactgtgaaagcacaaatgagatttttgtcaaaagatgcctgtggatattatgaacgtcttggggctcattcaaccaatatggaaaacttgagatactctttccaactcccttgcctgatagttttagtccataggggaaactgcttccttctgagttactgaaaatcgataccatgatttttatttctggtttccattgctctctttatgcttttcttactgggctgtgacctgatacactaaaatgaaatattgatagaaattgtgctcatgaagtttttccaaacagcaccagaaaaggaagtgccagaaatgtcagaagaaagcctattttcatgggatttcctgccttccttacatcccgacatgtctaaatagttcagataacctccagctgaactctaggttgctccactcagactgaaatcaaacagctgagttgagggccactcattcagcaatgggtgcaatttaggaactgcagtgataaagcagcgcaaccaaaagggacactggacacggaaattctggtcctggctccgtaggaactcatgccagctctcctgctctggcacccgatgcctggccttgagccaaccttctccttcagtgcatctcccagtgtttattcatgcctttcttttattcactgtttgttgctcacaattttttccaaaaagaaaatcttcctcaaagagaagccatcatttcccaataactgctttaagacagaaaaagtcaatgtttgtctcactcctcttatggccattacatctaccaaactcagaaatgccatctaggtgttaaaatcctggggacaataacactttcccagtcagagatctagctacttaaaaccaaatttttgaggttggtcatgtctttgggtgtgacatggcttttatttcctttgtcattgactttcatctataacatcaatgcattcctgagcacggtcttgtcactggtttaggttttaattccttttactttttgctgctttcctcctaaaagccttgtttctgctttttttttccctcccattgctaacgtacatactgtttagttagttatggcaaaactgtaaaaaattatttagtcatacagtttctcaactaacacactcattcttttttgttatgttttctttatcataatttatactcatcttatcaaaatgtagatgtaatgtatagaacctactactacctgaaattatctaagtgtgtaacatagaccctagtacttggactcactgatcagagtttggaatggcctctactcaggcagaaactccaaatactccaaataagctcacatgatggtctgttttaatatttgggtttttcttcttttttttttttccaagagcaggaaaagatgaggaatcctccagaaaaatacatggaagcatatgcatgaaacaaattcacccattataaagaagataaaaatattcacaaagaaaataaaaagattggcaaaatgttctaacaatccaaattcaaagaacacaacaatactaccaagtaccagcctgcaactttctgcgtagaattcctaatccctttcttctttcctttggaaaggcatgtttaagattatgaatactgtatatcaaagtcaggagtgaggaagggctttatgaagacacaccaccattacacacacactgtatgtgtctctgtccaagtggggatcatgcagaaaacagagcaaactatgattttcctcccctcatttctggtcctttctttcctcagctgttggggaagctggcagggaaattggtttaaggaatcaaagaaacgccactacgtacgtatgggaataaaactgcattcttatttgacatctggcatccaattttcttgtaggaacttgcaataggaattgaactttgagaaccacccacctcaaccactcctagtaccagtctccaggattcttgccctgacttggacatttgtgggatttatggttaagggagatcacttggccataaatccccggtgaggaatgatgatggtcctccctccctacccccaaaattaaaggcgcgagagcaggactccctgaagggaaacggccaccatttctgcgaggtctgcgcaaaccttaccatgtatgtgccaccgtgaaacgccgctgtttggggatgttgctgctgagaagcattctgcgcagaagcctgggggaatttctcggagagatcactggagagagcttgggagaaaccgatttcctcgctgtcttggacttctcatgctgcaacaggttttctcgcaaggatttcacaaggtcttcgttcagccacgggtttggacaatgcggattatccacttcaggtactgttaaagtgtccgggcttgtctgctgagccattttcctggtcaactttgtacagctggcaagaatccagggcaacgtggttccctcgctcacggtcccggaaatgtccagggaagcaggtctgagcctgctgctg
